(12) United States Patent
Meijrink et al.

(10) Patent No.: US 11,396,665 B2
(45) Date of Patent: Jul. 26, 2022

(54) CRISPR-CAS SYSTEM FOR A FILAMENTOUS FUNGAL HOST CELL

(71) Applicants: DSM IP ASSETS B.V., Heerlen (NL); RIJKSUNIVERSITEIT GRONINGEN, Groningen (NL)

(72) Inventors: Bernard Meijrink, Echt (NL); René Verwaal, Echt (NL); Bianca Elisabeth Maria Gielesen, Echt (NL); Johannes Andries Roubos, Echt (NL); Carsten Pohl, Echt (NL); Arnold Jacob Mattieu Driessen, Groningen (NL); Roelof Ary Lans Bovenberg, Echt (NL); Yvonne Irene Nygård, Echt (NL)

(73) Assignee: DSM IP ASSETS B.V., Heerlen (NL)

( * ) Notice: Subject to any disclaimer, the term of this patent is extended or adjusted under 35 U.S.C. 154(b) by 89 days.

(21) Appl. No.: 15/541,665

(22) PCT Filed: Jan. 6, 2016

(86) PCT No.: PCT/EP2016/000029
§ 371 (c)(1),
(2) Date: Jul. 5, 2017

(87) PCT Pub. No.: WO2016/110453
PCT Pub. Date: Jul. 14, 2016

(65) Prior Publication Data
US 2019/0194692 A1    Jun. 27, 2019

Related U.S. Application Data

(60) Provisional application No. 62/177,497, filed on Mar. 16, 2015, provisional application No. 62/177,496, filed on Mar. 16, 2015, provisional application No. 62/177,495, filed on Mar. 16, 2015.

(30) Foreign Application Priority Data

Jan. 6, 2015  (EP) .................................. 15150148
Jan. 6, 2015  (EP) .................................. 15150164

(51) Int. Cl.
| | | |
|---|---|---|
| C12N 15/00 | (2006.01) |
| C12N 15/90 | (2006.01) |
| C12N 1/14 | (2006.01) |
| C12N 9/22 | (2006.01) |
| C12N 15/11 | (2006.01) |
| C12N 15/113 | (2010.01) |
| C12P 1/02 | (2006.01) |

(52) U.S. Cl.
CPC ............ *C12N 15/902* (2013.01); *C12N 1/14* (2013.01); *C12N 9/22* (2013.01); *C12N 15/11* (2013.01); *C12N 15/113* (2013.01); *C12P 1/02* (2013.01); *C12N 2310/20* (2017.05); *C12N 2330/51* (2013.01); *C12N 2800/80* (2013.01)

(58) Field of Classification Search
CPC .......... C12N 15/902; C12N 1/14; C12N 9/22; C12N 15/11; C12N 15/113; C12N 2310/20; C12N 2330/51; C12N 2800/80; C12P 1/02
See application file for complete search history.

(56) References Cited

U.S. PATENT DOCUMENTS

| | | | | |
|---|---|---|---|---|
| 2014/0068797 | A1* | 3/2014 | Doudna ............... | C12N 15/902 800/18 |
| 2014/0303036 | A1* | 10/2014 | Roubos .............. | C12N 15/1027 506/10 |
| 2015/0211013 | A1* | 7/2015 | Emalfarb ................ | C12P 21/00 506/9 |
| 2016/0237466 | A1* | 8/2016 | Landowski ............. | C12P 21/02 |
| 2018/0010151 | A1* | 1/2018 | Verwaal ............... | C12N 15/102 |
| 2018/0023096 | A1* | 1/2018 | Meijrink ................ | C12N 15/63 435/67 |

FOREIGN PATENT DOCUMENTS

| | | |
|---|---|---|
| WO | 2014/191521 A2 | 12/2014 |
| WO | 2015/004241 A2 | 1/2015 |
| WO | 2015/017866 A1 | 2/2015 |
| WO | WO-2015054507 A1 * | 4/2015 ............. C12P 21/02 |

OTHER PUBLICATIONS

Schoberle et al., Plasmids for increased efficiency of vector construction and genetic engineering in filamentous fungi, Jul. 16, 2013, Fungal Genetics and Biology, 58-59, 1-9 (Year: 2013).*
Koonin et al. Diversity, classification and evolution of CRISPR-Cas systems, 2017, Current Opinion in Microbiology, 37, 67-78 (Year: 2017).*
Goswami, Targeted Gene Replacement in Fungi Using a Split-Marker Approach, 2012, Plant Fungal Pathogens: Methods and Protocols, Methods in Molecular Biology, Chapter 16, pp. 255-269. (Year: 2012).*
Raymond, General Method for Plasmid Construction Using Homologous Recombination, Jan. 1999, BioTechniques, 26, 134-141 (Year: 1999).*
Aleksenko & Clutterbuck "" Fungal Genetics and Biology vol. 21, No. 3, Jun. 1997, pp. 373-387). (Year: 1997).*
Doudna (Science, Nov. 2014, vol. 396, No. 6213; pp. 1-9). (Year: 2014).*
Nodvig et al. entitled A CRISPR-Cas9 System for Genetic Engineering of Filamentous Fungi in post-filing PLOS ONE, published Jul. 15, 2015, pp. 1-18). (Year: 2015).*
Ryan, Owen W. et al., "Multiplex Engineering of Industrial Yeast Genomes Using CRISPRm", The Use of CRISPR CAS9, ZFNS, Talens in Generating Site Specific Genome Alterations, Jan. 1, 2014, vol. 546, pp. 473-489.
Baldwin, Thomas et al., "What is the best type of promoter for expression of guide RNAs in the CRISPR CAS system?", Research Gate, Dec. 18, 2014.

(Continued)

*Primary Examiner* — Catherine S Hibbert
(74) *Attorney, Agent, or Firm* — McBee Moore & Vanik IP, LLC; Susan McBee; Chester Moore

(57) ABSTRACT

The present invention relates to the field of molecular biology and cell biology. More specifically, the present invention relates to a CRISPR-CAS system for a filamentous fungal host cell.

25 Claims, 41 Drawing Sheets

Specification includes a Sequence Listing.

(56) References Cited

OTHER PUBLICATIONS

Gao, Yangbin et al., "Self-processing of ribozyme-flanked RNAs into guide RNAs in vitro and in vivo for CRISPR-mediated genome editing", Journal of Integrative Plant Biology, Apr. 6, 2014, vol. 56, No. 4, pp. 343-349.

Bao, Zehua et al., "Homology-Integrated CRISPR-Cas (HI-CRISPR) System for One-Step Multigene Disruption in *Saccharomyces cerevisiae*", ACS Synthetic Biology, Sep. 10, 2014, XP055175736.

Xu, Kun et al., "Efficient genome engineering in eukaryotes using Cas9 from *Streptococcus thermophilus*", Cellular and Molecular Life Sciences, Jul. 20, 2014, vol. 72, No. 2, pp. 383-399.

Ryan, Owen W. et al., "Selection of chromosomal DNA libraries using a multiplex CRISPR system", ELIFE, vol. 3, Aug. 19, 2014, XP055175718.

Aleksenko, A. et al., "Autonomous plasmid replication in Aspergillus nidulans: AMA1 and MATE elements", Fungal Genetics and Biology, San Diego, CA, US, Jan. 1, 1997, vol. 21, pp. 373-387.

Sakuma, Tetsushi et al., "Multiplex genome engineering in human cells using all-in-one CRISPR/Cas9 vector system", Scientific Reports, Jun. 23, 2014, vol. 4.

Kooistra, Rolf et al., "Efficient gene targeting in Kluyveromyces lactis", Yeast, Jul. 15, 2004, vol. 21, No. 9, pp. 781-792, John Wiley & Sons Ltd, GB.

Sidik, Saima M. et al., "Efficient Genome Engineering of Toxoplasma gondii Using CRISPR/Cas9", PLOS ONE, Jun. 27, 2014, vol. 9, No. 6, p. e100450.

Nodvig, Christina S. et al., "A CRISPR-Cas9 System for Genetic Engineering of Filamentous Fungi", PLOS ONE, Jul. 15, 2015, vol. 10, No. 7, p. e0133085.

International Search Report of International Patent Application No. PCT/EP2016/000029 dated Jun. 10, 2016.

Arazoe, Takayuki et al., "Site-specific DNA double-strand break generated by l-SceI endonuclease enhances ectopic homologous recombination in Pyricularia oryzae", FEMS Microbiology Letters, Mar. 2014, vol. 352, pp. 221-229.

Casqueiro, Javier et al., "Gene Targeting in Penicillium chrysogenum: Disruption of the lys2 Gene Leads to Penicillin Overproduction", Journal of Bacteriology, Feb. 1999, pp. 1181-1188, vol. 181, No. 4.

De Boer, Paulo et al., "Highly efficient gene targeting in Penicillium chrysogenum using the bi-partite approach in deltalig4 or deltaku70 mutants", Fungal Genetics and Biology, Oct. 2010, pp. 839-846, vol. 47.

Krappmann, Sven et al., "Gene Targeting in Aspergillus fumigatus by Homologous Recombination is Facilitated in a Nonhomologous End-Joining-Deficient Genetic Background", Eukaryotic Cell, Jan. 2006, pp. 212-215, vol. 5, No. 1.

Oldenburg, Kevin R. et al., "Recombination-mediated PCR-directed plasmid construction in vivo in yeast", Nucleic Acids Research, 1997, pp. 451-452, vol. 25, No. 2.

* cited by examiner

Fig. 6

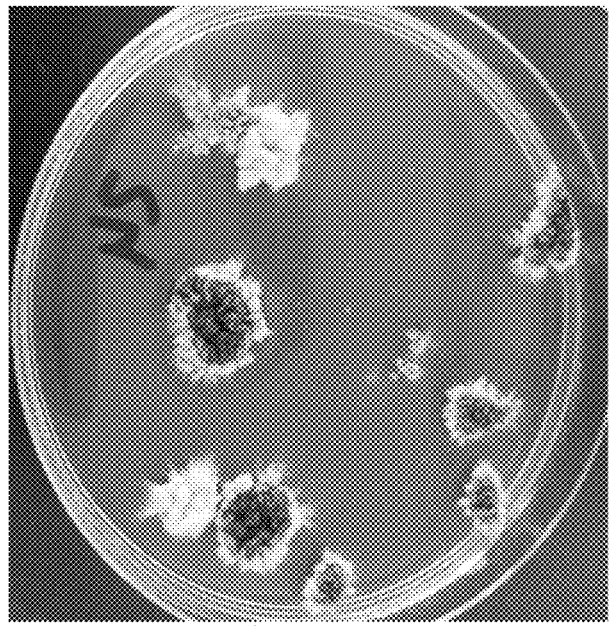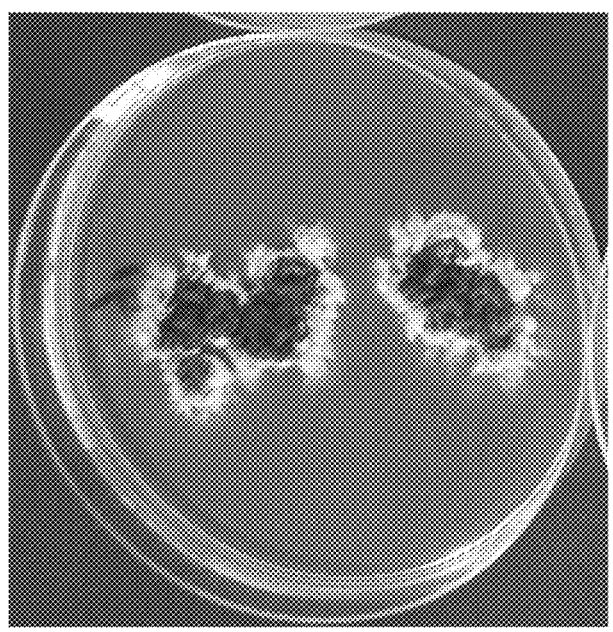
Fig. 9

CRISPR-CAS SYSTEM FOR A FILAMENTOUS FUNGAL HOST CELL

CROSS-REFERENCE TO RELATED APPLICATIONS

This application is a National Stage entry of International Application No. PCT/EP2016/000029, filed Jan. 6, 2016, which claims priority to European Patent Application No. 15150148.3, filed Jan. 6, 2015, European Patent Application No. 15150164.0, filed Jan. 6, 2015, U.S. Patent Application No. 62/177,495, filed Mar. 16, 2015, U.S. Patent Application No. 62/177,496, filed Mar. 16, 2015, and U.S. Patent Application No. 62/177,497, filed Mar. 16, 2015. The disclosures of the priority applications are incorporated in their entirety herein by reference.

REFERENCE TO SEQUENCE LISTING SUBMITTED AS A COMPLIANT ASCII TEXT FILE (.txt)

Pursuant to the EFS-Web legal framework and 37 CFR §§ 1.821-825 (see MPEP § 2442.03(a)), a Sequence Listing in the form of an ASCII-compliant text file (entitled "Sequence_Listing_2919208-313003_ST25.txt" created on 14 Jun. 2017, and 173,216,480 bytes in size) was submitted via CD, and the entire contents of the Sequence Listing are incorporated herein by reference.

FIELD OF THE INVENTION

The present invention relates to the field of molecular biology and cell biology. More specifically, the present invention relates to a CRISPR-CAS system for a filamentous fungal host cell.

BACKGROUND TO THE INVENTION

Recent advances in genomics techniques and analysis methods have significantly accelerated the ability to e.g. catalog and map genetic factors associated with a diverse range of biological functions and diseases. Precise genome engineering technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors nucleases (TALENs), or homing meganucleases are available for producing targeted genome perturbations, there remains a need for new genome engineering technologies that are affordable, easy to set up, scalable, and amenable to targeting multiple positions within a genome. The engineering of meganucleases has been challenging for most academic researchers because the DNA recognition and cleavage functions of these enzymes are intertwined in a single domain. Robust construction of engineered zinc finger arrays has also proven to be difficult for many laboratories because of the need to account for context-dependent effects between individual finger domains in an array. There thus exists a pressing need for alternative and robust techniques for targeting of specific sequences within a host cell with a wide array of applications.

SUMMARY OF THE INVENTION

The present invention addresses above described need and provides such technique. The present invention is based on the CRISPR-Cas system, which does not require the generation of customized proteins to target-specific sequences but rather a single Cas enzyme that can be programmed by a guide-polynucleotide to recognize a specific polynucleotide target; in other words, the Cas enzyme can be recruited to a specific polynucleotide target using said guide-polynucleotide molecule. Adding the CRISPR-Cas system to the repertoire of genomics techniques and analysis methods may significantly simplify existing methodologies in the field of molecular biology.

The present invention provides a non-naturally occurring or engineered composition comprising a source of a CRISPR-Cas system comprising a guide-polynucleotide and a Cas protein, wherein the guide-polynucleotide comprises a sequence that essentially is the reverse complement of a target-polynucleotide in a host cell and the guide-polynucleotide can direct binding of the Cas protein at the target-polynucleotide in the host cell to form a CRISPR-Cas complex.

The present invention further relates to a method of modulating expression of a polynucleotide in a cell, comprising contacting a host cell with the composition according to the present invention, wherein the guide-polynucleotide directs binding of the Cas protein at the target-polynucleotide in the host cell to form a CRISPR-Cas complex.

The present invention further relates to a host cell comprising a composition according to the present invention.

The present invention further relates to a method of producing a host cell, comprising contacting a host cell with the composition according to the present invention, wherein the guide-polynucleotide directs binding of the Gas protein at the target-polynucleotide in the host cell to form a CRISPR-Cas complex.

The present invention further relates to a method. for the production of a compound of interest, comprising culturing under conditions conducive to the compound of interest a host cell according to the present invention and optionally purifying or isolating the compound of interest.

BRIEF DESCRIPTION OF THE DRAWINGS

FIG. 6 depicts the alignment of the genomic sequence of the fwnA6 gene (SEQ ID NO: 1), the 20 bp that is incorporated in the gRSR responsible for specifically targeting the genome (SEQ ID NO: 138) and the donor DNA (SEQ ID NO: 119) that will facilitate the repair of the double stranded cut via HDR and thereby introduce the frame shift in fwnA6 and/or the point mutation in the PAM sequence (CGG to CCG).
FIG. 9 depicts pictures taken from transformation plates corresponding to transformation 6 and 8, respectively, as described in Table 3. On the left, one of the plates from transformation 6 with colonies forming black spores and on the right one of the plates from transformation 8 with black spore colonies and white/fawn spore colonies.

(FIG. 16A) Depicts the correct assembly of gRSR fwnA cassette in AMA-plasmid and BG-AMA6. (Figure B) depicts no assembly of gRSR fwnA cassette in circular plasmid BG-AMA5.

DESCRIPTION OF THE SEQUENCE LISTING

Figure 1:
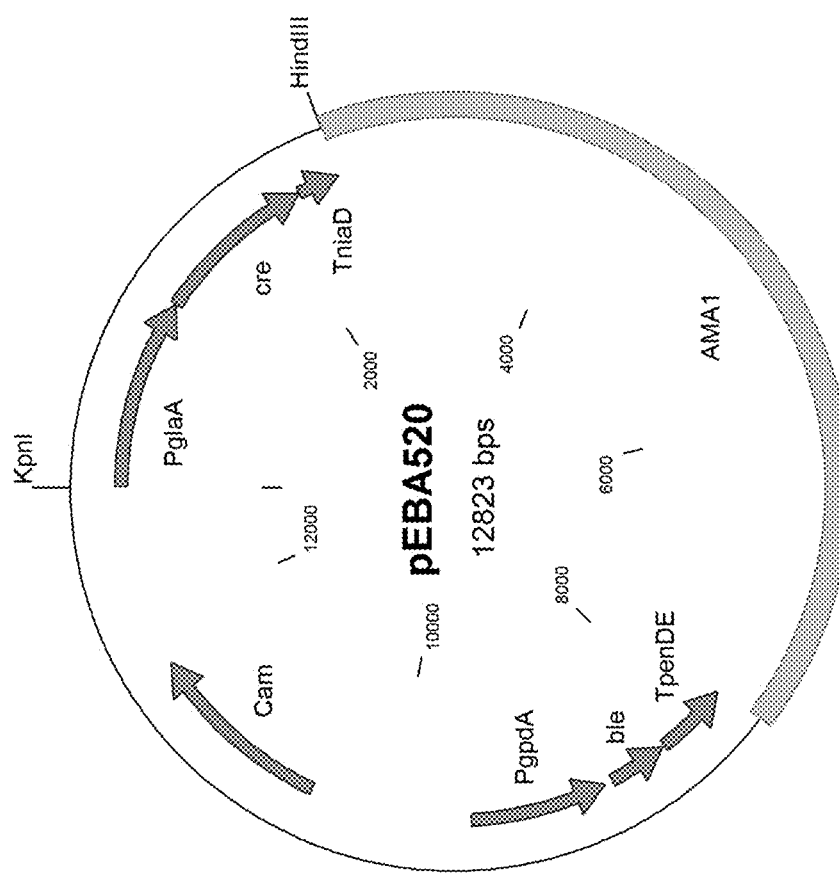
FIG. 1 depicts a plasmid map of vector pEBA520.

SEQ ID NO: 1 sets out the genome of *Aspergillus niger* CBS 513.88.

SEQ ID NO: 2 sets out the genome of *Penicillium chrysogenum* Wisconsin 54-1255.

SEQ ID NO: 3 sets out the genome of *Rasamsonia emersonii* CBS393.64.

SEQ ID NO: 4-6 empty.

SEQ ID NO: 7 sets out the genome of *Mortierella alpina* ATCC 32222

SEQ ID NO: 8-94 empty.

SEQUENCES IN EXAMPLES 1-41

SEQ ID NO: 95 sets out plasmid pEBA520

SEQ ID NO: 96 sets out forward primer DBC-05797

SEQ ID NO: 97 sets out revere primer DBC-10681

SEQ ID NO: 98 sets out plasmid pRPBdsRED7354

SEQ ID NO: 99 sets out forward primer DBC-10680

SEQ ID NO: 100 sets out reverse primer DBC-05796

SEQ ID NO: 101 sets out template ccdB cassette

SEQ ID NO: 102 sets out plasmid BG-AMA1

SEQ ID NO: 103 sets out promoter fragment Pc.FP017

SEQ ID NO: 104 sets out the coding sequence for CAS9

SEQ ID NO: 105 sets out the terminator sequence Pc.FT029

SEQ ID NO: 106 sets out backbone vector 5a

SEQ ID NO: 107 sets out resulting vector BG-C19

SEQ ID NO: 108 sets out forward primer DBC-13112

SEQ ID NO: 109 sets out reverse primer DBC-13114

SEQ ID NO: 110 sets out plasmid BG-AMA2

SEQ ID NO: 111 sets out promoter fragment Pc.PAF

SEQ ID NO: 112 sets out promoter fragment Te.FP036

SEQ ID NO: 113 sets out the terminator sequence Pc20g04380

SEQ ID NO: 114 sets out the gBlock self-processing ribozyme

SEQ ID NO: 115 sets out plasmid BG-AMA-3

SEQ ID NO: 116 sets out plasmid BG-AMA-4

SEQ ID NO: 117 sets out forward primer DBC-05795

SEQ ID NO: 118 sets out reverse primer DBC-05796

SEQ ID NO: 119 sets out gBlock donor DNA fwnA6

SEQ ID NO: 120 sets out forward primer DBC-12195

SEQ ID NO: 121 sets out reverse primer DBC-12196

SEQ ID NO: 122 sets out forward primer DBC-13318

SEQ ID NO: 123 sets out reverse primer DBC-13319

SEQ ID NO: 124 sets out sequencing primer DBC-13320

SEQ ID NO: 125 sets out resulting vector BG-C20

SEQ ID NO: 126 sets out plasmid BG-AMA-5

SEQ ID NO: 127 sets out promoter fragment An.TEF

SEQ ID NO: 128 sets out plasmid BG-AMA-6
SEQ ID NO: 129 sets out plasmid donor DNA fwnA6
SEQ ID NO: 130 sets out the *A. nidulans* TEF promoter
SEQ ID NO: 131 sets out plasmid BG-AMA7
SEQ ID NO: 132 sets out a Cas9/phleo fragment
SEQ ID NO: 133 sets out a forward PCR primer to check the presence of the Cas9 open reading frame
SEQ ID NO: 134 sets out a reverse PCR primer to check the presence of the Cas9 open reading frame
SEQ ID NO: 135 sets out plasmid pEBA513
SEQ ID NO: 136 sets out plasmid BG-AMA8
SEQ ID NO: 137 sets out plasmid BG-AMA9
SEQ ID NO: 138 sets out gRSR fwnA cassette with overlap
SEQ ID NO: 139 sets out a forward PCR primer to check the assembly of the gRSR fwnA fragment into the AMA-plasmid
SEQ ID NO: 140 sets out a reverse PCR primer to check the assembly of the gRSR fwnA fragment into the AMA-plasmid
SEQ ID NO: 141 sets out a reverse PCR primer to check the assembly of the guide RNA into the AMA-plasmid
SEQ ID NO: 142 sets out donor DNA nicB
SEQ ID NO: 143 sets out a forward primer for PCR amplification of the donor DNA from the cloning vector
SEQ ID NO: 144 sets out a reverse primer for PCR amplification of the donor DNA from the cloning vector
SEQ ID NO: 145 sets out gBlock nicB single
SEQ ID NO: 146 sets out plasmid BG-AMA10
SEQ ID NO: 147 sets out gRNA fwnA multiplex
SEQ ID NO: 148 sets out gRNA nicB multiplex
SEQ ID NO: 149 sets out plasmid BG-AMA11
SEQ ID NO: 150 sets out gRSR fwnA+linker multiplex
SEQ ID NO: 151 sets out a forward PCR primer
SEQ ID NO: 152 sets out plasmid BG-AMA12
SEQ ID NO: 153 sets out forward primer donor DNA fwnA ~350 bp flank
SEQ ID NO: 154 sets out reverse primer donor DNA fwnA ~350 bp flank
SEQ ID NO: 155 sets out forward primer donor DNA fwnA ~250 bp flank
SEQ ID NO: 156 sets out reverse primer donor DNA fwnA ~250 bp flank
SEQ ID NO: 157 sets out forward primer donor DNA fwnA ~130 bp flank
SEQ ID NO: 158 sets out reverse primer donor DNA fwnA ~130 bp flank
SEQ ID NO: 159 sets out forward primer donor DNA fwnA ~55 bp flank
SEQ ID NO: 160 sets out reverse primer donor DNA fwnA ~55 bp flank
SEQ ID NO: 161 sets out donor DNA fwnA ~350 bp
SEQ ID NO: 162 sets out donor DNA fwnA ~250 bp
SEQ ID NO: 163 sets out donor DNA fwnA ~130 bp
SEQ ID NO: 164 sets out donor DNA fwnA ~55 bp
SEQ ID NO: 165 sets out an amdS expression cassette
SEQ ID NO: 166 sets out a forward PCR primer for amplification of the amdS expression cassette
SEQ ID NO: 167 sets out a reverse PCR primer for amplification of the amdS expression cassette
SEQ ID NO: 168 sets out a gBlock gRSR fragment
SEQ ID NO: 169 sets out plasmid BG-AMA16
SEQ ID NO: 170 sets out the nucleotide sequence of the gBlock to introduce a stop codon into the amdS gene in *R. emersonii*.
SEQ ID NO: 171 sets out the nucleotide sequence of the gBlock to delete the amdS gene in *R. emersonii*.
SEQ ID NO: 172 sets out the nucleotide sequence of the gBlock to introduce a stop codon into the amdS gene in *R. emersonii* cloned into a TOPO Zero Blunt vector.
SEQ ID NO: 173 sets out the nucleotide sequence of the gBlock to delete the amdS gene in *R. emersonii* cloned into a TOPO Zero Blunt vector.
SEQ ID NO: 174 sets out the nucleotide sequence of the Pc_tef promoter.
SEQ ID NO: 175 sets out the nucleotide sequence of the gBlock of the guide RNA.
SEQ ID NO: 176 sets out the nucleotide sequence of the AMA plasmid containing the CAS9 expression cassette under control of the Pc_FP017 promoter.
SEQ ID NO: 177 sets out the nucleotide sequence of the forward primer to amplify the CAS9 expression cassette.
SEQ ID NO: 178 sets out the nucleotide sequence of the CAS9 expression construct under control of the PC_FP017 promoter and a guide RNA cassette under control of the Pc_tef promoter.
SEQ ID NO: 179 sets out the nucleotide sequence of the AMA plasmid containing the CAS9 of the Anid_tef promoter.
SEQ ID NO: 180 sets out the nucleotide sequence of the CAS9 expression construct under control of the Anid_tef promoter and a guide RNA cassette under control of the Pc_tef promoter.
SEQ ID NO: 181 sets out the nucleotide sequence of the forward primer to amplify the genomic DNA of the amdS gene.
SEQ ID NO: 182 sets out the nucleotide sequence of the reversed primer to amplify the genomic DNA of the amdS gene.
SEQ ID NO: 183 sets out the nucleotide sequence of the forward primer to amplify the genomic DNA of the amdS locus.
SEQ ID NO: 184 sets out the nucleotide sequence of the reversed primer to amplify the genomic DNA of the amdS locus.
SEQ ID NO: 185 sets out the nucleotide sequence of the forward primer for the sequence reaction of the introduced stop mutation.
SEQ ID NO: 186 sets out the nucleotide sequence of the forward primer to amplify the amdS_stop donor DNA.
SEQ ID NO: 187 sets out the nucleotide sequence of the reversed primer to amplify the amdS_stop donor DNA.
SEQ ID NO: 188 sets out the nucleotide sequence of the forward primer to amplify the amdS_deletion donor DNA.
SEQ ID NO: 189 sets out the nucleotide sequence of the reversed primer to amplify the amdS_deletion donor DNA.
SEQ ID NO: 190 sets out pDEST-PKS17
SEQ ID NO: 191 sets out forward primer 184
SEQ ID NO: 192 sets out reverse primer 189
SEQ ID NO: 193 sets out gRNA Pks17 >846r
SEQ ID NO: 194 sets out gRNA tail
SEQ ID NO: 195 sets out forward oligo gRNA pPks17 >846r
SEQ ID NO: 196 sets out reverse oligo gRNA pPks17 >846r
SEQ ID NO: 197 sets out CAS9 expression cassette
SEQ ID NO: 198 sets out gRNA expression cassette "U6")
SEQ ID NO: 199 sets out gRNA expression cassette "U3")
SEQ ID NO: 200 sets out gRNA expression cassette "tRNA-Met")
SEQ ID NO: 201 sets out gRNA expression cassette "tRNA-Leu")
SEQ ID NO: 202 sets out 5' flank AMA1
SEQ ID NO: 203 sets out 3' flank AMA1
SEQ ID NO: 204 sets out pYN2-4

SEQ ID NO: 205 sets out gRNA Pks17 >235r
SEQ ID NO: 206 sets out forward oligo gRNA pPks17 >235r
SEQ ID NO: 207 sets out reverse oligo gRNA pPks17 >235r
SEQ ID NO: 208 sets out gRNA expression cassette "U6 pKS17-235")
SEQ ID NO: 209 sets out 120 bp donor DNA
SEQ ID NO: 210 sets out gRNA tail long
SEQ ID NO: 211 sets out forward oligo gRNA Pks17 235 long
SEQ ID NO: 212 sets out reverse oligo gRNA Pks17 235 long
SEQ ID NO: 213 sets out U6 promoter
SEQ ID NO: 214 sets out U6 terminator
SEQ ID NO: 215 sets out gRNA expression cassette "U6 pKS17>235 long")
SEQ ID NO: 216 sets out tRNA-Met promoter
SEQ ID NO: 217 sets out tRNA-Met terminator
SEQ ID NO: 218 sets out gRNA expression cassette "tRNA-Met pKS17>235 long"
SEQ ID NO: 219 sets out tRNA-Leu promoter
SEQ ID NO: 220 sets out tRNA-Leu terminator
SEQ ID NO: 221 sets out gRNA expression cassette "tRNA-Leu pKS17>235 long"
SEQ ID NO: 222 sets out utp25 promoter
SEQ ID NO: 223 sets out utp25 terminator
SEQ ID NO: 224 sets out gRNA expression cassette "utp25 pKS17>235 long"
SEQ ID NO: 225 sets out forward primer pks17_5'_Bpil_F
SEQ ID NO: 226 sets out reverse primer pks17_5'_Bpil_R
SEQ ID NO: 227 sets out forward primer pks17_3'_Bpil_F
SEQ ID NO: 228 sets out reverse primer pks17_3'_Bpil_R
SEQ ID NO: 229 sets out forward primer pks17_1 kb_F
SEQ ID NO: 230 sets out reverse primer pks17_1 kb_R
SEQ ID NO: 231 sets out donor DNA 2 kb marker free DNA fragment targeting pKS17
SEQ ID NO: 232 sets out xInA CAS9 expression cassette
SEQ ID NO: 233 sets out pDSM-YN2 vector
SEQ ID NO: 234 sets out primer 5'_F
SEQ ID NO: 235 sets out primer 5'_R
SEQ ID NO: 236 sets out 5' flanking region for HR pDSM-YN2 vector
SEQ ID NO: 237 sets out primer 3'_F
SEQ ID NO: 238 sets out primer 3'_R
SEQ ID NO: 239 sets out 3' flanking region for pDSM-YN2 vector
SEQ ID NO: 240 sets out pYN2_18_A_5'-XInA-Cas9-Utp25_Pks17
SEQ ID NO: 241 sets out pYN2_19_A_5'XInA-Cas9-U6_Pks17
SEQ ID NO: 242 sets out pYN2_20_A_5'-XInA-Cas9-tRNA-Leu_Pks17
SEQ ID NO: 243 sets out pYN2_21_A_5'-XInA-Cas9-tRNA-Met_Pks17
SEQ ID NO: 244 sets out pYN2_22_B_Utp25_Pks17-amdS-3'
SEQ ID NO: 245 sets out pYN2_23_B_U6_Pks17-amdS-3'
SEQ ID NO: 246 sets out pYN2_24_B_tRNA_Leu_Pks17-amdS-3'
SEQ ID NO: 247 sets out pYN2_25_B_tRNA_Met_Pks17-amdS-3')
SEQ ID NO: 248 sets out pks17_0.25 kb_F
SEQ ID NO: 249 sets out pks17_0.25 kb_R
SEQ ID NO: 250 sets out template for in vitro gRNA synthesis
SEQ ID NO: 251 sets out pYN2_28_Xyl-Cas9_AMDS_3

DETAILED DESCRIPTION OF THE INVENTION

In a first aspect, the present invention provides a non-naturally occurring or engineered composition comprising a source of a CRISPR-Cas system comprising a guide-polynucleotide and a Cas protein, wherein the guide-polynucleotide comprises a guide-sequence that essentially is the reverse complement of a target-polynucleotide in a host cell and the guide-polynucleotide can direct binding of the Cas protein at the target-polynucleotide in the host cell to form a CRISPR-Cas complex, wherein the guide-sequence is essentially the reverse complement of the (N)y part of a 5'-(N)yPAM-3' polynucleotide sequence target in the genome of the host cell, wherein y is an integer of 8-30, more preferably 10-30, more preferably 15-30, more preferably 17-27, more preferably 17-20, more preferably 17, 18, 19, 20, 21, 22, 23, 24, 25, 26, or 27, wherein PAM is a protospacer adjacent motif, wherein the host cell is a eukaryote, which eukaryote is a filamentous fungus, preferably an *Aspergillus*, a *Penicillium*, a *Rasamsonia* or a *Mortierella* and wherein PAM is preferably a sequence selected from the group consisting of 5'-XGG-3', 5'-XGGXG-3', 5'-XX-AGAAW-3', 5'-XXXXGATT-3', 5'-XXAGAA-3', 5'-XAAAAC-3', wherein X can be any nucleotide or analog thereof, preferably X can be any nucleotide; and W is A or T.

Preferred genomes of *Aspergillus*, *Penicillium*, *Rasamsonia* and *Mortierella* are the genomes represented by SEQ ID NO's: 1-3 and 7, respectively. Unknown or ambiguous nucleotides in a genome (such as a nucleotide depicted with "n") are preferably excluded as polynucleotide sequence target.

The composition, source, CRISPR-Cas system, guide-polynucleotide, Cas protein, target-polynucleotide, host cell and CRISPR-Cas complex are herein referred to as a composition, source, CRISPR-Cas system, guide-polynucleotide, Cas protein, target-polynucleotide, host cell and CRISPR-Cas complex according to the present invention. For the sake of completeness, since "a" is defined elsewhere herein as "at least one", a composition according to the present invention comprises a source of at least one, i.e. one, two, three or more guide-polynucleotides and/or at least one, i.e. one, two, three or more Cas proteins. Accordingly, the present invention conveniently provides for a multiplex CRISPR-Cas system. Such multiplex CRISPR-Cas system can conveniently be used for introduction of a donor polynucleotide, deletion of a polynucleotide and polynucleotide library insertion into the genome of a host cell. Herein, a multiplex CRISPR-Cas system may refer to the use of one of more Cas proteins, one of more guide-polynucleotides and/or one or more donor polynucleotides. Herein, when a combination of a single guide-polynucleotide and multiple donor polynucleotides is used wherein the donor polynucleotides are configured such that they will be introduced into a single target locus, the term "singleplex" is used.

The terms "CRISPR system", "CRISPR-Cas system" and "CRISPR enzyme system" are used interchangeably herein and refer in the context of all embodiments of the present invention to a collection of elements required to form, together with a target-polynucleotide, a CRISPR-Cas complex; these elements comprise but are not limited to a Cas protein and a guide-polynucleotide.

The term "CRISPR-Cas complex" refers in the context of all embodiments of the present invention to a complex comprising a guide-polynucleotide hybridized to a target-polynucleotide and complexed with a Cas protein. In the most straightforward form, where a non-mutated Cas protein is used such as but not limited to the Cas9 protein of *Streptococcus pyogenes*, the formation of the CRISPR-Cas complex results in cleavage of one or both polynucleotide strands in or near (e.g. within 1, 2, 3, 4, 5, 6, 7, 8, 9, 10, 20, 50, or more base pairs from) the target-polynucleotide. Typically, a target-polynucleotide according to the present invention (defined below herein) is associated with a PAM sequence (defined below herein) and the PAM sequence is preferably immediately downstream (3') of the target-polynucleotide; the formation of the CRISPR-Cas complex typically results in cleavage of one or both polynucleotide strands 3 base pairs upstream (5') of the PAM sequence.

The term "non-naturally occurring composition" refers in the context of all embodiments of the present invention to a composition that in its form used in the present invention does not occur in nature. The individual elements may e.g. occur as such or in combinations with other elements in nature, but the non-naturally occurring composition comprises e.g. at least one element more or less than a naturally composition.

The term "engineered composition" refers in the context of all embodiments of the present invention to a composition wherein at least one of the elements has been engineered, i.e. modified by man, in such a way that resulting element does not occur in nature. It follows that by virtue of comprising at least one engineered element, an engineered composition does not occur in nature.

The terms "polynucleotide", "nucleotide sequence" and "nucleic acid" are used interchangeably herein and refer in the context of all embodiments of the present invention to a polymeric form of nucleotides of any length, either deoxyribonucleotides or ribonucleotides, or mixes or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, oligonucleotides and primers. A polynucleotide may comprise one or more modified nucleotides, such as a methylated nucleotide and a nucleotide analogue or nucleotide equivalent wherein a nucleotide analogue or equivalent is defined as a residue having a modified base, and/or a modified backbone, and/or a non-natural internucleoside linkage, or a combination of these modifications. Preferred nucleotide analogues and equivalents are described in the section "General definitions". As desired, modifications to the nucleotide structure may be introduced before or after assembly of the polynucleotide. A polynucleotide may be further modified after polymerization, such as by conjugation with a labeling compound.

A guide-polynucleotide according to the present invention comprises at least a guide-sequence that is able to hybridize with the target-polynucleotide and is able to direct sequence-specific binding of the CRISPR-Cas system to the target-polynucleotide to form a CRISPR-Cas complex. In order to enable formation of an active CRISPR-Cas complex, the guide-polynucleotide preferably also comprises a sequence that has a specific secondary structure and allows binding of the Cas protein to the guide-polynucleotide. Such sequence is known in the art as tracrRNA, tracr sequence, tracr scaffold or guide-polynucleotide structural component, these terms are used interchangeably herein; wherein the tracr is the abbreviation for transactivating CRISPR; tracrRNA thus means transactivating CRISPR RNA. The tracrRNA in the original CRISPR-Cas system is the endogenous bacterial RNA that links the crRNA (guide-sequence) to the Cas nuclease, being able to bind any crRNA. A guide-polynucleotide structural component may be comprised of a single polynucleotide molecule or may be comprised of two or more molecules hybridized to each other; such hybridizing components of a guide-polynucleotide structural component may be referred to as a tracr sequence and a tracr-mate sequence.

Accordingly, the guide-polynucleotide preferably also comprises a tracr sequence and/or a tracr-mate sequence. The guide-polynucleotide is a polynucleotide according to the general definition of a polynucleotide set out here above; a preferred guide-polynucleotide comprises ribonucleotides, a more preferred guide-polynucleotide is a RNA (guide-RNA). Two examples of typical guide-polynucleotide structures are depicted in Sander and Joung, 2014 and Mali et al., 2013.

In the context of the present invention, a guide-sequence is referred to as essentially the reverse complement of a target-sequence or of a target-polynucleotide if the subject sequence is able to hybridize with the target-sequence or target-polynucleotide, preferably under physiological conditions as in a host cell. The degree of complementarity between a guide-sequence and its corresponding target-sequence, when optimally aligned using a suitable alignment algorithm, is preferably higher than 50%, 60%, 75%, 80%, 85%, 90%, 95%, 97.5%, 99% sequence identity. Optimal alignment may be determined using any suitable algorithm for aligning sequences, preferably an algorithm as defined herein under "Sequence identity". When the target-polynucleotide is a double stranded polynucleotide, the subject sequence, such as a guide-sequence, may be able to hybridize with either strand of the target-polynucleotide e.g. a coding strand or a non-coding strand.

Preferably, a guide-sequence according to the present invention targets a target-sequence that is unique in the target. Preferably, a guide-sequence according to the present invention has 100% sequence identity with the 8, 9, 10, 11, 12, 13, 14, 15, 16, 17, 18, 19 or 20, more preferably 8, 9, 10, 11 or 12 nucleotides in the target-polynucleotide immediately adjacent to a PAM sequence.

A guide-sequence according to the present invention preferably is 8-30, more preferably 10-30, more preferably 15-30, more preferably 17-27, more preferably 17-20, more preferably 17, 18, 19, 20, 21, 22, 23, 24, 25, 26, or 27 nucleotides in length. The ability of a guide-sequence to direct sequence-specific binding of a CRISPR-Cas system to a target-sequence to form a CRISPR-Cas complex may be assessed by any suitable assay. For example, the components of a CRISPR system sufficient to form a CRISPR-Cas complex, including the guide-sequence to be tested, may be provided to a host cell having the corresponding target-sequence, such, as by transfection with vectors encoding the components of the CRISPR-Cas system, followed by an assessment of preferential cleavage within the target-sequence, such as by the Surveyor assay (Surveyor® Mutation Detection Kits distributed by Integrated DNA Technologies, Leuven, Belgium) or another sequence analysis assay such as sequencing. Cleavage of a target-polynucleotide may be evaluated in a test tube by providing the target-polynucleotide, components of a CRISPR-Cas system, including the guide-sequence to be tested and a control guide-sequence different from the test guide-sequence, and comparing binding or rate of cleavage at the target-sequence between the test and control guide-sequence reactions. Other assays are possible, and are known to a person skilled in the art.

A guide-polynucleotide structural component is believed to be necessary for formation of an active CRISPR-Cas complex. The guide-polynucleotide structural component is believed not necessarily to be operably linked to the guide-sequence; however, a guide-polynucleotide structural component may be operably linked to a guide-sequence within a guide-polynucleotide. A guide-polynucleotide structural component according to the present invention, which may comprise or consist of all or a portion of a wild-type guide-polynucleotide structural component (e.g. about or more than about 20, 26, 32, 45, 48, 54, 63, 67, 85, or more nucleotides of a wild-type tracr-sequence) forms part of a CRISPR-Cas complex; e.g. by hybridization of at least a portion of a tracr-sequence according to the present invention to all or a portion of a tracr-mate sequence according to the present invention and preferably operably linked to a guide-sequence according to the present invention. A tracr-sequence according to the present invention has sufficient complementarity to a tracr-mate sequence according to the present invention to hybridize, preferably under physiological condition as in a host cell, and facilitate formation of a CRISPR-Cas complex. As with the target-sequence according to the present invention, it is believed that complete complementarity is not needed, provided there is sufficient complementarity to be functional. Preferably, the tracr-sequence according to the present invention has at least 50%, 60%, 70%, 80%, 90%, 95% or 99% sequence identity along the length of the tracr-mate sequence according to the present invention when optimally aligned. Optimal alignment may be determined using any suitable algorithm for aligning sequences, preferably an algorithm as defined herein under "Sequence identity".

In general, a tracr mate sequence according to the present invention includes any sequence that has sufficient complementarity with a tracr sequence according to the present invention to promote formation of a CRISPR-Cas complex at a target-sequence, wherein the CRISPR-Cas complex comprises the tracr mate sequence according to the present invention hybridized to the tracr sequence according to the present invention. The degree of complementarity of the tracr sequence according to the present invention and the tracr mate sequence according to the present invention is preferably defined with respect to optimal alignment of the tracr mate sequence and tracr sequence along the length of the shorter of the two sequences. Optimal alignment may be determined using any suitable algorithm for aligning sequences, preferably an algorithm as defined herein under "Sequence identity".

Preferably, with respect to a tracr mate sequence according to the present invention and a tracr sequence according to the present invention, secondary structures are taken into account, such as self-complementarity within either the tracr sequence or tracr mate sequence. Preferably, the degree of complementarity between the tracr sequence according to the present invention and tracr mate sequence according to the present invention along the length of the shorter of the two sequences when optimally aligned is higher than 50%, 60%, 75%, 80%, 85%, 90%, 95%, 97.5%, 99% sequence identity. Preferably, the tracr mate sequence according to the present invention is 5, 6, 7, 8, 9, 10, 11, 12, 13, 14, 15, 16, 17, 18, 19, 20, 25, 30, 40, 50, or more nucleotides in length.

Preferably, the tracer sequence according to the present invention is 5, 6, 7, 8, 9, 10, 11, 12, 13, 14, 15, 16, 17, 18, 19, 20, 25, 30, 40, 50, or more nucleotides in length. Preferably, the tracr sequence according to the present invention and tracr mate sequence, i.e. the guide-polynucleotide structural component according to the present invention are comprised within a single transcript, such that hybridization between the two produces a hybridization complex comprising a secondary structure, such as a hairpin. Such hybridization complex may also be formed when the tracr sequence and the tracr mate sequence are not comprised in a single transcript. Preferred loop forming sequences in a tracr sequence according to the present invention and/or a tracr mate sequence according to the present invention and/or guide-polynucleotide structural component according to the present invention for formation of hairpin structures are four nucleotides in length, and most preferably have the sequence GAAA; longer or shorter loop sequences may be used, as may alternative sequences. The loop sequences preferably include a nucleotide triplet (for example, AAA), and an additional nucleotide (for example C or G). Examples of loop forming sequences include CAAA and AAAG. Preferably, a tracr sequence according to the present invention and/or tracr mate sequence according to the present invention or hybridization complex thereof and/or guide-polynucleotide structural component according to the present invention comprises or is able to form at least two or more hairpins. More preferably, a tracr sequence according to the present invention and/or tracr mate sequence according to the present invention or hybridization complex thereof and/or guide-polynucleotide structural component according to the present invention comprises or is able to form two, three, four or five hairpins. Preferably, a tracr sequence according to the present invention and/or tracr mate sequence according to the present invention or hybridization complex thereof and/or guide-polynucleotide structural component according to the present invention comprises or is able to form at most five hairpins. Preferably, the single transcript of a tracr sequence according to the present invention and a tracr-mate sequence according to the present invention or hybridization complex of a tracr sequence according to the present invention and a tracr mate sequence according to the present invention and/or guide-polynucleotide structural component according to the present invention further comprises a transcription termination sequence; preferably this is a polyT sequence, for example six T nucleotides. As said, guide-polynucleotide structural components are known to the person skilled in the art; background information can e.g. be found in Gaj et al, 2013.

In the context of all embodiments according to the present invention, the term "target-polynucleotide" refers to a target-sequence according to the present invention to which a guide-sequence according to the present invention is designed to have complementarity, where hybridization between a target-sequence according to the present invention and a guide-sequence according to the present invention promotes the formation of a CRISPR-Cas complex. Full complementarity is not necessarily required, provided there is sufficient complementarity to cause hybridization and promote formation of a CRISPR-Cas complex. Preferably, a guide-sequence according to the present invention targets a target-sequence that is unique in the target. Preferably, a guide-sequence according to the present invention has 100% sequence identity with the 8, 9, 10, 11, 12, 13, 14, 15, 16, 17, 18, 19 or 20, more preferably 8, 9, 10, 11 or 12 nucleotides in the target-polynucleotide immediately adjacent to a PAM sequence. A target-polynucleotide according to the present invention may comprise any polynucleotide, such as DNA or RNA polynucleotides and may be single or double stranded. When the target-polynucleotide is a double strand polynucleotide, a guide-sequence according to the present invention, may be able to hybridize with either strand of the target-polynucleotide e.g. a coding strand or a non-coding strand.

A target-polynucleotide according to the present invention may be located in the nucleus or cytoplasm of a cell. A target-polynucleotide according to the present invention may be located in an organelle of a host cell, for example in a mitochondrion or chloroplast. A target-polynucleotide according to the present invention may be comprised in a genome, may be comprised in a chromosome or may be extra-chromosomal, may be comprised in an artificial chromosome such a Yeast Artificial Chromosome (YAC), may be present in any chromosomal entity or extra-chromosomal entity such as an autosomal replicating entity such as an episomal plasmid or vector. A target-polynucleotide according to the present invention may be native or foreign to the host cell.

A target-polynucleotide according to the present invention is preferably associated with a protospacer adjacent motif (PAM), which is a short polynucleotide recognized by the CRISPR-Cas complex. Preferably, the target-polynucleotide and PAM are linked wherein the PAM is preferably immediately downstream (3') of the target-polynucleotide. The exact sequence and length of the PAM may vary, e.g. different Cas proteins may require different PAM's. A preferred PAM according to the present invention is a polynucleotide of 2 to 8 nucleotides in length. A preferred PAM is selected from the group consisting of 5'-XGG-3', 5'-XGGXG-3', 5'-XXAGAAW-3', 5'-XXXXGATT-3', 5'-XXAGAA-3', 5'-XAAAAC-3', wherein X can be any nucleotide or analog thereof, preferably any nucleotide; and W is A or T. A more preferred PAM is 5'-XGG-3'. The PAM is preferably matched with the Cas protein. The most widely used CAS/CRISPR system is derived from *S. pyogenes* and the matching PAM sequence 5'-XGG-3' is located immediately downstream (3') of the target-sequence. A preferred PAM for a *Neisseria meningitidis* Cas protein is 5'-XXXX-GATT-3'; a preferred PAM for a *Streptococcus thermophilus* Cas protein is 5'-XXAGAA-3'; a preferred PAM for a *Treponema denticola* is 5'-XAAAAC-3'. A preferred PAM matches the Cas protein used. A Cas protein according to the present invention may be engineered to match a different PAM than the native PAM matching the wild-type Cas protein. As such, the CRISPR-Cas system according to the present invention may be used for customized specific targeting.

The term "hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence-specific manner. The complex may comprise two strands forming a duplex structure, three or more strands forming a multi stranded complex, a single self-hybridizing strand, or any combination of these. A hybridization reaction may constitute a step in a more extensive process, such as the cleavage of a polynucleotide by an enzyme. Preferred hybridization conditions are physiological conditions as within a host cell according to the present invention.

The term "source" in the context of all embodiments of the present invention refers to any source of a CRISPR-Cas system comprising a guide-polynucleotide and a Cas protein. The guide-polynucleotide and Cas protein may be present in separate sources. In such case, the composition according to the present invention comprises a CRISPR-Cas system comprising a source of a guide-polynucleotide and a source of a Cas-protein. Any source means that the guide-polynucleotide and Cas protein may be present as such in a form that they can function within a CRISPR-Cas system. The guide-polynucleotide and/or the Cas-protein may be provided in its active forms and may e.g. be provided from an inactive form or from another entity. The guide-polynucleotide may e.g. be present on another polynucleotide or may be encoded by a polynucleotide that is transcribed to provide for the actual guide-polynucleotide. The Cas protein may be encoded by a polynucleotide (e.g. DNA or mRNA) that is transcribed and/or translated to provide the actual Cas protein. An encoding polynucleotide may be present in a nucleic acid construct as defined herein and/or in a vector as defined herein. Such nucleic acid construct and vector are herein referred to as a nucleic acid construct according to the present invention and a vector according to the present invention.

Preferably, in the composition according to the present invention, the Cas protein is encoded by a polynucleotide and/or the guide-polynucleotide is encoded by or present on a polynucleotide.

Preferably, in the composition according to the present invention, the Cas protein is encoded by a polynucleotide and/or the guide-polynucleotide is encoded by or present on another polynucleotide and the polynucleotide or polynucleotides are comprised in a vector.

Preferably, in a composition according to the invention, the guide-polynucleotide is encoded by a polynucleotide that is transcribed to provide for the actual guide-polynucleotide. Accordingly, in an embodiment, in the composition according to the invention, preferably, the guide polynucleotide is present in the form of a polynucleotide encoding for said guide-polynucleotide and the guide-polynucleotide is obtained upon transcription of said polynucleotide in the host cell.

Preferably, in a composition according to the invention, the polynucleotide encoding a guide-polynucleotide has sequence identity with a vector such that recombination of the polynucleotide encoding the guide-polynucleotide and said vector is facilitated, wherein the recombination preferably is in vivo recombination in the host cell and wherein the vector is preferably linear. Accordingly, in an embodiment, in the composition according to the invention, preferably, a polynucleotide encoding a guide-polynucleotide has one or more regions of sequence identity with a first vector to allow homologous recombination between the polynucleotide encoding the guide-polynucleotide and said first vector to yield a second vector comprising the polynucleotide encoding the guide polynucleotide, wherein the recombination preferably is in vivo recombination in the host cell and wherein the first vector is preferably a linear vector. The person skilled in the art knows how to provide a linear vector; it can e.g. be synthesized as such or can be provided by restriction enzyme digestion of a circular vector. It allows the design of several distinct polynucleotides encoding a guide-polynucleotide that have homology with the vector without having to clone each polynucleotide encoding a guide-polynucleotide into the vector.

Preferably, such composition according to the invention comprises at least two distinct polynucleotides each encoding a respective distinct guide-polynucleotide, wherein said at least two polynucleotides additionally comprise sequence identity with each other such that recombination of the polynucleotides encoding the distinct guide-polynucleotides and said vector is facilitated, wherein the recombination preferably is in vivo recombination in the host cell and wherein the vector is preferably a linear vector. Accordingly, in an embodiment, the composition according to the invention preferably comprises at least two distinct polynucleotides each encoding a respective distinct guide-polynucleotide, wherein said at least two polynucleotides additionally comprise sequence identity with each other to allow homologous recombination of the polynucleotides encoding the distinct guide-polynucleotides with each other and with said (first) vector to yield a second vector comprising said at least two polynucleotides encoding each a guide-polynucleotide, wherein the recombination preferably is in vivo recombination in the host cell and wherein the (first) vector is preferably a linear vector. In an embodiment, the guide-polynucleotides are preferably distinct in their sequence identity with the target-polynucleotide.

In a variant embodiment, the polynucleotide encoding a guide-polynucleotide does not have sequence identity with a vector or another polynucleotide encoding a guide-polynucleotide itself, but an additional polynucleotide is present in the composition according to the invention that facilitates assembly of the polynucleotide encoding a guide-polynucleotide into the vector and/or assembly of a complex of two distinct polynucleotides each encoding a respective distinct guide-polynucleotide.

Accordingly, there is provided a composition according to the invention, wherein an additional set of polynucleotides is present that has sequence identity with a polynucleotide encoding a guide-polynucleotide and with a vector such that recombination of the polynucleotide encoding the guide-polynucleotide and said vector is facilitated, wherein the recombination preferably is in vivo recombination in the host cell and wherein the vector is preferably linear. In addition, there is provided a composition according to the invention, wherein a further polynucleotide is present that has sequence identity with a polynucleotide encoding the guide-polynucleotide and with a further and distinct polynucleotide encoding a further and distinct guide-polynucleotide such that recombination of the polynucleotides encoding the guide-polynucleotides and said vector is facilitated, wherein the recombination preferably is in vivo recombination in the host cell and wherein the vector is preferably linear.

Preferably, in the composition according to the present invention, the Cas protein is encoded by a polynucleotide and the guide-polynucleotide is encoded by or present on another polynucleotide and the polynucleotides are comprised in one vector.

Preferably, in the composition according to the present invention, the Cas protein is encoded by a polynucleotide comprised in a vector and the guide-polynucleotide is encoded by or present on another polynucleotide comprised in another vector. Preferably, the vector encoding the Cas protein is a low copy vector and the vector encoding the guide-polynucleotide is a high copy vector. This allows differential expression of the Cas protein and the guide-polynucleotide; the Cas protein may e.g. be expressed in lower level than the guide-polynucleotide. Preferably herein, a low copy vector is a vector that is present in an amount of at most 10, 9, 8, 7, 6, 5, 4, 3, 2 or most preferably 1 copy per host cell. Preferably herein, a high copy vector is a vector that is present in an amount of at least 10, 15, 20, 25, 30, 35, 40, 45, 50, 55, 60, 70, 80, 90, or at least 100 copies per host cell.

The invention thus provides for the possibilities that the guide-polynucleotide and the Cas protein are provided as such, or that they are encoded on or present on a vector. In the latter case, the encoding polynucleotides may each be on a separate vector or may both be on a single vector. The present invention, as depicted elsewhere herein, also provides for an exogenous polynucleotide, also referred to as a donor polynucleotide, a donor DNA when the polynucleotide is a DNA, or repair template, that upon cleavage of the target-polynucleotide by the CRISPR-Cas complex recombines with the target-polynucleotide, resulting in a modified target-polynucleotide. Such exogenous polynucleotide is herein referred to as an exogenous polynucleotide according to the present invention and may be single-stranded or double-stranded. Accordingly, a composition according to the present invention may further comprise an exogenous polynucleotide according to the present invention; a composition according to the invention may comprise one or more distinct exogenous polynucleotides. Such one or more distinct exogenous polynucleotides may encode different expression products or may encode identical expression products while a part of the exogenous polynucleotide has sequence identity to a part of the target-polynucleotide. In an embodiment, the composition according to the invention comprises one or more distinct exogenous polynucleotides, said exogenous polynucleotide comprise one or more regions of sequence identity to the target polynucleotide to allow, upon cleavage of the target-polynucleotide by the CRISPR-Cas complex, homologous recombination with the cleaved target-polynucleotide, resulting in a modified target-polynucleotide. Such compositions according to the invention allow for a multiplex CRISPR-CAS system according to the invention as referred to elsewhere herein. In an embodiment, in a composition according to the invention where at least two distinct exogenous polynucleotides are present that upon cleavage of the target-polynucleotide by the CRISPR-Cas complex recombine with the target-polynucleotides, resulting in a modified target-polynucleotide, said at least two distinct exogenous polynucleotides may comprise sequence identity with each other such that recombination of said distinct exogenous polynucleotides is facilitated, wherein the recombination preferably is in vivo recombination in the host cell. In an embodiment, the composition according to the invention comprising at least two distinct exogenous polynucleotides, each of said at least two distinct exogenous polynucleotides comprise at least one region of sequence identity with another exogenous polynucleotide and optionally with the target polynucleotide, to allow upon cleavage of the target-polynucleotide by the CRISPR-Cas complex, homologous recombination of said at least two distinct exogenous polynucleotides with one another and with the cleaved target-polynucleotide, resulting in a modified target-polynucleotide, wherein the recombination preferably is in vivo recombination in the host cell. Such compositions according to the invention allow for a singleplex CRISPR-Cas system as described elsewhere herein. In a variant embodiment, an additional polynucleotide is present that has sequence identity with the exogenous and distinct polynucleotides such that recombination of the exogenous and distinct polynucleotides is facilitated, and wherein the recombination preferably is in vivo recombination in the host cell. In this variant embodiment, the additional polynucleotide or polynucleotides may have sequence identity with only the exogenous polynucleotides such that a complex of these can be formed. Alternatively, or in combination, an additional polynucleotide or polynucleotides may have sequence identity with an exogenous polynucleotide as well as sequence identity to a part of the target-polynucleotide such that the exogenous polynucleotide or complex of exogenous polynucleotides can be introduced into the target polynucleotide. The exogenous polynucleotide according to the present invention may be present on a vector or may be present as such, may be encoded by another polynucleotide or may be operably linked to the guide-polynucleotide and may have sequence identity to a part of the target-polynucleotide upstream of the PAM associated with the guide-sequence (i.e. on the 5' side of the PAM) or may have sequence identity to a part of the target-polynucleotide downstream of the PAM associated with the guide-sequence (i.e. on the 5' side of the PAM). The vector may be a separate vector for the exogenous polynucleotide. A vector carrying an exogenous polynucleotide may be any vector described herein below. The exogenous polynucleotide may be present on a vector that comprises a polynucleotide encoding a Cas protein according to the present invention and/or comprising a guide-polynucleotide or a polynucleotide encoding a guide-polynucleotide according to the present invention. Accordingly, in an embodiment, the present invention provides for a composition according to the present invention wherein a polynucleotide encoding a Cas protein according to the present invention, a guide-polynucleotide or a polynucleotide encoding a guide-polynucleotide according to the present invention are present on a single vector, which may further comprise any elements necessary for expressing the encoded products such as promoter and terminator elements. Such single (all-in-one) vector has the advantage that all components necessary for a CRISPR-Cas system are present together; in addition, a single transformation event, optionally in combination with a donor polynucleotide, suffices to introduce the components into a host cell. In an embodiment, there is provided a composition according to the present invention wherein a Cas protein according to the present invention is encoded by a polynucleotide which is present on a vector and a guide-polynucleotide according to the present invention is present as such (e.g. as a PCR fragment, a restriction fragment or a synthetic fragment), the guide-polynucleotide may be operably linked to an exogenous polynucleotide according to the present invention, wherein the guide-polynucleotide and/or the operably linked exogenous polynucleotide has sequence identity with the vector such that it allows in vivo recombination in the host cell of the guide-polynucleotide and/or the operably linked exogenous polynucleotide with the vector. Preferably, the in vivo recombination yields a second vector comprising the guide-polynucleotide and/or the operably linked exogenous polynucleotide. In case a guide-polynucleotide and an exogenous polynucleotide are operably linked and the guide-polynucleotide has sequence identity with the vector such as described here above, the exogenous polynucleotide is liberated when the guide-polynucleotide recombined with the vector. For the purposes described here above, the vector may be digested with a proper restriction enzyme (such as SapI) such that in vivo recombination is facilitated between the digested vector and the guide-polynucleotide and/or the operably linked exogenous polynucleotide. This embodiment enhances efficiency since it obviates the need for a vector-insert assembly step. This embodiment envisages that multiple distinct guide-polynucleotides can be used, or multiple distinct guide-polynucleotides operably linked to multiple distinct exogenous polynucleotides can be used, i.e. a library of guide-polynucleotides or guide-polynucleotides operably linked to multiple distinct exogenous polynucleotides. Such multiplex CRISPR-Cas system can conveniently be used for introduction of a donor polynucleotide sequence, deletion of a polynucleotide and polynucleotide library insertion into the genome of a host cell.

In the context of all embodiments of the present invention, a vector may be any vector (e.g., a plasmid or virus), which can conveniently be subjected to recombinant DNA procedures and can mediate expression of a polynucleotide according to the invention. The choice of the vector will typically depend on the compatibility of the vector with the host cell into which the vector is to be introduced. Preferred vectors are the vectors used in the examples herein. A vector may be a linear polynucleotide or a linear or closed circular plasmid. A vector may be an autonomously replicating vector, i.e., a vector, which exists as an extra-chromosomal entity, the replication of which is independent of chromosomal replication, e.g., a plasmid, an extra-chromosomal element, a mini-chromosome, or an artificial chromosome.

Preferably, in the composition according to the present invention, at least one vector is an autonomously replicating vector, preferably an AMA-vector. An autonomously maintained cloning vector and an AMA-vector preferably comprise the AMA1-sequence (see e.g. Aleksenko and Clutterbuck 1997) or a functional variant or equivalent thereof.

A vector may be one which, when introduced into the host cell, becomes integrated into the genome and replicated together with the chromosome(s) into which it has been integrated. An integrative vector may integrate at random or at a predetermined target locus in a chromosome of the host cell. A preferred integrative vector comprises a DNA fragment, which is homologous to a DNA sequence in a predetermined target locus in the genome of the host cell for targeting the integration of the vector to this predetermined locus. In order to promote targeted integration, a vector is preferably linearized prior to transformation of the cell. Linearization is preferably performed such that at least one but preferably either end of the vector is flanked by sequences homologous to the target locus. The length of the homologous sequences flanking the target locus is preferably at least 30 bp, preferably at least 50 bp, preferably at least 0.1 kb, even preferably at least 0.2 kb, more preferably at least 0.5 kb, even more preferably at least 1 kb, most preferably at least 2 kb. Preferably, the efficiency of targeted integration into the genome of the host cell, i.e. integration in a predetermined target locus, is increased by augmented homologous recombination abilities of the host cell.

The homologous flanking DNA sequences in the vector (which are homologous to the target locus) may be derived from a highly expressed locus, meaning that they are derived from a gene, which is capable of high expression level in the host cell. A gene capable of high expression level, i.e. a highly expressed gene, is herein defined as a gene whose mRNA can make up at least 0.5% (w/w) of the total cellular mRNA, e.g. under induced conditions, or alternatively, a gene whose gene product can make up at least 1% (w/w) of the total cellular protein, or, in case of a secreted gene product, can be secreted to a level of at least 0.1 g/l (e.g. as described in EP 357 127 B1).

A number of preferred highly expressed fungal genes are given by way of example: the amylase, glucoamylase, alcohol dehydrogenase, xylanase, glyceraldehyde-phosphate dehydrogenase or cellobiohydrolase (cbh) genes from Aspergilli, Chrysosporium or Trichoderma. Most preferred highly expressed genes for these purposes are a glucoamylase gene, preferably an *A. niger* glucoamylase gene, an *A. oryzae* TAKA-amylase gene, an *A. nidulans* gpdA gene, a *Trichoderma reesei* cbh gene, preferably cbh1, a *Chrysosporium lucknowense* cbh gene or a cbh gene from *P. chrysogenum*.

More than one copy of a polynucleotide according to the present invention may be inserted into the microbial host cell to mediate production of the product encoded by said polynucleotide. This can be done, preferably by integrating multiple copies of the polynucleotide into the genome of the host cell, more preferably by targeting the integration of the polynucleotide at one of the highly expressed loci defined in the former paragraph. Alternatively, integration of multiple copies can be achieved by including an amplifiable selectable marker gene with a polynucleotide according to the present invention, such that cells containing amplified copies of the selectable marker gene (and thereby additional copies of the nucleic acid sequence) can be selected for by cultivating the cells in the presence of the appropriate selectable agent. To increase the number of copies of a polynucleotide according the present invention even more, the technique of gene conversion as described in WO98/46772 may be used.

When a polynucleotide according to the present invention encoding a Cas protein according to the present invention and/or a guide-polynucleotide according to the present invention is integrated into the genome of the host cell, it may be desirable to excise the polynucleotide from the genome, e.g. when the desired genome editing has taken place. The excision of a polynucleotide can be performed by any means known to the person skilled in art; one preferred means is using Amds as a selection marker and counter-selecting with e.g. fluoroacetamide to excise the polynucleotide from the genome such as described in EP0635574. Another means for excision would be to use the well-known Cre/lox system; the polynucleotide sequence encoding the Cas-protein according to the present invention may e.g. be flanked by lox66/71 or loxP/loxP. A further means for excision would be to the use the CRISPR-Cas system according to the present invention.

A vector according to the present invention may be a single vector or plasmid or a vector system comprising two or more vectors or plasmids, which together contain the polynucleotides according to the present invention to be introduced into the host cell host cell.

A vector according to the present invention may contain one or more selectable markers, which permit easy selection of transformed cells. In an embodiment, in a composition according to the invention, one or more or all vectors comprise a selectable marker, preferably each vector comprising a distinct selectable marker. A selectable marker is a gene the product of which provides for biocide or viral resistance, resistance to heavy metals, prototrophy to auxotrophs, and the like. The selectable marker may be introduced into the cell on the vector as an expression cassette or may be introduced on a separate vector.

A selectable marker for use in a filamentous fungal cell may be selected from the group including, but not limited to, amdS (acetamidase), argB (ornithine carbamoyltransferase), bar (phosphinothricinacetyltransferase), bleA (phleomycin binding), hygB (hygromycinphosphotransferase), niaD (nitrate reductase), pyrG (orotidine-5'-phosphate decarboxylase), sC (sulfate adenyltransferase), NAT or NTC (Nourseothricin) and trpC (anthranilate synthase), KanMX (resistance to G418/geneticin; the selection marker kanMX is a hybrid gene consisting of a bacterial aminoglycoside phosphotransferase (kanr from transposon Tn903) under control of the strong TEF promoter from *Ashbya gossypii*; mammalian cells, yeast, and other eukaryotes acquire resistance to geneticin (=G418, an aminoglycoside antibiotic similar to kanamycin) when transformed with a kanMX marker; in yeast, the kanMX marker avoids the requirement of auxotrophic markers; in addition, the kanMX marker renders *E. coli* resistant to kanamycin.) as well as equivalents from other species. Preferred for use in an *Aspergillus* and *Penicillium* cell are the amdS (see for example EP 635574 Bi, EP0758020A2, EP1799821A2, WO 97/06261A2) and pyrG genes of *A. nidulans* or *A. oryzae* and the bar gene of *Streptomyces hygroscopicus*. More preferably an amdS gene is used, even more preferably an amdS gene from *A. nidulans* or *A. niger*. A most preferred selectable marker gene is the *A. nidulans* amdS coding sequence fused to the *A. nidulans* gpdA promoter (see EP 635574 B1). Other preferred AmdS markers are those described in WO2006/040358. AmdS genes from other filamentous fungi may also be used (WO 97/06261).

Markers which can be used in a prokaryotic host cell include ATP synthetase, subunit 9 (oliC), orotidine-5'-phosphatedecarboxylase (pvrA), the ampicillin resistance gene (*E. coli*), resistance genes for neomycin, kanamycin, tetracycline, spectinomycin, erythromycin, chloramphenicol, phleomycin (*Bacillus*) and the *E. coli* uidA gene, coding for β-glucuronidase (GUS). Vectors may be used in vitro, for example for the in vitro production of RNA in an in vitro transcription system or used to transfect or transform a host cell.

Versatile marker genes that can be used for transformation of most filamentous fungi and yeasts such as acetamidase genes or cDNAs (the amdS, niaD, facA genes or cDNAs from *A. nidulans, A. oryzae* or *A. niger*), or genes providing resistance to antibiotics like G418, hygromycin, bleomycin, kanamycin, methotrexate, phleomycin orbenomyl resistance (benA). Alternatively, specific selection markers can be used such as auxotrophic markers which require corresponding mutant host strains: e. g. D-alanine racemase (from *Bacillus*), URA3 (from *S. cerevisiae* or analogous genes from other yeasts), pyrG or pyrA (from *A. nidulans* or *A. niger*), argB (from *A. nidulans* or *A. niger*) or trpC. In a preferred embodiment the selection marker is deleted from the transformed host cell after introduction of the expression construct so as to obtain transformed host cells capable of producing the polypeptide which are free of selection marker genes.

The procedures used to ligate elements described above to construct a vector according to the present invention are well known to one skilled in the art (see, e.g. Sambrook & Russell, Molecular Cloning: A Laboratory Manual, 3rd Ed., CSHL Press, Cold Spring Harbor, N.Y., 2001; and Ausubel et al., Current Protocols in Molecular Biology, Wiley Inter-Science, NY, 1995).

A Cas protein in the context of all embodiments of the present invention refers to any Cas protein suitable for the purpose of the invention. A Cas protein may comprise enzymatic activity or may not comprise enzymatic activity. Non-limiting examples of Cas proteins include CasI, CasI B, Cas2, Cas3, Cas4, Cas5, Cas6, Cas7, Cas8, Cas9 (also known as CsnI and CsxI2), CasIO, Csy1, Csy2, Csy3, Cse1, Cse2, Csc1, Csc2, Csa5, Csn2, Csm2, Csm3, Csm4, Csm5, Csm6, Cmrl, Cmr3, Cmr4, Cmr5, Cmr6, Csb1, Csb2, Csb3, CsxI7, CsxI4, CsxIO, Csx16, CsaX, Csx3, CsxI, CsxIS, Csf1, Csf2, Csf3, Csf4, homologs thereof or modified versions thereof. These Cas proteins are known to the person skilled in the art; for example, the amino acid sequence of *S. pyogenes* Cas9 protein may be found in the SwissProt database under accession number Q99ZW2. Preferably, an unmodified Cas protein according to the present invention has DNA cleavage activity, such as e.g. Cas9. Preferably, a Cas protein according to the invention is Cas9, and may be Cas9 from *S. pyogenes* or *S. pneumoniae*. Preferably, a Cas protein according to the present invention directs cleavage of one or both polynucleotide strands at the location of the target-polynucleotide, such as within the target-polynucleotide and/or within the reverse complement of the target-polynucleotide. At the location of the target-polynucleotide is herein defined as within about 1, 2, 3, 4, 5, 6, 7, 8, 9, 10, 15, 20, 25, 50, 100, 200, 500, or more nucleotides from the first or last nucleotide of a target-polynucleotide; more preferably, within 1, 2, 3, 4, 5, 6, 7, 8, 9, 10, 15, 20, 25, 50, 100, 200, 500, or more nucleotides from the first or last nucleotide of a target-polynucleotide; even more preferably, within 1, 2, 3, 4, 5, 6, 7, 8, 9, 10, 15, 20, 25, 50 nucleotides from the first or last nucleotide of a target-polynucleotide. Accordingly, a Cas protein according to the present invention preferably directs cleavage of one or both polynucleotide strands within about 1, 2, 3, 4, 5, 6, 7, 8, 9, 10, 15, 20, 25, 50, 100, 200, 500, or more nucleotides from the first or last nucleotide of a target-polynucleotide; more preferably, within 1, 2, 3, 4, 5, 6, 7, 8, 9, 10, 15, 20, 25, 50, 100, 200, 500, or more nucleotides from the first or last nucleotide of a target-polynucleotide; even more preferably, within 1, 2, 3, 4, 5, 6, 7, 8, 9, 10, 15, 20, 25, 50 nucleotides from the first or last nucleotide of a target-polynucleotide. Typically, a target-polynucleotide according to the present invention is associated with a PAM sequence (defined elsewhere herein) and the PAM sequence is preferably immediately downstream (3') of the target-sequence; the formation of the CRISPR-Cas complex typically results in cleavage of one or both polynucleotide strands 3 base pairs upstream (5) of the PAM sequence.

Preferably, a Cas protein in a composition according to the present invention has activity for directing cleavage of both polynucleotide strands at the location of the target-polynucleotide. Cas nuclease activity is typically performed by two separate catalytic domains, namely RuvC and HNH. Each domain cuts one polynucleotide strand each domain can be inactivated by a single point mutation. A Cas protein according to the present invention may thus conveniently be mutated with respect to a corresponding wild-type Cas protein such that the mutated Cas protein has altered nuclease activity and lacks the ability to cleave one or both strands of a target-polynucleotide. In the embodiment of the invention, altered nuclease activity of a Cas protein according to the invention is preferably determined in view of the wild-type Cas protein and is preferably determined under identical or substantially identical conditions; the person skilled in the art knows how to determine nuclease activity of a Cas protein. For example, an aspartate-to-alanine substitution (D10A) in the RuvC I catalytic domain of Cas9 from S. pyogenes converts Cas9 from a nuclease that cleaves both strands to a nickase, which is herein defined as a Cas protein that cleaves a single strand of a target-polynucleotide. Other examples of mutations that render Cas9 into a nickase include, but are not limited to H840A, N854A, and N863A. In the context of the present invention, a Cas protein having nickase activity may be used for genome editing via homologous recombination, preferably the double nicking technique according to Ran et al., 2013. Accordingly, a preferred Cas protein according to the present invention comprises at least one mutation, such that the protein has altered nuclease activity compared to the corresponding wild-type Cas protein, preferably having activity to direct cleavage of a single polynucleotide strand at the location of the target-sequence. Such so-called nickase mutant can conveniently be used in duplex set-up, i.e. in a composition according to the present invention comprising a Cas protein nickase mutant with RuvC mutated and a Cas protein nickase mutant wherein NHN is mutated, such that the one Cas protein mutant nicks one strand of the polynucleotide target and the other Cas protein mutant nicks the other strand of the polynucleotide target. Depending on the two guide-polynucleotides used, the two different CRISPR-Cas complexes will effectively result in two single-strand nicks in the polynucleotide target; these nicks may be several nucleotides up to 5, 10, 20, 30 or more apart. Such double nicking method greatly enhances specificity of NEJH. Background information on double nicking can be found in e.g. Ran et al, 2013.

A Cas protein according to the present invention may comprise two or more mutated catalytic domains of Cas9, such as RuvC I, RuvC II and/or RuvC III to result in a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. Preferably, a Cas protein is considered to substantially lack all DNA cleavage activity when the DNA cleavage activity of the mutated enzyme is less than about 25%, 10%, 5%, 1%, 0.1%, 0.01%, or lower with respect to its non-mutated form. A Cas protein lacking substantially all enzyme activity can conveniently be used for gene silencing or down regulation of expression since the CRISPR-CAS complex will hamper transcription from the target-polynucleotide. Other mutations may be useful; where the Cas9 or other Cas protein is from a species other than S. pyogenes, mutations in corresponding amino acids may be made to achieve similar effects; the person skilled in the art knows how to identify these corresponding amino acids.

A Cas protein according to the present invention may be a fusion protein and comprise at least one heterologous functional domain, such domain preferably is a domain comprising Fokl activity such as described by Aggarwal et al (Aggarwal, A. K.; Wah, D. A.; Hirsch, J. A.; Dorner, L. F.; Schildkraut, I. (1997). "Structure of the multimodular endonuclease Fokl bound to DNA". Nature 388 (6637): 97-100). The enzyme Foki is naturally found in *Flavobacterium okeanokoites* and is a bacterial type IIS restriction endonuclease consisting of an N-terminal DNA-binding domain and a non-specific DNA cleavage domain at the C-terminal (Durai et al., 2005). When the Fold protein is bound to double stranded DNA via its DNA-binding domain at the 5'-GGATG-3':3'-CATCC-5' recognition site, the DNA cleavage domain is activated and cleaves, without further sequence specificity, the first strand 9 nucleotides downstream and the second strand 13 nucleotides upstream of the nearest nucleotide of the recognition site (Wah et al., 1998. Cas9-Fokl fusions have been described inter alia in Guilinger et al., 2014; and in Tsai et al., 2014.

A Cas fusion protein according to the present invention may comprise 1, 2, 3, 4, 5, 6, 7, 8, 9, 10, or more domains in addition to the Cas protein. Examples of protein domains that may be fused to a Cas protein include, but are not limited to, epitope tags, reporter gene sequences, and protein domains having one or more of the following activities: methylase activity, demethylase activity, transcription activation activity, transcription repression activity, transcription release factor activity, historic modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A Cas protein may be fused to a gene sequence encoding a protein or a fragment of a protein that bind DNA molecules or bind other cellular molecules, including but not limited to, maltose binding protein (MBP), S-tag, Lex A DNA binding domain (DBD) fusions, GAL4 DNA binding domain fusions, and herpes simplex virus (HSV) BP 16 protein fusions. Additional domains that may form part of a fusion protein comprising a CRISPR enzyme are described in US20110059502. A tagged Cas protein may be used to identify the location of a target-polynucleotide. A preferred Cas fusion protein according to the present invention comprises a FokI domain as defined here above.

A preferred Cas protein according to the present invention comprises a nuclear localization sequence, preferably a heterologous nuclear localization sequence. Such nuclear localization sequence is also referred as a nuclear localization signal. Preferably, such nuclear localization signal confers to the CRISPR-Cas complex sufficient strength to drive accumulation of said CRISPR-Cas complex in a detectable amount in the nucleus of a host cell. Without wishing to be bound by theory, it is believed that a nuclear localization sequence is not necessary for CRISPR-Cas activity in a host cell, but that including such sequences enhances activity of the system, especially as to targeting nucleic acid molecules into the nucleus. Such nuclear localization sequence is preferably present in the Cas protein, but may also be present anywhere else such that targeting of the CRISPR-Cas system to the nucleus is facilitated. A preferred nuclear localization sequence is the SV40 nuclear localization sequence.

In a composition and in any other embodiment according to the present invention a Cas protein encoding polynucleotide is preferably codon optimized for the host cell it is to be expressed in, more preferably the Cas protein encoding polynucleotide is codon pair optimized. In general, codon optimization refers to a process of modifying a nucleic acid sequence for enhanced expression in a host cell of interest by replacing at least one codon (e.g. more than 1, 2, 3, 4, 5, 10, 15, 20, 25, 50, or more codons) of a native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules.

The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database", and these tables can be adapted in a number of ways. See e.g. Nakamura, Y., et al., 2000. Computer algorithms for codon optimizing a particular sequence for expression in a particular host cell are also available, such as Gene Forge (Aptagen; Jacobus, Pa.), are also available. Preferably, one or more codons (e.g. 1, 2, 3, 4, 5, 10, 15, 20, 25, 50, or more, or all codons) in a sequence encoding a Cas protein correspond to the most frequently used codon for a particular amino acid. Preferred methods for codon optimization are described in WO2006/077258 and WO2008/000632). WO2008/000632 addresses codon-pair optimization. Codon-pair optimization is a method wherein the nucleotide sequences encoding a polypeptide have been modified with respect to their codon-usage, in particular the codon-pairs that are used, to obtain improved expression of the nucleotide sequence encoding the polypeptide and/or improved production of the encoded polypeptide. Codon pairs are defined as a set of two subsequent triplets (codons) in a coding sequence. The amount of Cas protein in a source in a composition according to the present invention may vary and may be optimized for optimal performance. It may be convenient to avoid too high levels of Cas protein in a host cell since high levels of Cas protein may be toxic to the host cell, even without a guide-polynucleotide present (see e.g. Ryan et al 2014 and Jacobs et al., 2014). A person skilled in the art knows how to regulate expression levels, such as by choosing a weaker promoter, repressible promoter or inducible promoter for expression of a Cas protein. Examples of promoters suitable for expression of a protein are depicted elsewhere herein.

In a composition according to the present invention wherein a guide-polynucleotide according to the present invention is encoded by a polynucleotide, expression of the guide-polynucleotide may be facilitated by a promoter operably linked to the encoding polynucleotide. Such promoter may be any suitable promoter known to the person skilled in the art. Several types of promoters can be used. It may be convenient to use an RNA polymerase III promoter or an RNA polymerase II promoter. Background information on RNA polymerase 11 and its promoters can be found e.g. in Marck et al., 2006. In some cases, such as in *S. cerevisiae*, *S. pombe*, RNA polymerase III promoters include promoter elements in the transcribed region. Accordingly, it may be convenient to use an RNA polymerase II promoter; these are known to the person skilled in the art and reviewed in e.g. Kornberg 1999. However, transcripts from an RNA II polymerase often have complex transcription terminators and transcripts are polyadenylated; this may hamper with the requirements of the guide-polynucleotide which because both its 5' and 3' ends need to be precisely defined in order to achieve the required secondary structure to produce a functional CRISPR-Cas system. These drawbacks can however be circumvented. In case an RNA polymerase II promoter is used, the polynucleotide encoding the guide-polynucleotide may also encode self-processing ribozymes and may be operably linked to an RNA polymerase II promoter; as such the polynucleotide encodes a pre-guide-polynucleotide comprising the guide-polynucleotide and self-processing ribozymes, wherein, when transcribed, the guide-polynucleotide is released by the self-processing ribozymes from the pre-guide-polynucleotide transcript. Preferred constructs comprising a polynucleotide encoding a pre-guide-polynucleotide according to the present invention operably linked to an RNA polymerase II promoter are those depicted in examples 1-41 herein. Background information on such constructs can be found in e.g. Gao et al, 2014 et al.

Preferably, in a composition according to the present invention wherein the guide-polynucleotide is encoded by a polynucleotide, said polynucleotide is operably linked to an H1 RNA polymerase III promoter, preferably a human H1 RNA polymerase III promoter.

Preferably, in a composition according to the present invention wherein the guide-polynucleotide is encoded by a polynucleotide, said polynucleotide is operably linked to a U6 RNA polymerase III promoter, preferably a human U6 RNA polymerase II promoter.

Preferably, in a composition according to the present invention wherein the guide-polynucleotide is encoded by a polynucleotide, said polynucleotide is operably linked to an SNR52p RNA polymerase III promoter, preferably a yeast SNR52p RNA polymerase Ill promoter. Such promoter is preferably used when the host is a yeast host cell, such as a *Saccharomyces* or a *Kluyveromyces*.

Preferably, in a composition according to the present invention wherein the guide-polynucleotide is encoded by a polynucleotide, said polynucleotide is operably linked to an RNA polymerase II promoter and encodes a pre-guide-polynucleotide comprising the guide-polynucleotide and self-processing ribozymes, wherein, when transcribed, the guide-polynucleotide is released by the self-processing ribozymes from the pre-guide-polynucleotide transcript. Preferred constructs comprising a polynucleotide encoding a pre-guide-polynucleotide according to the present invention operably linked to an RNA polymerase II promoter are those depicted in examples 1-41 herein. Conveniently, multiple pre-guide-polynucleotides and multiple self-processing ribozymes may be encoded by a single polynucleotide, operably linked to one or more RNA polymerase II promoters.

The composition according to the first aspect of the present invention can conveniently be used to modulate expression of a polynucleotide in a host cell. Accordingly, in a second aspect, the present invention provides a method of modulating expression of a polynucleotide in a host cell, comprising contacting a host cell with the composition according to the first aspect of the invention, wherein the guide-polynucleotide directs binding of the Cas protein at the target-polynucleotide in the host cell to form a CRISPR-Cas complex.

The term "expression" in the context of the present invention is herein defined as the process by which a polynucleotide is transcribed from a polynucleotide template (e.g. a DNA template polynucleotide is transcribed into an mRNA polynucleotide transcript or other RNA transcript) and/or the process by which an mRNA transcript is subsequently translated into peptides, polypeptides, or proteins. Transcripts and encoded polypeptides may be collectively referred to as "gene product". If the polynucleotide transcript is derived from a genomic template DNA, expression may include splicing of the mRNA transcript in a host cell. The term "modulating expression" refers herein to increased or reduced expression compared to a parent host cell wherein expressing is not modulated when assayed using the same conditions. Reduced expression may be a reduced amount of transcript such as mRNA and/or a reduced amount of translation product such as a polypeptide. It follows that increased expression may be an enhanced amount of transcript such as mRNA and/or an enhanced amount of translation product such as a polypeptide.

Preferably, the CRISPR-Cas complex cleaves one or both polynucleotide strands at the location of the target-polynucleotide, resulting in modulated expression of the gene product. The CRISPR-Cas complex may also have altered nuclease activity and substantially lack the ability to cleave one or both strands of a target-polynucleotide; in such case, expression is modulated by the binding of the complex to the target-polynucleotide. A Cas protein lacking substantially all enzyme activity can conveniently be used for gene silencing or down regulation of expression since the CRISPR-Cas complex will hamper transcription from the target-polynucleotide. Alternatively, a Cas protein can be modified into a transcription factor for programmable transcriptional activation or silencing of a gene of interest (Larson, et al., 2013).

A composition according to the first aspect of the present invention can conveniently be used for the deletion of polynucleotide. In an embodiment, when the composition according to the first aspect of the present invention comprises a source of at least one or two guide-polynucleotides and/or a source of at least at least one Cas protein, at least one CRISPR-Cas complex or two different CRISPR-Cas complexes are formed that cleave one or both polynucleotide strands at one location or at different locations of the target-polynucleotide, resulting in deletion of a polynucleotide fragment from the target-polynucleotide. Preferably, such composition according to the present invention comprising at least one or two guide-polynucleotides and/or a source of at least at least one Cas protein, additionally comprises an exogenous polynucleotide as defined herein below that is at least partly complementary to the at least one or two target-polynucleotides targeted by the guide-polynucleotide(s). Such polynucleotide fragment to be deleted or deleted fragment may be several nucleotides in length up to a few thousand nucleotides in length, an entire gene may be deleted or a cluster of genes may be deleted. Accordingly, the present invention provides for a method of modulating expression of a polynucleotide in a host cell, wherein a polynucleotide fragment is deleted from a target-polynucleotide.

In an embodiment, the method of modulating expression comprises cleavage of one or both polynucleotide strands at at least one location of the target-polynucleotide followed by modification of the target-polynucleotide by homologous recombination with an exogenous polynucleotide. In such case, the composition according to the first aspect of the present invention preferably further comprises such exogenous polynucleotide. Such modification may result in insertion, deletion or substitution of at least one nucleotide in the target-polynucleotide, wherein the insertion or substitution nucleotide may originate from the exogenous polynucleotide. A modification can also be made when the exogenous polynucleotide is a non-integrating entity such as described in Dong et al., and Beetham et al.; in this case the target-polynucleotide is modified but no nucleotide of the exogenous polynucleotide is introduced into the target-polynucleotide. Consequently, the resulting host is a non-recombinant host cell when the Cas-protein according to the invention is transformed as a protein. The exogenous polynucleotide may be any polynucleotide of interest such as a polynucleotide encoding a compound of interest as defined herein below, or a part of such polynucleotide or a variant thereof. Such exogenous polynucleotide is herein referred to as an exogenous polynucleotide according to the present invention and may single-stranded or double-stranded.

Various applications can be considered by the person skilled in the art for the compositions and methods according to the present invention. A polynucleotide (or gene) in a genome may be modified, edited or disrupted using compositions and methods according to the present invention. E.g. when a fully active Cas protein is used that cuts in both strands of the target-polynucleotide and when no exogenous polynucleotide is present as a suitable repair template, the double strand break is repaired by non-homologous end joining repair (NHEJ). During NHEJ insertions and/or deletions (which may be construed as substitution in some cases) of one or several nucleotides may occur, these are randomly inserted or deleted at the repair site; this is characteristic for NHEJ. Such insertions and/or deletions may impact the reading frame of the coding sequence, resulting amino acid changes in the gene product or even a truncated protein in case of genesis of a (premature) stop codon or alteration of a splice site.

A polynucleotide (or gene) in a genome may be modified, edited or disrupted using compositions and methods according to the present invention using homologous end joining repair (HEJ), also known as homology-directed repair (HDR), when an exogenous polynucleotide is present as repair template. E.g. when an exogenous polynucleotide having sequence identity to the target-polynucleotide (i.e. upstream (5') and downstream (3') of the double strand break) is present together with a CRISPR-Cas system according to the present invention, HDR will introduce (or actually reproduce) the corresponding nucleotides of the exogenous polynucleotide at the double strand break in the target-polynucleotide. Preferably, an exogenous polynucleotide according to the present invention does not contain the target sequence itself followed by a functional PAM sequence to avoid the risk of the exogenous polynucleotide itself or the modified target-polynucleotide being (re)cut by the CRISPR-CAS system.

In the embodiments of the present invention, when a CRISPR-Cas system according to the present invention comprises an exogenous polynucleotide (donor polynucleotide, donor DNA, repair template), the CRISPR-Cas system according to the present invention preferably comprises two or more guide-polynucleotides encoded by or present on one or more separate polynucleotides or vectors, and two or more exogenous polynucleotides are provided together with said CRISPR-Cas system enabling the formation of two or more CRISPR-CAS complexes. In a method according to the present invention, such CRISPR-Cas systems according to the present invention can conveniently be used to modulate expression at two or more target-polynucleotides, i.e. a method to target multiple target sites. Such CRISPR-Cas system according to the present invention will by chance form one, two or more CRISPR-CAS complexes at one or more target-polynucleotides. Such method can be used to generate one or more insertions, deletions, substitutions, optionally in combination with the one or more exogenous polynucleotides, in the genome of the host cell, or to modulate expression of genes via the formed CRISPR-CAS complexes.

In the embodiments of the present invention when a CRISPR-Cas system according to the present invention comprises an exogenous polynucleotide (donor polynucleotide, repair template), the exogenous polynucleotide and the guide-polynucleotide may be encoded by or present on a single polynucleotide. This enables synthesis of two or more of such combination polynucleotides and even library synthesis of such combination polynucleotides. Such library can be provided as a pool and be used to make a library of vectors and/or polynucleotides where the guide-polynucleotide and the exogenous polynucleotide are together encoded by or present on one polynucleotide. Such pool enables the use of a CRISPR-Cas system according to the present invention in a library-like multiplex system. In such CRISPR-Cas system according to the present invention, the exogenous polynucleotide and the guide-polynucleotide may be directly connected or may be separated by a linker polynucleotide.

In an embodiment, the guide-polynucleotide and the exogenous polynucleotide are connected by a linker polynucleotide that encodes for or represents the right flank of the guide-polynucleotide encoding or representing the gRNA 3' sequence and terminator, or a linker polynucleotide that encodes for or represents the left flank of the guide-polynucleotide encoding or representing the gRNA 5' sequence and promoter. This enables synthesis of two or more of such combination polynucleotides and even library synthesis of such combination polynucleotides. Such combination polynucleotides can be further processed to form a combination polynucleotide with one or more functional guide-polynucleotide(s) (containing a promoter and terminator).

In an embodiment, the guide-polynucleotide and the exogenous polynucleotide are connected by a linker polynucleotide that encodes for or represents the right flank of the guide-polynucleotide encoding or representing the gRNA 3' sequence and terminator and the polynucleotide target for said guide-polynucleotide, or a linker polynucleotide that encodes for or represents the polynucleotide target for said guide-polynucleotide and the left flank of the guide-polynucleotide encoding or representing the gRNA 5' sequence and promoter, where in vivo a CRISPR-Cas system can be formed at the combination polynucleotide to cleave the combination polynucleotide.

In an embodiment, one or more combination polynucleotides according to the present invention can be recombined (e.g. via direct cloning or in vivo recombination) with one or more vectors encoding Cas protein according to the present invention. One or more of such recombined vectors enable the formation of one or more CRISPR-CAS complexes.

The host cell according to this aspect of the present invention may be any host cell as defined herein. A preferred host cell is a modified host cell wherein expression of a component associated with non-homologous end joining (NHEJ) is altered compared to the corresponding wild-type host cell; preferably expression of the component associated with NHEJ is lowered. Preferred components associated with NHEJ are the yeast Ku70 and Ku80 and their respective orthologs in preferred non-mammalian host cells according to the present invention. Another preferred component associated with NHEJ is the yeast LIG4 and its respective orthologs in preferred non-mammalian host cells according to the present invention.

In a method according to this aspect of the present invention, a preferred host cell comprises a polynucleotide encoding a compound of interest as defined elsewhere herein. In a method according to this aspect of the present invention, the host cell may be a recombinant host cell or may be a non-recombinant host cell.

A method of modulating expression of a polynucleotide in a host cell according to this aspect of the present invention, results in a modified host cell that preferably comprises components of the composition according to the first aspect of the present invention. Accordingly, in a third aspect the present invention provides for a host cell comprising a composition according to the first aspect of the present invention. Such host cell may be any host cell as defined herein and may further comprise a polynucleotide encoding a compound of interest as defined elsewhere herein.

In a fourth aspect, the present invention provides a method of producing a host cell, comprising contacting a host cell with the composition according to the first aspect of the present invention, wherein the guide-polynucleotide directs binding of the Cas protein at the target-polynucleotide in the host cell to form a CRISPR-Cas complex. In an embodiment, the contacting with the composition according to the first aspect of the invention may be performed in two steps, wherein the host cell is first contacted with a source of a Cas protein according to the invention and subsequently the host cell is contacted with a source of a guide-polynucleotide according to the invention and optionally an exogenous polynucleotide according to the invention. A host cell in this embodiment of the present invention may be any type of host cell as defined herein and may comprise a polynucleotide encoding a compound of interest as defined elsewhere herein. A preferred method of producing a host cell according to the present invention comprises a step to produce an offspring host cell, wherein in said offspring host cell no components of a CRISPR-Cas system according to the present invention are present anymore. A further preferred host cell is a modified host cell wherein expression of a component associated with NHEJ as depicted above is altered compared to the corresponding wild-type host cell; preferably expression of the component associated with NHEJ is lowered.

The composition according to the first aspect of the present invention may be any such composition as defined herein. Contacting a host cell with a composition according to the present invention may be performed by any means known to the person skilled in the art. A host cell according to the present invention may simply be brought into a solution comprising a composition according to the present invention. Specific means of delivering a composition according to the present invention into a host cell may be used. The person skilled in the art is aware of such methods (see e.g. Sambrook & Russell; Ausubel, supra)., which include but are not limited to electroporation methods, particle bombardment or microprojectile bombardment, protoplast methods and *Agrobacterium* mediated transformation (AMT). Preferably the protoplast method is used for filamentous fungi. Procedures for transformation are inter alia described by J. R. S. Fincham, Transformation in fungi. 1989, Microbiological reviews. 53, 148-170. Transformation may involve a process consisting of protoplast formation, transformation of the protoplasts, and regeneration of the cell wall in a manner known per se. Suitable procedures for transformation of *Aspergillus* cells are described in EP 238 023 and Yelton et al., 1984, Proceedings of the National Academy of Sciences USA 81:1470-1474. Suitable procedures for transformation of *Aspergillus* and other filamentous fungal host cells using *Agrobacterium tumefaciens* are described in e.g. De Groot et al., *Agrobacterium tumefaciens*-mediated transformation of filamentous fungi. Nat Biotechnol. 1998, 16:839-842. Erratum in: Nat Biotechnol 1998 16:1074. A suitable method of transforming *Fusarium* species is described by Malardier et al., 1989, Gene 78:147156 or in WO 96/00787. Other methods can be applied such as a method using biolistic transformation as described in: Christiansen et al., *Biolistic transformation of the obligate plant pathogenic fungus, Erysiphe graminis* f. sp. *hordei*. 1995, Curr Genet. 29:100-102. Yeast may be transformed using any method known in the art such as the procedures described by Becker and Guarente, In Abelson, J. N. and Simon, 1983; Hinnen et al., 1978, and Gietz R D, Woods R A. 2002.

Preferably, the CRISPR-Cas complex cleaves one or both polynucleotide strands at the location of the target-polynucleotide, resulting in modulated expression of the gene product. The CRISPR-Cas complex may also have altered nuclease activity and lack the ability to cleave one or both strands of a target-polynucleotide; in such case, expression is modulated by the binding of the complex to the target-polynucleotide.

In an embodiment, when the composition according to the first aspect of the present invention comprises a source of at least one or two guide-polynucleotides and/or a source of at least one Cas protein, at least one CRISPR-Cas complex or two different CRISPR-CAS complexes are formed that cleave one or both polynucleotide strands at one location or at different locations of the target-polynucleotide, resulting in deletion of a polynucleotide fragment from the target-polynucleotide. Preferably, such composition according to the present invention comprising at least one or two guide-polynucleotides and/or a source of at least at least one Cas protein, additionally comprises an exogenous polynucleotide as defined herein below that is at least partly complementary to the at least one or two target-polynucleotides targeted by the guide-polynucleotide(s). Such polynucleotide fragment to be deleted or deleted fragment may be from several nucleotides in length up to a few thousand nucleotides in length, an entire gene may be deleted or a cluster of genes may be deleted. Accordingly, the present invention provides for a method of modulating expression of a polynucleotide in a host cell, wherein a polynucleotide fragment is deleted from a target-polynucleotide.

In one embodiment a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex. Preferably a method of modulating expression of a polynucleotide in a host cell, wherein a polynucleotide fragments is deleted from a target-polynucleotide, comprises contacting a host cell with a composition as described herein, wherein the guide-polynucleotide directs binding of the Cas protein at the target-polynucleotide in the host cell to form a CRISPR-Cas complex, wherein the host cell is a modified host cell deficient in a component associated with NHEJ. In another preferred embodiment a method of modulating expression of a polynucleotide in a host cell, wherein a polynucleotide fragments is deleted from a target-polynucleotide, comprises contacting a host cell with a composition as descried herein, wherein the guide-polynucleotide directs binding of the Cas protein at the target-polynucleotide in the host cell to form a CRISPR-Cas complex, wherein the host cell is a modified host cell deficient in a component associated with NHEJ, wherein the composition as described herein does not comprise an exogenous or donor polynucleotide. In one preferred embodiment the component associated with NHEJ is a yeast Ku70 or a yeast Ku80 or a yeast LIG4 or its respective ortholog in the host cells according to the present invention. In another embodiment of the method of modulating expression of a polynucleotide in a host cell the composition is comprised in an AMA vector.

Therefore the present invention relates in one embodiment to a method of modulating expression of a polynucleotide in a cell, wherein a polynucleotide fragment is deleted from a target-polynucleotide, comprising contacting a host cell with the composition as described herein but preferably not comprising a donor polynucleotide as defined herein, wherein the guide-polynucleotide directs binding of the Cas protein at the target-polynucleotide in the host cell to form a CRISPR-Cas complex, wherein the host cell is deficient in a component associated with NHEJ, preferably a yeast Ku70 or yeast Ku80 or a yeast LIG4 or its respective ortholog in the host cells.

Surprisingly it has been found that in a host cell deficient in a gene involved in NHEJ it is possible to obtain deletions in the host cell genome in a controlled way by using the CRISPR/CAS9 system when regions of homology are present at both sites of the intended cleavage site and wherein the composition as described herein does not comprise a donor DNA, in a method of modulating expression of a polynucleotide in a cell, wherein a polynucleotide fragment is deleted from a target-polynucleotide, as described herein.

Therefore in one embodiment the invention relates to a method of modulating expression of a polynucleotide in a cell, wherein a polynucleotide fragment is deleted from a target-polynucleotide, comprising contacting a host cell with a non-naturally occurring or engineered composition comprising a source of a CRISPR-Cas system comprising a guide-polynucleotide and a Cas protein, wherein the guide-polynucleotide comprises a guide-sequence that essentially is the reverse complement of a target-polynucleotide in a host cell and the guide-polynucleotide can direct binding of the Cas protein at the target-polynucleotide in the host cell to form a CRISPR-Cas complex, wherein the guide-sequence is essentially the reverse complement of the (N)y part of a 5'-(N)yPAM-3' polynucleotide sequence target in the genome of the host cell, wherein y is an integer of 8-30, wherein PAM is a protospacer adjacent motif, wherein the host cell is a eukaryote, which eukaryote is a filamentous fungus, preferably an *Aspergillus*, a *Penicillium*, a *Rasamsonia* or a *Mortierella* and wherein PAM is preferably a sequence selected from the group consisting of 5'-XGG-3', 5'-XGGXG-3', 5'-XXAGAAW-3', 5'-XXXXGATT-3', 5'-XXAGAA-3', 5'-XAAAAC-3', wherein X can be any nucleotide or analog thereof, preferably X can be any nucleotide; and W is A or T herein but preferably not comprising a donor polynucleotide as defined herein, wherein the guide-polynucleotide directs binding of the Cas protein at the target-polynucleotide in the host cell to form a CRISPR-Cas complex, wherein the host cell is deficient in a component associated with NHEJ, preferably a yeast Ku70 or yeast Ku80 or a yeast LIG4 or its respective ortholog in the host cells, wherein the Cas protein has activity for directing cleavage of both polynucleotide strands at the location of the target-sequence and wherein the cleavage occurs in a region of the genome comprised between two homologous regions which upon cleavage by the Cas protein recombine with each other resulting in the deletion of a polynucleotide comprised between said regions.

Preferably the degree of homology between the two homologous regions is such to allow homologous recombination. Preferably the two homologous regions have at least 60%, 70%, 80%, 90%, 99% or 100% sequence identity over the whole length of the homologous regions. It has been surprisingly found that the length of homologous region can be very short even in filamentous fungi, wherein usually a length of at least 1 or several kb is necessary to allow homologous recombination. Therefore in a preferred embodiment the length of the homologous regions is preferably at most 1 kb, at most 0.5 kb, at most 100 bp, at most 50 bp, at most 40 bp, at most 30 bp, at most 20 bp, at most 10 bp.

Preferably the distance between the two homologous regions is at most 10 kb, at most 9, at most 8 kb, at most 7 kb, at most 6 kb, at most 5 kb, at most 4 kb, at most 3 kb, at most 2 kb, at most 1 kb, at most 0.5 kb, at most 100 bp, at most 50 bp, at most 40 bp, at most 30, 20, 10 kb.

In one aspect, the invention relates to a software algorithms able to identify PAM sites in the genome comprised between homology regions of about 7-20 bp in a neighbourhood of the PAM site to design a method to target one or more PAM sites and create deletion of polynucleotides without use of a donor DNA.

The above method can be used for efficient removal of polynucleotide sequences in a designed way. For example upon introducing a Cas9 expression cassette at the genomic DNA and after several rounds of modifications mediated by the CRISPR/CAS9 system, one can remove the CAS9 from the genome by the introduction of a gRNA targeting a site in the Cas9 expression cassette and wherein the Cas9 expression cassette is comprised between two homologous regions as defined above, preferably 100-bp long, more preferably 20-bp, 15-bp long or shorter and cleave out the Cas9 open reading frame or a large part of the expression cassette.

The above method can also be used for transient inactivation of a gene. Eg. one could for example make a gene, e.g. a Ku70 polynucleotide non-functional by inserting a polynucleotide sequence in the ORF of the Ku70 gene, comprising two homologous regions at its 5'-end and 3'end respectively, wherein preferably the homologous regions are 100-bp, more preferably 20-bp, 15-bp long or shorter. The Ku70 gene can be made functional again using a CRISPR-Cas9 system without donor DNA as described above.

In an embodiment, the method of modulating expression comprises cleavage of one or both polynucleotide strands at at least one location of the target-polynucleotide followed by modification of the target-polynucleotide by homologous recombination with an exogenous polynucleotide. In such case, the composition according to the first aspect of the present invention preferably further comprises such exogenous polynucleotide. Such modification may result in insertion, deletion or substitution of at least one nucleotide in the target-polynucleotide, wherein the insertion or substitution nucleotide may or may not originate from the exogenous polynucleotide. In one embodiment the exogenous polynucleotide comprises regions of homology with the target-polynucleotide. Preferably the degree of homology between these homologous regions is such to allow homologous recombination. Preferably the homologous regions have at least 60%, 70%, 80%, 90%, 99% or 100% sequence identity over the whole length of the homologous regions. In one embodiment, wherein the host cell is deficient in a component involve in NHEJ as defined herewith, the homologous regions are preferably at most 1 kb, at most 0.5 kb, at most 100 bp, at most 50 bp, at most 40 bp, at most 30 bp, at most 20 bp, at most 10 bp.

A modification can also be made when the exogenous polynucleotide is a non-integrating entity; in this case the target-polynucleotide is modified but no nucleotide of the exogenous polynucleotide is introduced into the target-polynucleotide. Consequently, the resulting host is a non-recombinant host when the Cas-protein according to the present invention is transformed as a protein. In a method according to this aspect of the present invention, the host cell may thus be a recombinant host cell or may be a non-recombinant host cell. The exogenous polynucleotide may be any polynucleotide of interest such as a polynucleotide encoding a compound of interest as defined herein, or a part of such polynucleotide or a variant thereof.

In a fifth aspect, the present invention provides for a method for the production of a compound of interest, comprising culturing under conditions conducive to the compound of interest a host cell according to the third or fourth aspect of the present invention or a host cell obtained by a method according to the second aspect of the present invention, or a host cell obtainable by a method according to the fourth aspect of the present invention and optionally purifying or isolating the compound of interest.

A compound of interest in the context of all embodiments of the present invention may be any biological compound. The biological compound may be biomass or a biopolymer or a metabolite. The biological compound may be encoded by a single polynucleotide or a series of polynucleotides composing a biosynthetic or metabolic pathway or may be the direct result of the product of a single polynucleotide or products of a series of polynucleotides, the polynucleotide may be a gene, the series of polynucleotide may be a gene cluster. In all embodiments of the present invention, the single polynucleotide or series of polynucleotides encoding the biological compound of interest or the biosynthetic or metabolic pathway associated with the biological compound of interest, are preferred targets for the compositions and methods according to the present invention. The biological compound may be native to the host cell or heterologous to the host cell.

The term "heterologous biological compound" is defined herein as a biological compound which is not native to the cell; or a native biological compound in which structural modifications have been made to alter the native biological compound.

The term "biopolymer" is defined herein as a chain (or polymer) of identical, similar, or dissimilar subunits (monomers). The biopolymer may be any biopolymer. The biopolymer may for example be, but is not limited to, a nucleic acid, polyamine, polyol, polypeptide (or polyamide), or polysaccharide.

The biopolymer may be a polypeptide. The polypeptide may be any polypeptide having a biological activity of interest. The term "polypeptide" is not meant herein to refer to a specific length of the encoded product and, therefore, encompasses peptides, oligopeptides, and proteins. The term polypeptide refers to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. Polypeptides further include naturally occurring allelic and engineered variations of the above-mentioned polypeptides and hybrid polypeptides. The polypeptide may be native or may be heterologous to the host cell. The polypeptide may be a collagen or gelatine, or a variant or hybrid thereof. The polypeptide may be an antibody or parts thereof, an antigen, a clotting factor, an enzyme, a hormone or a hormone variant, a receptor or parts thereof, a regulatory protein, a structural protein, a reporter, or a transport protein, protein involved in secretion process, protein involved in folding process, chaperone, peptide amino acid transporter, glycosylation factor, transcription factor, synthetic peptide or oligopeptide, intracellular protein. The intracellular protein may be an enzyme such as, a protease, ceramidases, epoxide hydrolase, aminopeptidase, acylases, aldolase, hydroxylase, aminopeptidase, lipase. The polypeptide may also be an enzyme secreted extracellularly. Such enzymes may belong to the groups of oxidoreductase, transferase, hydrolase, lyase, isomerase, ligase, catalase, cellulase, chitinase, cutinase, deoxyribonuclease, dextranase, esterase. The enzyme may be a carbohydrase, e.g. cellulases such as endoglucanases, β-glucanases, cellobiohydrolases or β-glucosidases, hemicellulases or pectinolytic enzymes such as xylanases, xylosidases, mannanases, galactanases, galactosidases, pectin methyl esterases, pectin lyases, pectate lyases, endo polygalacturonases, exopolygalacturonases rhamnogalacturonases, arabanases, arabinofuranosidases, arabinoxylan hydrolases, galacturonases, lyases, or amylolytic enzymes; hydrolase, isomerase, or ligase, phosphatases such as phytases, esterases such as lipases, proteolytic enzymes, oxidoreductases such as oxidases, transferases, or isomerases. The enzyme may be a phytase. The enzyme may be an aminopeptidase, asparaginase, amylase, a maltogenic amylase, carbohydrase, carboxypeptidase, endo-protease, metallo-protease, serine-protease catalase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, protein deaminase, invertase, laccase, lipase, mannosidase, mutanase, oxidase, pectinolytic enzyme, peroxidase, phospholipase, galactolipase, chlorophyllase, polyphenoloxidase, ribonuclease, transglutaminase, or glucose oxidase, hexose oxidase, monooxygenase. In one embodiment the compound of interest may be an enzyme composition comprising at least two enzymatic activities, typicallyt more than two activities, for example, three, four, five, six, seven, eight, nine or more. The enzyme composition may comprises cellulolytic and/or hemicellulolytic enzyme activity and may have the ability to modify, for example degrade, a non-starch carbohydrate material, such as lignocellulose. An enzyme composition may comprise at least one cellulase and at least one hemicellulase. In addition, a enzyme composition may comprise auxiliary enzyme activity, i.e. additional activity which, either directly or indirectly leads to lignocellulose degradation. Thus, the enzyme composition may comprise endoglucanase activity and/or cellobiohydrolase activity and/or β-glucosidase activity. The enzyme composition may comprise more than one enzyme activity in one or more of those classes. Examples of enzyme compositions able to degrade non-starch carbohydrate material such as lignocelluloses and the production thereof are described in WO2011/000949.

According to the present invention, a compound of interest can be a polypeptide or enzyme with improved secretion features as described in WO2010/102982. According to the present invention, a compound of interest can be a fused or hybrid polypeptide to which another polypeptide is fused at the N-terminus or the C-terminus of the polypeptide or fragment thereof. A fused polypeptide is produced by fusing a nucleic acid sequence (or a portion thereof) encoding one polypeptide to a nucleic acid sequence (or a portion thereof) encoding another polypeptide.

Techniques for producing fusion polypeptides are known in the art, and include, ligating the coding sequences encoding the polypeptides so that they are in frame and expression of the fused polypeptide is under control of the same promoter(s) and terminator. The hybrid polypeptides may comprise a combination of partial or complete polypeptide sequences obtained from at least two different polypeptides wherein one or more may be heterologous to the host cell. Example of fusion polypeptides and signal sequence fusions are for example as described in WO2010/121933.

The biopolymer may be a polysaccharide. The polysaccharide may be any polysaccharide, including, but not limited to, a mucopolysaccharide (e.g., heparin and hyaluronic acid) and nitrogen-containing polysaccharide (e.g., chitin). In a preferred option, the polysaccharide is hyaluronic acid.

A polynucleotide coding for the compound of interest or coding for a compound involved in the production of the compound of interest according to the invention may encode an enzyme involved in the synthesis of a primary or secondary metabolite, such as organic acids, carotenoids, (beta-lactam) antibiotics, and vitamins. Such metabolite may be considered as a biological compound according to the present invention.

The term "metabolite" encompasses both primary and secondary metabolites; the metabolite may be any metabolite. Preferred metabolites are citric acid, gluconic acid, adipic acid, fumaric acid, itaconic acid and succinic acid.

A metabolite may be encoded by one or more genes, such as in a biosynthetic or metabolic pathway. Primary metabolites are products of primary or general metabolism of a cell, which are concerned with energy metabolism, growth, and structure. Secondary metabolites are products of secondary metabolism (see, for example, R. B. Herbert, The Biosynthesis of Secondary Metabolites, Chapman and Hall, New York, 1981).

A primary metabolite may be, but is not limited to, an amino acid, fatty acid, nucleoside, nucleotide, sugar, triglyceride, or vitamin.

A secondary metabolite may be, but is not limited to, an alkaloid, coumarin, flavonoid, polyketide, quinine, steroid, peptide, or terpene. The secondary metabolite may be an antibiotic, antifeedant, attractant, bacteriocide, fungicide, hormone, insecticide, or rodenticide. Preferred antibiotics are cephalosporins and beta-lactams. Other preferred metabolites are exo-metabolites. Examples of exo-metabolites are Aurasperone B, Funalenone, Kotanin, Nigragillin, Orlandin, Other naphtho-γ-pyrones, Pyranonigrin A, Tensidol B, Fumonisin B2 and Ochratoxin A.

The biological compound may also be the product of a selectable marker. A selectable marker is a product of a polynucleotide of interest which product provides for biocide or viral resistance, resistance to heavy metals, prototrophy to auxotrophs, and the like.

Selectable markers include, but are not limited to, amdS (acetamidase), argB (ornithinecarbamoyltransferase), bar (phosphinothricinacetyltransferase), hygB (hygromycin phosphotransferase), niaD (nitrate reductase), pyrG (orotidine-5'-phosphate decarboxylase), sC (sulfate adenyltransferase), trpC (anthranilate synthase), ble (phleomycin resistance protein), hyg (hygromycin), NAT or NTC (Nourseothricin) as well as equivalents thereof.

According to the invention, a compound of interest is preferably a polypeptide as described in the list of compounds of interest.

According to another embodiment of the invention, a compound of interest is preferably a metabolite.

The host cell according to the present invention may already be capable of producing the compound of interest. The mutant microbial host cell may also be provided with a homologous or heterologous nucleic acid construct that encodes a polypeptide wherein the polypeptide may be the compound of interest or a polypeptide involved in the production of the compound of interest. The person skilled in the art knows how to modify a microbial host cell such that it is capable of producing the compound of interest General Definitions Throughout the present specification and the accompanying claims, the words "comprise", "include" and "having" and variations such as "comprises", "comprising", "includes" and "including" are to be interpreted inclusively. That is, these words are intended to convey the possible inclusion of other elements or integers not specifically recited, where the context allows.

The terms "a" and "an" are used herein to refer to one or to more than one (i.e. to one or at least one) of the grammatical object of the article. By way of example, "an element" may mean one element or more than one element.

The word "about" or "approximately" when used in association with a numerical value (e.g. about 10) preferably means that the value may be the given value (of 10) more or less 1% of the value.

A preferred nucleotide analogue or equivalent comprises a modified backbone. Examples of such backbones are provided by morpholino backbones, carbamate backbones, siloxane backbones, sulfide, sulfoxide and sulfone backbones, formacetyl and thioformacetyl backbones, methyleneformacetyl backbones, riboacetyl backbones, alkene containing backbones, sulfamate, sulfonate and sulfonamide backbones, methyleneimino and methylenehydrazino backbones, and amide backbones. It is further preferred that the linkage between a residue in a backbone does not include a phosphorus atom, such as a linkage that is formed by short chain alkyl or cycloalkyl internucleoside linkages, mixed heteroatom and alkyl or cycloalkyl internucleoside linkages, or one or more short chain heteroatomic or heterocyclic internucleoside linkages.

A preferred nucleotide analogue or equivalent comprises a Peptide Nucleic Acid (PNA), having a modified polyamide backbone (Nielsen, et al. (1991) Science 254, 1497-1500). PNA-based molecules are true mimics of DNA molecules in terms of base-pair recognition. The backbone of the PNA is composed of N-(2-aminoethyl)-glycine units linked by peptide bonds, wherein the nucleobases are linked to the backbone by methylene carbonyl bonds. An alternative backbone comprises a one-carbon extended pyrrolidine PNA monomer (Govindaraju and Kumar (2005) Chem. Commun, 495-497). Since the backbone of a PNA molecule contains no charged phosphate groups, PNA-RNA hybrids are usually more stable than RNA-RNA or RNA-DNA hybrids, respectively (Egholm et al (1993) Nature 365, 566-568).

A further preferred backbone comprises a morpholino nucleotide analog or equivalent, in which the ribose or deoxyribose sugar is replaced by a 6-membered morpholino ring. A most preferred nucleotide analog or equivalent comprises a phosphorodiamidate morpholino oligomer (PMO), in which the ribose or deoxyribose sugar is replaced by a 6-membered morpholino ring, and the anionic phosphodiester linkage between adjacent morpholino rings is replaced by a non-ionic phosphorodiamidate linkage.

A further preferred nucleotide analogue or equivalent comprises a substitution of at least one of the non-bridging oxygens in the phosphodiester linkage. This modification slightly destabilizes base-pairing but adds significant resistance to nuclease degradation. A preferred nucleotide analogue or equivalent comprises phosphorothioate, chiral phosphorothioate, phosphorodithioate, phosphotriester, aminoalkylphosphotriester, H-phosphonate, methyl and other alkyl phosphonate including 3'-alkylene phosphonate, 5'-alkylene phosphonate and chiral phosphonate, phosphinate, phosphoramidate including 3'-amino phosphoramidate and aminoalkylphosphoramidate, thionophosphoramidate, thionoalkylphosphonate, thionoalkylphosphotriester, selenophosphate or boranophosphate.

A further preferred nucleotide analogue or equivalent comprises one or more sugar moieties that are mono- or disubstituted at the 2', 3' and/or 5' position such as a —OH; —F; substituted or unsubstituted, linear or branched lower (C1-C10) alkyl, alkenyl, alkynyl, alkaryl, allyl, aryl, or aralkyl, that may be interrupted by one or more heteroatoms; O-, S-, or N-alkyl; O-, S-, or N-alkenyl; O-, S- or N-alkynyl; O-, S-, or N-allyl; O-alkyl-O-alkyl, -methoxy, -aminopropoxy; aminoxy, methoxyethoxy; -dimethylaminooxyethoxy; and -dimethylaminoethoxyethoxy. The sugar moiety can be a pyranose or derivative thereof, or a deoxypyranose or derivative thereof, preferably a ribose or a derivative thereof, or deoxyribose or derivative thereof. Such preferred derivatized sugar moieties comprise Locked Nucleic Acid (LNA), in which the 2'-carbon atom is linked to the 3' or 4' carbon atom of the sugar ring thereby forming a bicyclic sugar moiety. A preferred LNA comprises 2'-0,4'-C-ethylene-bridged nucleic acid (Morita et al. 2001. Nucleic Acid Res Supplement No. 1: 241-242). These substitutions render the nucleotide analogue or equivalent RNase H and nuclease resistant and increase the affinity for the target.

"Sequence identity" or "identity" in the context of the present invention of an amino acid- or nucleic acid-sequence is herein defined as a relationship between two or more amino acid (peptide, polypeptide, or protein) sequences or two or more nucleic acid (nucleotide, oligonucleotide, polynucleotide) sequences, as determined by comparing the sequences. In the art, "identity" also means the degree of sequence relatedness between amino acid or nucleotide sequences, as the case may be, as determined by the match between strings of such sequences. Within the present invention, sequence identity with a particular sequence preferably means sequence identity over the entire length of said particular polypeptide or polynucleotide sequence.

"Similarity" between two amino acid sequences is determined by comparing the amino acid sequence and its conserved amino acid substitutes of one peptide or polypeptide to the sequence of a second peptide or polypeptide. In a preferred embodiment, identity or similarity is calculated over the whole sequence (SEQ ID NO:) as identified herein. "Identity" and "similarity" can be readily calculated by known methods, including but not limited to those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heine, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48:1073 (1988).

Preferred methods to determine identity are designed to give the largest match between the sequences tested. Methods to determine identity and similarity are codified in publicly available computer programs. Preferred computer program methods to determine identity and similarity between two sequences include e.g. the GCG program package (Devereux, J., et al., Nucleic Acids Research 12 (1): 387 (1984)), BestFit, BLASTP, BLASTN, and FASTA (Altschul, S. F. et al., J. Mol. Biol. 215:403-410 (1990). The BLAST X program is publicly available from NCBI and other sources (BLAST Manual, Altschul, S., et al., NCBI NLM NIH Bethesda, Md. 20894; Altschul, S., et al., J. Mol. Biol. 215:403-410 (1990). The well-known Smith Waterman algorithm may also be used to determine identity.

Preferred parameters for polypeptide sequence comparison include the following: Algorithm: Needleman and Wunsch, J. Mol. Biol. 48:443-453 (1970); Comparison matrix: BLOSSUM62 from Hentikoff and Hentikoff, Proc. Natl. Acad. Sci. USA. 89:10915-10919 (1992); Gap Penalty: 12; and Gap Length Penalty: 4. A program useful with these parameters is publicly available as the "Ogap" program from Genetics Computer Group, located in Madison, Wis. The aforementioned parameters are the default parameters for amino acid comparisons (along with no penalty for end gaps).

Preferred parameters for nucleic acid comparison include the following: Algorithm: Needleman and Wunsch, J. Mol. Biol. 48:443-453 (1970); Comparison matrix: matches=+10, mismatch=0; Gap Penalty: 50; Gap Length Penalty: 3. Available as the Gap program from Genetics Computer Group, located in Madison, Wis. Given above are the default parameters for nucleic acid comparisons.

Optionally, in determining the degree of amino acid similarity, the skilled person may also take into account so-called "conservative" amino acid substitutions, as will be clear to the skilled person. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulphur-containing side chains is cysteine and methionine. Preferred conservative amino acids substitution groups are: valine-leucine-isoleucine, phenylalanine-tyrosine, lysine-arginine, alanine-valine, and asparagine-glutamine. Substitutional variants of the amino acid sequence disclosed herein are those in which at least one residue in the disclosed sequences has been removed and a different residue inserted in its place. Preferably, the amino acid change is conservative. Preferred conservative substitutions for each of the naturally occurring amino acids are as follows: Ala to ser; Arg to lys; Asn to gin or his; Asp to glu; Cys to ser or ala; Gin to asn; Glu to asp; Gly to pro; His to asn or gin; lie to leu or val; Leu to ile or val; Lys to arg; gin or glu; Met to leu or ile; Phe to met, leu or tyr; Ser to thr; Thr to ser; Trp to tyr; Tyr to trp or phe; and, Val to ile or leu.

A polynucleotide according to the present invention is represented by a nucleotide sequence. A polypeptide according to the present invention is represented by an amino acid sequence. A nucleic acid construct according to the present invention is defined as a polynucleotide which is isolated from a naturally occurring gene or which has been modified to contain segments of polynucleotides which are combined or juxtaposed in a manner which would not otherwise exist in nature. Optionally, a polynucleotide present in a nucleic acid construct according to the present invention is operably linked to one or more control sequences, which direct the production or expression of the encoded product in a host cell or in a cell-free system.

The sequence information as provided herein should not be so narrowly construed as to require inclusion of erroneously identified bases. The skilled person is capable of identifying such erroneously identified bases and knows how to correct for such errors.

All embodiments of the present invention, i.e. a composition according to the present invention, a method of modulating expression, a host cell comprising a composition according to the present invention, a method of producing a host cell according to the present invention, a host cell according to the present invention and a method for the production of a compound of interest according to the present invention preferably refer to host cell, not to a cell-free in vitro system; in other words, the CRISPR-Cas systems according to the present invention are preferably host cell systems, not cell-free in vitro systems.

In all embodiments of the present invention, e.g. a composition according to the present invention, a method of modulating expression, a host cell comprising a composition according to the present invention, a method of producing a host cell according to the present invention, a host cell according to the present invention and a method for the production of a compound of interest according to the present invention, the host cell according to the present invention may be a haploid, diploid or polyploid host cell.

The host cell according to the present invention is a filamentous fungal host cell. Filamentous fungi as defined herein include all filamentous forms of the subdivision Eumycota and Oomycota (as defined by Hawksworth et al., In, Ainsworth and Bisby's Dictionary of The Fungi, 8th edition, 1995, CAB International, University Press, Cambridge, UK).

The filamentous fungal host cell may be a cell of any filamentous form of the taxon Trichocomaceae (as defined by Houbraken and Samson in Studies in Mycology 70:1-51. 2011). In another preferred embodiment, the filamentous fungal host cell may be a cell of any filamentous form of any of the three families Aspergillaceae, Thermoascaceae and Trichocomaceae, which are accommodated in the taxon Trichocomaceae.

The filamentous fungi are characterized by a mycelial wall composed of chitin, cellulose, glucan, chitosan, mannan, and other complex polysaccharides. Vegetative growth is by hyphal elongation and carbon catabolism is obligatory aerobic. Filamentous fungal strains include, but are not limited to, strains of *Acremonium, Agaricus, Aspergillus, Aureobasidium, Chrysosporium, Coprinus, Cryptococcus, Filibasidium, Fusarium, Humicola, Magnaporthe, Mortierella, Mucor, Myceliophthora, Neocallimastix, Neurospora, Paecilomyces, Penicillium, Piromyces, Panerochaete, Pleurotus, Schizophyllum, Talaromyces, Rasamsonia, Thermoascus, Thielavia, Tolypocladium*, and *Trichoderma*. A preferred filamentous fungal host cell according to the present invention is from a genus selected from the group consisting of *Acremonium, Aspergillus, Chrysosporium, Myceliophthora, Penicillium, Talaromyces, Rasamsonia, Thielavia, Fusarium* and *Trichoderma*; more preferably from a species selected from the group consisting of *Aspergillus niger, Acremonium alabamense, Aspergillus awamori, Aspergillus foetidus, Aspergillus sojae, Aspergillus fumigatus, Talaromyces emersonii, Rasamsonia emersonii, Rasamsonia emersonii* CBS127450, *Rasamsonia emersonii* CBS393.64, *Aspergillus oryzae, Chrysosporium lucknowense, Fusarium oxysporum, Mortierella alpina, Mortierella alpina* ATCC 32222, *Myceliophthora thermophila, Trichoderma reesei, Thielavia terrestris, Penicillium chrysogenum* and *P. chrysogenum* Wisconsin 54-1255 (ATCC28089); even more preferably the filamentous fungal host cell according to the present invention is an *Aspergillus niger*. When the host cell according to the present invention is an *Aspergillus niger* host cell, the host cell preferably is CBS 513.88, CBS124.903 or a derivative thereof. Several strains of filamentous fungi are readily accessible to the public in a number of culture collections, such as the American Type Culture Collection (ATCC), Deutsche Sammlung von Mikroorganismen und Zellkulturen GmbH (DSM), Centraalbureau Voor Schimmelcultures (CBS), Agricultural Research Service Patent Culture Collection, Northern Regional Research Center (NRRL), and All-Russian Collection of Microorganisms of Russian Academy of Sciences, (abbreviation in Russian—VKM, abbreviation in English—RCM), Moscow, Russia. Preferred strains as host cells according to the present invention are *Aspergillus niger* CBS 513.88, CBS124.903, *Aspergillus oryzae* ATCC 20423, IFO 4177, ATCC 1011, CBS205.89, ATCC 9576, ATCC14488-14491, ATCC 11601, ATCC12892, *P. chrysogenum* CBS 455.95, *P. chrysogenum* Wisconsin54-1255 (ATCC28089), *Penicillium citrinum* ATCC 38065, *Penicillium chrysogenum* P2, *Thielavia terrestris* NRRL8126, *Rasamsonia emersonii* CBS393.64, *Rasamsonia emersonii* CBS127450, *Talaromyces emersonii* CBS 124.902, *Acremonium chrysogenum* ATCC 36225 or ATCC 48272, *Trichoderma reesei* ATCC 26921 or ATCC 56765 or ATCC 26921, *Aspergillus sojae* ATCC 11906, *Myceliophthora thermophila* C1, Garg 27K, VKM-F 3500 D, *Chrysosporium lucknowense* C1, Garg 27K, VKM-F 3500 D, ATCC44006 and derivatives thereof.

Preferably, and more preferably when the microbial host cell according to the invention is a filamentous fungal host cell, a host cell according to the present invention further comprises one or more modifications in its genome such that the host cell is deficient in the production of at least one product selected from glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE if compared to a parent host cell and measured under the same conditions.

Oxalic acid hydrolase (oahA) is a component of the synthesis pathway of oxalic acid in many host cells. A host cell deficient in oahA will be deficient in oxalic acid. Oxalic acid is an unwanted by-product in many applications such as food applications. Furthermore, oxalic acid lowers the pH of the medium cultivations of host cell producing this component, resulting in lowered yields; i.e. yield is increased in oxalic acid deficient host cells. It is therefore advantageous if a host cell according to the present invention is deficient in oahA. OahA deficient host cells and preferred methods of producing said host cells are extensively described in WO 2000/50576 and WO2004/070022. A preferred method to produce an oahA deficient host cell is the recombinant method of disruption described in WO 2000/50576. Preferably, a host cell according to the present invention is deficient in oahA. Preferably, the oahA is a fungal oahA. More preferably, the oahA is the oahA from *Aspergillus*. Even more preferably the oahA is the oahA from *Aspergillus niger*. Even more preferably the oahA is the oahA from *Aspergillus niger* CBS 513.88. Most preferably, the oahA comprises the sequence of An10g00820.

prtT is a transcriptional activator of proteases in eukaryotic cells. Several fungal transcriptional activators of proteases have been recently described in WO 00/20596, WO 01/68864, WO 2006/040312 and WO 2007/062936. These transcriptional activators were isolated from *Aspergillus niger* (*A. niger*), *Aspergillus fumigatus* (*A. fumigatus*), *Penicillium chrysogenum* (*P. chrysogenum*) and *Aspergillus oryzae* (*A. oryzae*). These transcriptional activators of protease genes can be used to improve a method for producing a polypeptide in a host cell, wherein the polypeptide is sensitive for protease degradation. When a host cell according to the present invention is deficient in prtT, the host cell will produce less proteases that are under transcriptional control of prtT. It is therefore advantageous when a host cell according to the invention is deficient in prtT. prtT deficient hosts and preferred methods to produce these hosts are extensively described in WO 01/68864, WO 2006/040312. WO 01/68864 and WO 2006/040312 describe recombinant and classic methods to disrupt the prtT coding sequence. WO 2007/062936 describes disruption of the prtT binding site in a protease promoter. Disruption of the binding site impedes binding of prtT to the binding site. Consequently, the transcription of the protease is not activated by prtT and less protease is produced.

Preferably, a host cell according to the present invention comprises a polynucleotide encoding prtT, said polynucleotide comprising a modification such that the host cell is deficient in the production of prtT compared to a parent cell it originates from when cultivated under comparable conditions. Preferably, the prtT is a fungal prtT. More preferably, the prtT is the prtT from *Aspergillus*. Even more preferably the prtT is the prtT from *Aspergillus niger*. Even more preferably the prtT is the prtT from *Aspergillus niger* CBS 513.88. Most preferably, the prtT comprises the sequence of An04g06940.

The term "glucoamylase" (glaA) is identical to the term "amyloglucosidase" and is defined herein as an enzyme having dextrin 6-alpha-D-glucanohydrolase activity which catalyses the endo hydrolysis of 1, 6-alpha-D-glucoside linkages at points of branching in chains of 1, 4-linked alpha-D-glucose residues and terminal 1, 4-linked alpha-D-glucose residues. Glucoamylase activity can be measured as AGIU/ml by determining the liberation of paranitrofenol from the substrate p-nitrophenyl-a-D-glucopyranoside (Sigma). This results in a yellow colour, whose absorbance can be measured at 405 nm using a spectrophotometer. 1 AGIU is the quantity of enzyme, which produces 1 μmole of glucose per minute at pH 4.3 and 60° C. from a soluble starch substrate. In WO98/46772 additional details of the assay can be found.

Preferably, a host cell according to the present invention comprises a polynucleotide encoding glaA, said polynucleotide comprising a modification such that the host cell is deficient in the production of glaA compared to a parent cell it originates from when cultivated under comparable conditions. Preferably, the glaA is a fungal glaA. More preferably, the glaA is the glaA from *Aspergillus*. Even more preferably the glaA is the glaA from *Aspergillus niger*. Even more preferably the glaA is the glaA from *Aspergillus niger* CBS 513.88. Most preferably, the glaA comprises the sequence of An03g06550.

The term "alpha-amylase" is defined herein as 1, 4-alpha-D-glucan glucanohydrolase activity which catalyzes the endohydrolysis of polysaccharides with three or more alpha-1, 4-linked glucose units in the presence of water to malto-oligosaccharides. To determine the (neutral) alpha-amylase activity, the Megazyme cereal alpha-amylase kit is used (Megazyme, CERALPHA alpha amylase assay kit, catalogus. ref. K-CERA, year 2000-2001), according a protocol of the supplier. The measured activity is based on hydrolysis of non-reducing-endblocked ρ-nitrophenyl maltoheptaoside in the presence of excess glucoamylase and α-glucosidase at a pH of 7.0. The amount of formed p-nitrophenol is a measure for alpha-amylase activity present in a sample.

The term "acid stable alpha-amylase" (amyA) is defined herein as an enzyme having alpha-amylase activity with optimal activity in the acid pH range. To determine the acid stable alpha-amylase activity, also the Megazyme cereal alpha-amylase kit is used (Megazyme, CERALPHA alpha amylase assay kit, catalogus. ref. K-CERA, year 2000-2001), according a protocol of the supplier but at an acid pH. The measured activity is based on hydrolysis of non-reducing-endblocked p-nitrophenyl maltoheptaoside in the presence of excess glucoamylase and α-glucosidase at a pH of 4.5. The amount of formed p-nitrophenol is a measure for acid stable alpha-amylase activity present in a sample.

Preferably, a host cell according to the present invention comprises a polynucleotide encoding AmyA, said polynucleotide comprising a modification, wherein the host cell is deficient in amyA compared to the parent cell it originates from when cultivated under comparable conditions. Preferably, the amyA is a fungal amyA. More preferably, the amyA is the amyA from *Aspergillus*. Even more preferably the amyA is the amyA from *Aspergillus niger*. Even more preferably the amyA is the amyA from *Aspergillus niger* CBS 513.88. Most preferably, the amyA comprises the sequence of An11g03340.

The term "neutral alpha-amylase activity" (amy) is defined herein as an enzyme having alpha-amylase activity with optimal activity in the neutral pH range.

Preferably, a host cell according to the present invention comprises a polynucleotide encoding AmyB, said polynucleotide comprising a modification, wherein the host cell is deficient in amyBI and/or amyBII compared to the parent cell it originates from when cultivated under comparable conditions. More preferably, a host cell according to the present invention is deficient in amyBI and amy BII. Preferably, the amyB a is a fungal amyB. More preferably, the amyB is the amyB from *Aspergillus*. Even more preferably the amyB is the amyBI from *Aspergillus niger*. Even more preferably the amyB is the amyBI from *Aspergillus niger* CBS 513.88. Most preferably, the amyBI comprises the sequence of An12g06930. Even more preferably the amyB is the amyBII from *Aspergillus niger*. Even more preferably the amyB is the amyBII from *Aspergillus niger* CBS 513.88. Most preferably, the amyBII comprises the sequence of An05g02100.

The term toxin associated polynucleotide is defined herein as a gene cluster, a multitude of genes, a gene or part thereof encoding a compound, or biochemical pathway responsible for the biosynthesis or secretion of at least one toxin or toxin intermediate compound. Said compound may e.g. be a polypeptide, which may be an enzyme.

A number of host cells, especially filamentous fungal host cells, which are used as for the production of polypeptides of interest, comprise genes encoding enzymes involved in the biosynthesis of various toxins. For example, cyclopiazonic acid, kojic acid, 3-nitropropionic acid and aflatoxins are known toxins, which are formed in, e.g., *Aspergillus flavus*.

Similarly, trichothecenes are formed in a number of filamentous fungi, e.g., in *Fusarium* sp. such as *Fusarium venenatum* as well as in *Trichoderma*; ochratoxin may be produced by *Aspergillus*. Recently, sequencing of the genome of an industrial *Aspergillus niger* host strain revealed an inactive fumonisin gene cluster (Pel et al., "Genome sequencing and analysis of the versatile cell factory *Aspergillus niger* CBS 513.88". Nat Biotechnol. 2007 February; 25 (2):221-231). The formation of such toxins during the fermentation of compounds of interest is highly undesirable as these toxins may present a health hazard to operators, customers and the environment. Consequently, a toxin deficient host cell enables toxin-free production of a compound of interest. The toxin-free compound is easier to produce since no toxin has to be removed from the product. Furthermore, the regulatory approval procedure for the compound is easier.

Preferably, a host cell according to the present invention comprises a toxin associated polynucleotide encoding a compound (which may e.g. be a polypeptide which may be an enzyme) or biochemical pathway, said toxin associated polynucleotide comprising a modification, wherein the host cell is deficient in the production of said toxin or a toxin intermediate compound compared to the parent cell it originates from when cultivated under comparable conditions. Preferably, the toxin or toxin intermediate compound is a fungal toxin or toxin intermediate compound. More preferably, the toxin or toxin intermediate compound is a toxin or toxin intermediate compound from *Aspergillus*. Even more preferably the toxin or the toxin intermediate compound is a toxin or toxin intermediate compound from *Aspergillus niger*. Even more preferably the toxin or toxin intermediate compound is a toxin or toxin intermediate compound from *Aspergillus niger* CBS 513.88. Even more preferably, the toxin or the toxin intermediate compound is fumonisin or a fumonisin intermediate compound. Even more preferably, the toxin or the toxin intermediate compound is ochratoxin or an ochratoxin intermediate compound. Most preferably, the toxin or the toxin intermediate compound is ochratoxin or fumonisin or an ochratoxin or a fumonisin intermediate compound.

Preferably, the toxin associated polynucleotide encodes a compound (which may e.g. be a polypeptide which may be an enzyme) or a biochemical pathway which is involved in the production of a fungal toxin or toxin intermediate compound. More preferably, said toxin or toxin intermediate compound is from *Aspergillus*. Even more preferably, said toxin or toxin intermediate compound is from *Aspergillus niger*. Even more preferably, said toxin or toxin intermediate compound is from *Aspergillus niger* CBS 513.88. Even more preferably, said toxin or toxin intermediate compound is a fumonisin or a fumonisin intermediate compound; even more preferably, a fumonisin-B or a fumonisin-B intermediate compound; even more preferably, a fumonisin-B2 or a fumonisin-B2 intermediate compound. Preferably, the toxin associated polynucleotide comprises the sequence of the fumonisin cluster from An01g06820 until An01g06930; more preferably, the toxin associated polynucleotide comprises the sequence of An01g06930. Alternatively or in combination when the toxin or toxin intermediate compound is a fumonisin or a fumonisin intermediate compound, the toxin associated polynucleotide encodes a compound (which may e.g. be a polypeptide which may be an enzyme) or a biochemical pathway, which is involved in ochratoxin or an ochratoxin intermediate compound; preferably, an ochratoxin A or an ochratoxin A intermediate compound; more preferably, the toxin associated polynucleotide comprises the sequence of the cluster from An15g07880 until An15g07930; most preferably, the toxin associated polynucleotide comprises the sequence of An15g07910 and/or the sequence of An15g07920.

Preferably, a host cell according to the present invention comprises at least one toxin associated polynucleotide encoding a compound (which may e.g. be a polypeptide which may be an enzyme) or biochemical pathway, said toxin associated polynucleotide comprising at least one modification, wherein the host cell is deficient in the production of a toxin or, toxin intermediate compound compared to the parent cell it originates from when cultivated under comparable conditions. More preferably, a host cell according to the present invention comprises two toxin associated polynucleotides, said two toxin associated polynucleotides each comprising at least one modification, wherein the host cell is preferably deficient in the production of fumonisin and ochratoxin compared to the parent cell it originates from when cultivated under comparable conditions. Even more preferably, a mutant microbial host cell according to the invention comprises three or more toxin associated polynucleotides, said three or more toxin associated polynucleotides each comprising at least one modification, wherein the host cell is preferably deficient in the production of fumonisin, ochratoxin and at least one additional toxin or toxin intermediate compound compared to the parent cell it originates from when cultivated under comparable conditions.

Preferably, a host cell according to the present invention comprises one or more modifications in its genome to result in a deficiency in the production of the major extracellular aspartic protease PepA. Preferably, the host cell according to the present invention comprises a disruption of the pepA gene encoding the major extracellular aspartic protease PepA; more preferably, the pepA is the pepA from *Aspergillus*; even more preferably the pepA is the pepA from *Aspergillus niger*; even more preferably the pepA is the pepA from *Aspergillus niger* CBS 513.88; most preferably, the pepA comprises the sequence of An14g04710.

Preferably, the efficiency of targeted integration of a polynucleotide to a pre-determined site into the genome of a host cell according to the invention is increased by rendering the cell deficient in a component in NHEJ (non-homologous recombination). Preferably, a host cell according to the invention comprises a polynucleotide encoding an NHEJ component comprising a modification, wherein said host cell is deficient in the production of said NHEJ component compared to a parent cell it originates from when cultivated under the same conditions.

The NHEJ component to be modified can be any NHEJ component known to the person skilled in the art. Preferred NHEJ components to be modified are selected from the group of filamentous fungal homologues of yeast KU70, KU80, MRE11, RAD50, RAD51, RAD52, XRS2, SIR4, LIG4. More preferred NHEJ components to be modified are filamentous fungal homologues of yeast KU70 and KU80, preferably hdfA (homologue of yeast KU70) or homologues thereof and hdfB (homologue of yeast KU80) or homologues thereof. The most preferred NHEJ component to be modified is KU70 or hdfA, or a homologue thereof. Another preferred NHEJ component to be modified is KU80 or hdfB, or a homologue thereof. Yet another preferred NHEJ component to be modified is a filamentous fungal homologue of yeast LIG4, or a homologue thereof. Methods to obtain such host cell deficient in a component involved in NHEJ are known to the skilled person and are extensively described in WO2005/095624. Preferably, the hdfA gene is the hdfA gene from *A. niger*, more preferably the hdfA from *A. niger* according to SEQ ID NO: 1 of WO2005/095624. In another preferred embodiment the hdfB gene is the hdfB gene from *A. niger*, more preferably the hdfB from *A. niger* according to SEQ ID NO: 4 of WO2005/095624.

When a host cell according to the present invention is a filamentous fungal host cell, said host cell preferably additionally comprises one or more modifications in its genome to result in a deficiency in the production of the product encoded by the hdfA gene (as depicted in SEQ ID NO: 3 of WO 2005/095624) and/or hdfB gene (as depicted in SEQ ID NO: 6 of WO 2005/095624). A host cell according to the present invention preferably further comprises a disruption of the hdfA and/or hdfB gene. Filamentous fungal host cells which are deficient in a product encoded by the hdfA and/or hdfB gene have been described in WO 2005/095624. When a host cell according to the present invention is a filamentous fungal host cell, said host cell preferably further comprises a modification in its genome which results in the deficiency in the production of the non-ribosomal peptide synthase npsE, preferably the npsE depicted in SEQ ID NO: 38 of WO2012/001169. Such host cells deficient in the production of non-ribosomal peptide synthase npsE have been described in WO2012/001169 (npsE has a genomic sequence as depicted in SEQ ID NO: 35, a coding sequence as depicted in SEQ ID NO: 36, an mRNA as depicted in SEQ ID NO: 37 and the nrps protein as depicted in SEQ ID NO: 38 of WO2012/001169).

A host cell according to the present invention preferably further comprises a modification in its genome which results in the deficiency in the production of the α-amylase amyC, preferably the mature AmyC protein shown in SEQ ID NO: 4 and 8 of WO2014/013073. Such host cells deficient in the production of the α-amylase amyC have been described in WO2014/013073. amyC has a genomic sequence as depicted in SEQ ID NO: 1 or 5 and a coding sequence depicted in SEQ ID NO: 2 or 6 and the AmyC protein as depicted in SEQ ID NO: 3 or 7 with the mature AmyC protein shown in SEQ ID NO: 4 and 8 of WO2014/013073).

A host cell according to the present invention preferably further comprises a modification in its genome which results in the deficiency in the production of the AgsE protein, preferably the mature AgsE protein shown in SEQ ID NO: 3 or comprised in SEQ ID NO: 3 of WO2014/013074. Such host cells deficient in the production of the AgsE protein have been described in WO2014/013074. AgsE has a genomic sequence as depicted in SEQ ID NO: 1 and a coding sequence depicted in SEQ ID NO: 2 and the AgsE protein as depicted in SEQ ID NO: 3 with the mature AgsE protein comprised in SEQ ID NO: 3 of WO2014/013074). The deficiency in the production of at least one product selected from glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC if compared to a parent host cell and measured under the same conditions may already be present in a parent host cell from which a host cell according to the present invention that is deficient in a further product selected from the group consisting of glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC is derived.

The deficiency in the production of at least one product selected from glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC, protein AgsE if compared to a parent host cell and measured under the same conditions may already be present in a parent host cell from which a host cell according to the present invention that is deficient in a further product selected from the group consisting of glucoamylase (glaA), acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC, protein AgsE is derived.

A preferred host cell according to the present invention comprises a deficiency in the production of glaA and optionally at least another product selected from the group consisting of acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC if compared to a parent host cell and measured under the same conditions.

A further preferred host cell according to the present invention comprises a deficiency in the production of glaA, PepA and optionally at least another product selected from the group consisting of acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA) and optionally at least another product selected from the group consisting of neutral alpha-amylase (amyBI and amyBII), oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and optionally at least another product selected from the group consisting of neutral alpha-amylase amyBII, oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, and optionally at least another product selected from the group consisting of oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, a product encoded by the gene hdfA and optionally at least another product selected from the group consisting of oxalic acid hydrolase (oahA), a toxin, preferably ochratoxin and/or fumonisin, a protease transcriptional regulator prtT, a product encoded by the gene hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA) and optionally at least another product selected from the group consisting of, a toxin, preferably ochratoxin and/or fumonisin, a protease transcriptional regulator prtT, a product encoded by the gene hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), ochratoxin, fumonisin, and optionally at least another product selected from the group consisting of a protease transcriptional regulator prtT, a product encoded by the gene hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), ochratoxin, fumonisin, a protease transcriptional regulator prtT and optionally at least another product selected from the group consisting of a product encoded by the gene hdfB, a non-ribosomal peptide synthase npsE, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), ochratoxin, fumonisin, a protease transcriptional regulator prtT, a non-ribosomal peptide synthase npsE and optionally at least another product selected from the group consisting of a product encoded by the gene hdfB, amylase amyC if compared to a parent host cell and measured under the same conditions.

A further preferred host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), ochratoxin, fumonisin, a protease transcriptional regulator prtT, amylase amyC and optionally at least another product selected from the group consisting of a product encoded by the gene hdfB, a non-ribosomal peptide synthase npsE, if compared to a parent host cell and measured under the same conditions.

A further preferred host cell according to the present invention comprises a reduced amylase background and comprises a deficiency in the production of glaA, acid stable alpha-amylase (amyA), neutral alpha-amylase amyBI and amyBII, if compared to a parent host cell and measured under the same conditions. Such host cell preferably also comprises a deficiency in the production of a filamentous fungal homolog of KU70 or KU80. Such host cell preferably also comprises a deficiency in the production of a toxin. Such a host cell preferably also comprises a deficiency in the production of a filamentous fungal homolog of KU70 or KU80 and a deficiency in the production of a toxin.

A further preferred host cell according to the present invention comprises a reduced amylase background and further comprises a deficiency in the production of glaA, acid stable alpha-amylase (amyA), neutral alpha-amylase amyBI, amyBII and amyC if compared to a parent host cell and measured under the same conditions. Such a host cell may preferably also comprises a filamentous fungal homolog of KU70 or KU80. Such host cell preferably also comprises a deficiency in the production of a toxin. Such host cell preferably also comprises a deficiency in the production of a filamentous fungal homolog of KU70 or KU80 and a deficiency in the production of a toxin.

A preferred host cell according to the present invention is a filamentous fungal host cell which comprises a deficiency in the production of glaA and optionally at least another product selected from the group consisting of acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, PepA, a product encoded by the gene hdfA and/or hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, and optionally at least another product selected from the group consisting of acid stable alpha-amylase (amyA), neutral alpha-amylase (amyBI and amyBII), oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA) and optionally at least another product selected from the group consisting of neutral alpha-amylase (amyBI and amyBII), oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and optionally at least another product selected from the group consisting of neutral alpha-amylase amyBII, oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII and optionally at least another product selected from the group consisting of oxalic acid hydrolase (oahA), a toxin, preferably ochratoxin and/or fumonisin, a protease transcriptional regulator prtT, a product encoded by the gene hdfA and/or hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA and optionally at least another product selected from the group consisting of oxalic acid hydrolase (oahA), a toxin, preferably ochratoxin and/or fumonisin, a protease transcriptional regulator prtT, a product encoded by the gene hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), and optionally at least another product selected from the group consisting of a toxin, preferably ochratoxin and/or fumonisin, a protease transcriptional regulator prtT, a product encoded by the gene hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), a protein AgsE and optionally at least another product selected from the group consisting of a toxin, preferably ochratoxin and/or fumonisin, a protease transcriptional regulator prtT, a product encoded by the gene hdfB, a non-ribosomal peptide synthase npsE, amylase amyC, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), a protein AgsE, a toxin, preferably ochratoxin and/or fumonisin, and optionally at least another product selected from the group consisting of a protease transcriptional regulator prtT, a product encoded by the gene hdfB, a non-ribosomal peptide synthase npsE, amylase amyC, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, oxalic acid hydrolase (oahA), a protein AgsE, a toxin, preferably ochratoxin and/or fumonisin, amylase amyC, and optionally at least another product selected from the group consisting of a protease transcriptional regulator prtT, a product encoded by the gene hdfB, a non-ribosomal peptide synthase npsE, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBIII, a product encoded by the gene hdfA, a toxin, preferably ochratoxin and/or fumonisin, and optionally at least another product selected from the group consisting of oxalic acid hydrolase (oahA), a protease transcriptional regulator prtT, a product encoded by the gene hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, amylase amyC, and optionally at least another product selected from the group consisting of oxalic acid hydrolase (oahA), a protease transcriptional regulator prtT, a product encoded by the gene hdfB, a non-ribosomal peptide synthase npsE, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, a non-ribosomal peptide synthase npsE, and optionally at least another product selected from the group consisting of oxalic acid hydrolase (oahA), a protease transcriptional regulator prtT, a product encoded by the gene hdfB, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, a protein AgsE, and optionally at least another product selected from the group consisting of oxalic acid hydrolase (oahA), a protease transcriptional regulator prtT, a product encoded by the gene hdfB, a non-ribosomal peptide synthase npsE, amylase amyC, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, a protein AgsE, amylase amyC, and optionally at least another product selected from the group consisting of oxalic acid hydrolase (oahA), a protease transcriptional regulator prtT, a product encoded by the gene hdfB, a non-ribosomal peptide synthase npsE, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, a protein AgsE, a non-ribosomal peptide synthase npsE, and optionally at least another product selected from the group consisting of oxalic acid hydrolase (oahA), a protease transcriptional regulator prtT, a product encoded by the gene hdfB, amylase amyC, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, amylase amyC, a non-ribosomal peptide synthase npsE, and optionally at least another product selected from the group consisting of oxalic acid hydrolase (oahA), a protease transcriptional regulator prtT, a protein AgsE, a product encoded by the gene hdfB, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, a protein AgsE, amylase amyC, a non-ribosomal peptide synthase npsE, and optionally at least another product selected from the group consisting of oxalic acid hydrolase (oahA), a protease transcriptional regulator prtT, a product encoded by the gene hdfB, if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, oxalic acid hydrolase (oahA), and optionally at least another product selected from the group consisting of a protease transcriptional regulator prtT, a product encoded by the gene hdfB, a non-ribosomal peptide synthase npsE, amylase amyC, a protein AgsE if compared to a parent host cell and measured under the same conditions.

In one embodiment the host cell according to the present invention comprises a deficiency in the production of glaA, PepA, acid stable alpha-amylase (amyA), neutral alpha-amylase amyBI and amyBII, a product encoded by the gene hdfA, a toxin, preferably ochratoxin and/or fumonisin, oxalic acid hydrolase (oahA), a non-ribosomal peptide synthase npsE, and optionally at least another product selected from the group consisting of a protease transcriptional regulator prtT, a product encoded by the gene hdfB, amylase amyC, a protein AgsE if compared to a parent host cell and measured under the same conditions.

A further preferred host cell according to the present invention comprises a reduced alpha-amylase background and comprises a deficiency in the production of acid stable alpha-amylase (amyA), neutral alpha-amylase amyBI and amyBII and, optionally, amyC if compared to a parent host cell and measured under the same conditions. Such host cell preferably also comprises a filamentous fungal homolog of KU70 or KU80. Such host cell preferably also comprise a deficiency in the production of a toxin. Such host cell preferably also comprises a deficiency in the production of a filamentous fungal homolog of KU70 or KU80 and a deficiency in the production of a toxin.

When a host cell according to the present invention is a filamentous fungal host cell, the host cell preferably further comprises at least two substantially homologous DNA domains suitable for integration of one or more copies of a polynucleotide according to the present invention or of a polynucleotide encoding a compound of interest, wherein at least one of the at least two substantially homologous DNA domains is adapted to have enhanced integration preference for the polynucleotide encoding a compound of interest compared to the substantially homologous DNA domain it originates from, and wherein the substantially homologous DNA domain where the adapted substantially homologous DNA domain originates from has a gene conversion frequency that is at least 10% higher than one of the other of the at least two substantially homologous DNA domains. Such host cells have extensively been described in WO2011/009700. Strains containing two or more copies of these substantially homologous DNA domains are also referred herein as strain containing two or more amplicons. Examples of host cells comprising such amplicons are inter alia described in van Dijck et al, 2003, Regulatory Toxicology and Pharmacology 28; 27-35: On the safety of a new generation of DSM *Aspergillus niger* enzyme production strains. In van Dijck et al, an *Aspergillus niger* strain is described that comprises 7 amplified glucoamylase gene loci, i.e. 7 amplicons. Preferred host cells according to the present invention are filamentous fungus host cells, preferably *A. niger* host cells, comprising two or more amplicons, preferably two or more ΔglaA amplicons, more preferably comprising 2, 3, 4, 5, 6, 7 ΔglaA amplicons, wherein the amplicon which has the highest frequency of gene conversion has been adapted to have enhanced integration preference for the polynucleotide according to the present invention or the polynucleotide encoding a compound of interest, compared to the amplicon it originates from. Adaptation of the amplicon can be performed according to any one of the methods described in WO2011/009700 (which is here fully incorporated by reference). Host cells comprising two or more amplicons wherein one amplicon has been adapted to have enhanced integration preference for a polynucleotide encoding a compound of interest compared to the amplicon it originates from are herein referred as host cells comprising an adapted amplicon. Preferred host cells with adapted amplicons, described in WO2011/009700, are host cells comprising three ΔglaA amplicons being a BamHI truncated amplicon, a SalI truncated amplicon and a BglII truncated amplicon and wherein the BamHI amplicon has been adapted to have enhanced integration preference for a polynucleotide according to the present invention or polynucleotide encoding a compound of interest, compared to the BamHI amplicon it originates from.

When a host cell according to the present invention is a filamentous fungal host cell, the host cell according to the present invention preferably further comprises a modification of Sec61.

A preferred SEC61 modification is a modification which results in a one-way mutant of SEC61; i.e. a mutant wherein the de novo synthesized protein can enter the ER via SEC61, but the protein cannot leave the ER via SEC61. Such modifications are extensively described in WO2005/123763. In a preferred embodiment the mutant microbial host cell comprises a modification in a Sec61 as depicted in SEQ ID NO: 3 of WO2005/123763. Most preferably, the SEC 61 modification is the S376W mutation in which Serine 376 is replaced by Tryptophan in SEQ ID NO: 3 of WO2005/123763.

A modification, preferably in the genome, is construed herein as one or more modifications. A modification, preferably in the genome of a host cell according to the present invention, can either be effected by
  a) subjecting a parent host cell to recombinant genetic manipulation techniques; and/or
  b) subjecting a parent host cell to (classical) mutagenesis; and/or
  c) subjecting a parent host cell to an inhibiting compound or composition.

Modification of a genome of a host cell is herein defined as any event resulting in a change in a polynucleotide sequence in the genome of the host cell.

Preferably, a host cell according to the present invention has a modification, preferably in its genome which results in a reduced or no production of an undesired compound as defined herein if compared to the parent host cell that has not been modified, when analysed under the same conditions.

A modification can be introduced by any means known to the person skilled in the art, such as but not limited to classical strain improvement, random mutagenesis followed by selection. Modification can also be introduced by site-directed mutagenesis.

Modification may be accomplished by the introduction (insertion), substitution (replacement) or removal (deletion) of one or more nucleotides in a polynucleotide sequence. A full or partial deletion of a polynucleotide coding for an undesired compound such as a polypeptide may be achieved. An undesired compound may be any undesired compound listed elsewhere herein; it may also be a protein and/or enzyme in a biological pathway of the synthesis of an undesired compound such as a metabolite. Alternatively, a polynucleotide coding for said undesired compound may be partially or fully replaced with a polynucleotide sequence which does not code for said undesired compound or that codes for a partially or fully inactive form of said undesired compound. In another alternative, one or more nucleotides can be inserted into the polynucleotide encoding said undesired compound resulting in the disruption of said polynucleotide and consequent partial or full inactivation of said undesired compound encoded by the disrupted polynucleotide.

In one embodiment the mutant microbial host cell according to the invention comprises a modification in its genome selected from
  a) a full or partial deletion of a polynucleotide encoding an undesired compound,
  b) a full or partial replacement of a polynucleotide encoding an undesired compound with a polynucleotide sequence which does not code for said undesired compound or that codes for a partially or fully inactive form of said undesired compound.
  c) a disruption of a polynucleotide encoding an undesired compound by the insertion of one or more nucleotides in the polynucleotide sequence and consequent partial or full inactivation of said undesired compound by the disrupted polynucleotide.

This modification may for example be in a coding sequence or a regulatory element required for the transcription or translation of said undesired compound. For example, nucleotides may be inserted or removed so as to result in the introduction of a stop codon, the removal of a start codon or a change or a frame-shift of the open reading frame of a coding sequence. The modification of a coding sequence or a regulatory element thereof may be accomplished by site-directed or random mutagenesis, DNA shuffling methods, DNA reassembly methods, gene synthesis (see for example Young and Dong, (2004), *Nucleic Acids Research* 32, (7) or Gupta et al. (1968), *Proc. Nati. Acad. Sci USA*, 60: 1338-1344; Scarpulla et al. (1982), *Anal. Biochem.* 121: 356-365; Stemmer et al. (1995), Gene 164: 49-53), or PCR generated mutagenesis in accordance with methods known in the art. Examples of random mutagenesis procedures are well known in the art, such as for example chemical (NTG for example) mutagenesis or physical (UV for example) mutagenesis. Examples of site-directed mutagenesis procedures are the QuickChange™ site-directed mutagenesis kit (Stratagene Cloning Systems, La Jolla, Calif.), the The Altered Sites® II in vitro Mutagenesis Systems' (Promega Corporation) or by overlap extension using PCR as described in Gene. 1989 Apr. 15; 77(1):51-9. (Ho S N, Hunt H D, Horton R M, Pullen J K, Pease L R "Site-directed mutagenesis by overlap extension using the polymerase chain reaction") or using PCR as described in Molecular Biology: Current Innovations and Future Trends. (Eds. A. M. Griffin and H. G. Griffin. ISBN 1-898486-01-8; 1995 Horizon Scientific Press, PO Box 1, Wymondham, Norfolk, U.K.).

Preferred methods of modification are based on recombinant genetic manipulation techniques such as partial or complete gene replacement or partial or complete gene deletion.

For example, in case of replacement of a polynucleotide, nucleic acid construct or expression cassette, an appropriate DNA sequence may be introduced at the target locus to be replaced. The appropriate DNA sequence is preferably present on a cloning vector.

Preferred integrative cloning vectors comprise a DNA fragment, which is homologous to the polynucleotide and/or has homology to the polynucleotides flanking the locus to be replaced for targeting the integration of the cloning vector to this pre-determined locus. In order to promote targeted integration, the cloning vector is preferably linearized prior to transformation of the cell. Preferably, linearization is performed such that at least one but preferably either end of the cloning vector is flanked by sequences homologous to the DNA sequence (or flanking sequences) to be replaced. This process is called homologous recombination and this technique may also be used in order to achieve (partial) gene deletion.

For example a polynucleotide corresponding to the endogenous polynucleotide may be replaced by a defective polynucleotide, that is a polynucleotide that fails to produce a (fully functional) polypeptide. By homologous recombination, the defective polynucleotide replaces the endogenous polynucleotide. It may be desirable that the defective polynucleotide also encodes a marker, which may be used for selection of transformants in which the nucleic acid sequence has been modified.

Alternatively or in combination with other mentioned techniques, a technique based on in vivo recombination of cosmids in *E. coli* can be used, as described in: A rapid method for efficient gene replacement in the filamentous fungus *Aspergillus nidulans* (2000) Chaveroche, M-K., Ghico, J-M. and d'Enfert C; Nucleic acids Research, vol 28, no 22.

Alternatively, modification, wherein said host cell produces less of or no protein such as the polypeptide having amylase activity, preferably α-amylase activity as described herein and encoded by a polynucleotide as described herein, may be performed by established anti-sense techniques using a nucleotide sequence complementary to the nucleic acid sequence of the polynucleotide. More specifically, expression of the polynucleotide by a host cell may be reduced or eliminated by introducing a nucleotide sequence complementary to the nucleic acid sequence of the polynucleotide, which may be transcribed in the cell and is capable of hybridizing to the mRNA produced in the cell. Under conditions allowing the complementary anti-sense nucleotide sequence to hybridize to the mRNA, the amount of protein translated is thus reduced or eliminated. An example of expressing an antisense-RNA is shown in Appl. Environ. Microbiol. 2000 February; 66(2):775-82. (Characterization of a foldase, protein disulfide isomerase A, in the protein secretory pathway of *Aspergillus niger*. Ngiam C, Jeenes D J, Punt P J, Van Den Hondel C A, Archer D B) or (Zrenner R, Willmitzer L, Sonnewald U. Analysis of the expression of potato uridinediphosphate-glucose pyrophosphorylase and its inhibition by antisense RNA. Planta. (1993); 190(2):247-52).

A modification resulting in reduced or no production of undesired compound is preferably due to a reduced production of the mRNA encoding said undesired compound if compared with a parent microbial host cell which has not been modified and when measured under the same conditions.

A modification which results in a reduced amount of the mRNA transcribed from the polynucleotide encoding the undesired compound may be obtained via the RNA interference (RNAi) technique (Mouyna et al., 2004). In this method identical sense and antisense parts of the nucleotide sequence, which expression is to be affected, are cloned behind each other with a nucleotide spacer in between, and inserted into an expression vector. After such a molecule is transcribed, formation of small nucleotide fragments will lead to a targeted degradation of the mRNA, which is to be affected. The elimination of the specific mRNA can be to various extents. The RNA interference techniques described in WO2008/053019, WO2005/05672A1, WO2005/026356A1, Oliveira et al.; Crook et al., 2014; and/or Barnes et al., may be used at this purpose.

A modification which results in decreased or no production of an undesired compound can be obtained by different methods, for example by an antibody directed against such undesired compound or a chemical inhibitor or a protein inhibitor or a physical inhibitor (Tour 0. et al, (2003) Nat. Biotech: Genetically targeted chromophore-assisted light inactivation. Vol. 21. no. 12:1505-1508) or peptide inhibitor or an anti-sense molecule or RNAi molecule (R. S. Kamath et al, (2003) Nature: Systematic functional analysis of the *Caenorhabditis elegans* genome using RNAi. vol. 421, 231-237).

In addition of the above-mentioned techniques or as an alternative, it is also possible to inhibiting the activity of an undesired compound, or to re-localize the undesired compound such as a protein by means of alternative signal sequences (Ramon de Lucas, J., Martinez O, Perez P., Isabel Lopez, M., Valenciano, S. and Laborda, F. The *Aspergillus nidulans* carnitine carrier encoded by the acuH gene is exclusively located in the mitochondria. FEMS Microbiol Lett. 2001 Jul. 24; 201(2):193-8) or retention signals (Derkx, P. M. and Madrid, S. M. The foldase CYPB is a component of the secretory pathway of *Aspergillus niger* and contains the endoplasmic reticulum retention signal HEEL. Mol. Genet. Genomics. 2001 December; 266(4): 537-545), or by targeting an undesired compound such as a polypeptide to a peroxisome which is capable of fusing with a membrane-structure of the cell involved in the secretory pathway of the cell, leading to secretion outside the cell of the polypeptide (e.g. as described in WO2006/040340).

Alternatively or in combination with above-mentioned techniques, decreased or no production of an undesired compound can also be obtained, e.g. by UV or chemical mutagenesis (Mattern, I. E., van Noort J. M., van den Berg, P., Archer, D. B., Roberts, I. N. and van den Hondel, C. A., Isolation and characterization of mutants of *Aspergillus niger* deficient in extracellular proteases. Mol Gen Genet. 1992 August; 234(2):332-6) or by the use of inhibitors inhibiting enzymatic activity of an undesired polypeptide as described herein (e.g. nojirimycin, which function as inhibitor for β-glucosidases (Carrel F. L. Y. and Canevascini G. Canadian Journal of Microbiology (1991) 37(6): 459-464; Reese E. T., Parrish F. W. and Ettlinger M. Carbohydrate Research (1971) 381-388)).

In an embodiment of the present invention, the modification in the genome of the host cell according to the invention is a modification in at least one position of a polynucleotide encoding an undesired compound.

A deficiency of a cell in the production of a compound, for example of an undesired compound such as an undesired polypeptide and/or enzyme is herein defined as a mutant microbial host cell which has been modified, preferably in its genome, to result in a phenotypic feature wherein the cell: a) produces less of the undesired compound or produces substantially none of the undesired compound and/or b) produces the undesired compound having a decreased activity or decreased specific activity or the undesired compound having no activity or no specific activity and combinations of one or more of these possibilities as compared to the parent host cell that has not been modified, when analysed under the same conditions.

Preferably, a modified host cell according to the present invention produces 1% less of the un-desired compound if compared with the parent host cell which has not been modified and measured under the same conditions, at least 5% less of the un-desired compound, at least 10% less of the un-desired compound, at least 20% less of the un-desired compound, at least 30% less of the un-desired compound, at least 40% less of the un-desired compound, at least 50% less of the un-desired compound, at least 60% less of the un-desired compound, at least 70% less of the un-desired compound, at least 80% less of the un-desired compound, at least 90% less of the un-desired compound, at least 91% less of the un-desired compound, at least 92% less of the un-desired compound, at least 93% less of the un-desired compound, at least 94% less of the un-desired compound, at least 95% less of the un-desired compound, at least 96% less of the un-desired compound, at least 97% less of the un-desired compound, at least 98% less of the un-desired compound, at least 99% less of the un-desired compound, at least 99.9% less of the un-desired compound, or most preferably 100% less of the un-desired compound.

A reference herein to a patent document or other matter which is given as prior art is not to be taken as an admission that that document or matter was known or that the information it contains was part of the common general knowledge as at the priority date of any of the claims.

The sequence information as provided herein should not be so narrowly construed as to require inclusion of erroneously identified bases. The skilled person is capable of identifying such erroneously identified bases and knows how to correct for such errors.

The disclosure of each reference set forth herein is incorporated herein by reference in its entirety.

The present invention is further illustrated by the following examples:

EXAMPLES

A Functional and Efficient CRISPR/CAS9 System in Filamentous Fungi

General Principle of the CRISPR/CAS9 System in Filamentous Fungi

Since the first publications and patents on CRISPR/CAS9 (Mali et al., 2013) appeared the wide spread use of this breakthrough technique has grown exponentially (Hsu et al., 2014). The use of CRISPR/CAS9 to create genomic modifications in human cell lines dominates the publications which can be easily explained by the possible medical applications of the technique. Use of CRISPR/CAS9 methods in other organisms are less abundant and for filamentous fungi not shown. This patent application describes amongst others the set up and use of an efficient functioning CRISPR/CAS9 system for filamentous fungi which uses for example guide-RNA flanked by self-processing ribozymes, one step Golden Gate cloning techniques and a specifically adapted AMA vector that makes it suitable for low and high throughput genome modifications in a broad range of filamentous fungi. The structure and function of the guide-RNA self-processing ribozymes abbreviated as gRSR in the examples is depicted in Gao and Zhao, 2014 in formation of the functional in vivo guide-RNA.

The examples describe the experiments demonstrating the functionality of CRISPR/CAS9 in *A. niger* using CAS9 in combination with a gRSR fragment that targets fwnA6. A donor DNA fragment is used to introduce a frame shift mutation into the fwnA6 gene which is involved in spore color formation. Strains with the mutation in the spores will have a color change in the spores from black to fawn (Jorgensen et al., 2011).

Strains

In the examples described, *Aspergillus niger* strains GBA 301 (ΔglaA, ΔpepA) and *Aspergillus niger* GBA 302 (ΔglaA, ΔpepA, ΔhdfA) are used. The construction of GBA 301 and GBA 302 is described in patent application WO2011/009700 which is herein incorporated by reference.

Example 1: Construction of pEBA520 from the pDSM-JAK-109 Vector

Vector pDSM-JAK-109 (construction described in WO2012123429, which is herein incorparated by reference) was used as parental plasmid in which the Phleomycin resistance marker was replaced by a cre-recombinase expression cassette using KpnI and HindIII restriction sites. Subsequently, the Ds-RED-SKL coding region was replaced by the Hygromycin resistance marker coding region using BamHI and SmaI sites. Fragments were synthesized and cloned by DNA2.0 (Menlo Park, Calif., USA). These two steps yielded the starting vector pEBA513, which construction and use is also described in WO2013/135729, used for the following cloning step. pEBA513 was used as parental plasmid in which the Hygromycin resistance marker was replaced by the ble coding region (using BamHI and SmaI restriction sites). The ble coding sequence was synthesized by DNA2.0 (Menlo Park, Calif., USA). The resulting plasmid was named pEBA520 (SEQ ID NO: 95) and used in the following examples. A plasmid map of pEBA520 can be found in FIG. 1.

Example 2: Construction of the BG-AMA1 Vector

Plasmid pEBA520, contains the dominant selectable ble marker cassette which confers resistance to Phleomycin in filamentous fungi, the Cam gene offering resistance to chloramphenicol antibiotic in *E. coli*, the AMA part for autonomous replication in filamentous fungi and the Cre gene controlled by PglaA (gluco-amylase) promoter. The Cre gene is replaced by using restriction enzymes KpnI and HindIII cutting the fragment from the vector followed by a Gibson cloning reaction adding two new fragments to the vector. Fragment one contains a dsRED expression cassette which will give strains containing the AMA vector with dsRED a clear detectable fluorescent signal. Fragment two contains the ccdB counter selection gene flanked by BsaI sites. The BsaI sites can be used in a Golden Gate assembly described as step 1 in patent application WO2013/144257, which is herein incorporated by reference, the ccdB counter selections aids in the cloning efficiency increasing the percentage correct clones after Golden Gate cloning.

Figure 2:
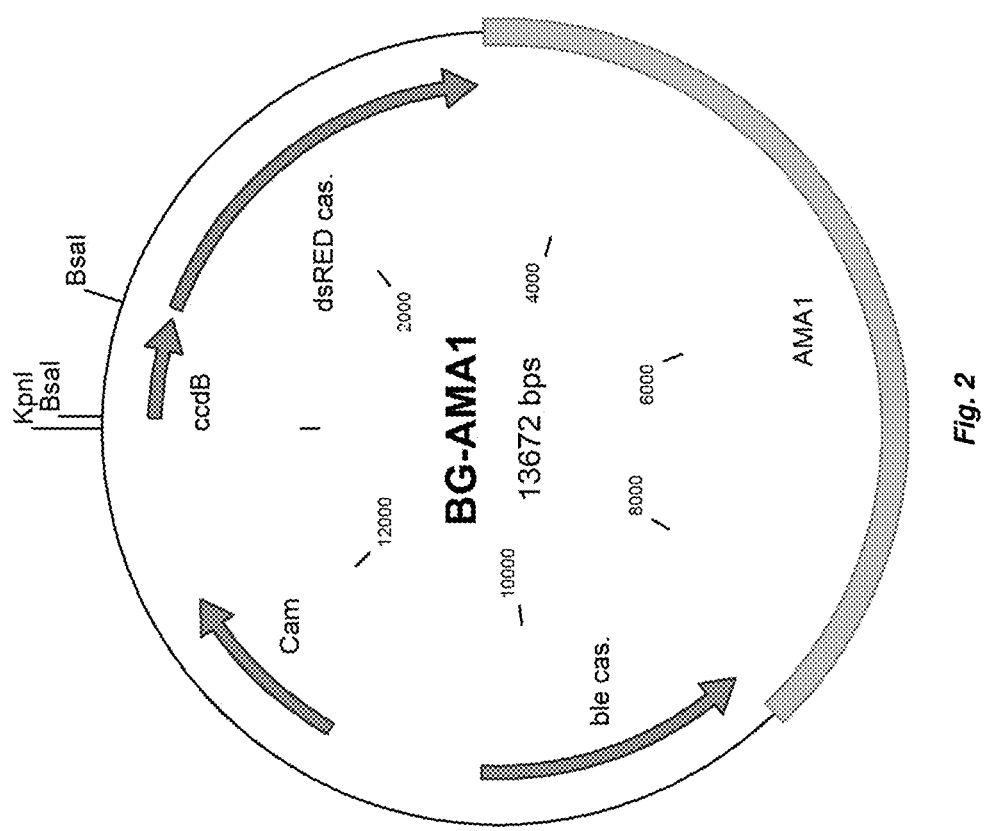
FIG. 2 depicts a plasmid map of vector BG-AMA-1.

The forward primer 5797 (SEQ ID NO: 96) and reverse primer 10681 (SEQ ID NO: 97) are used to PCR amplify the dsRED expression cassette. Template used in the PCR is plasmid pRPBdsRED7354 (SEQ ID NO: 98) containing the dsRED expression cassette. The forward primer 10680 (SEQ ID NO: 99) and reverse primer 5796 (SEQ ID NO: 100) are used to PCR amplify the ccdB fragment from plasmid 66218 (SEQ ID NO: 101) containing this fragment. PCRs to create fragments with homology were done using Phusion polymerase (New England Biolabs) according to standard PCR protocols. All PCR fragments were purified with the PCR purification kit from Macherey Nagel used according to the manual. DNA concentration was measured using the NanoDrop (ND-1000 Spectrophotometer, Thermo Scientific). The vector fragment cut with KpnI and HindIII was excised and purified from gel after agarose electrophoresis using the Gel extraction kit from Macherey Nagel used according to standard protocol. The purified fragments were used in the Gibson cloning reaction. The Gibson recombination was done with the Gibson Assembly kit of New England Biolabs according to the manual. After the reaction the mix was transformed to ccdB resistant *E. coli* cells. Several clones were checked with restriction enzyme analysis and a clone having the correct band pattern was named BG-AMA1 (SEQ ID NO: 102) and used in the following examples. A plasmid map of BG-AMA1 can be found in FIG. 2.

Example 3: Assembly of the BG-C19 CAS9 Expression Cassette

The CAS9 expression cassette was constructed using the Golden Gate cloning method for combining promoter, open reading frame and terminator sequences described as step 1 in patent application WO2013/144257. Three fragments were synthesized at DNA2.0 (Menlo Park, Calif., USA) and delivered in a standard cloning vector. First fragment is a promoter fragment Pc.FP017 functional in *Aspergillus niger* (SEQ ID NO: 103). Second fragment is an open reading frame encoding the CAS9 protein (SEQ ID NO: 104). Third fragment is a terminator Pc.FT029 functional in *A. niger* (SEQ ID NO: 105). The three separate DNA fragments were cloned with a Golden Gate reaction into the receiving backbone vector 5a (SEQ ID NO: 106). This resulted in the vector named BG-C19 (SEQ ID NO: 107) which contains the functional expression cassette for CAS9. The BG-C19 vector was checked using restriction enzyme analysis and used in the following examples.

Example 4: Cloning of CAS9 Expression Cassette in BG-AMA1 Creating BG-AMA2

Gibson cloning (Gibson et al., 2009) was used to clone the CAS9 expression cassette from the BG-C19 vector into the BG-AMA1 plasmid. PCRs to create fragments with homology were done using Phusion polymerase (New England Biolabs) according to standard PCR protocols. The CAS9 expression cassette was PCR amplified using forward primer DBC-13112 (SEQ ID NO: 108) and reverse primer DBC-13114 (SEQ ID NO: 109) both with 30 bp flanks (homology to BG-AMA1) and BG-C19 as a template. Vector BG-AMA1 was cut open with KpnI. All fragments, the PCR fragments and the cut-open vector, were purified with the PCR purification kit from Macherey Nagel used according to the manual. DNA concentration was measured using the NanoDrop (ND-1000 Spectrophotometer, Thermo Scientific).

Figure 3:
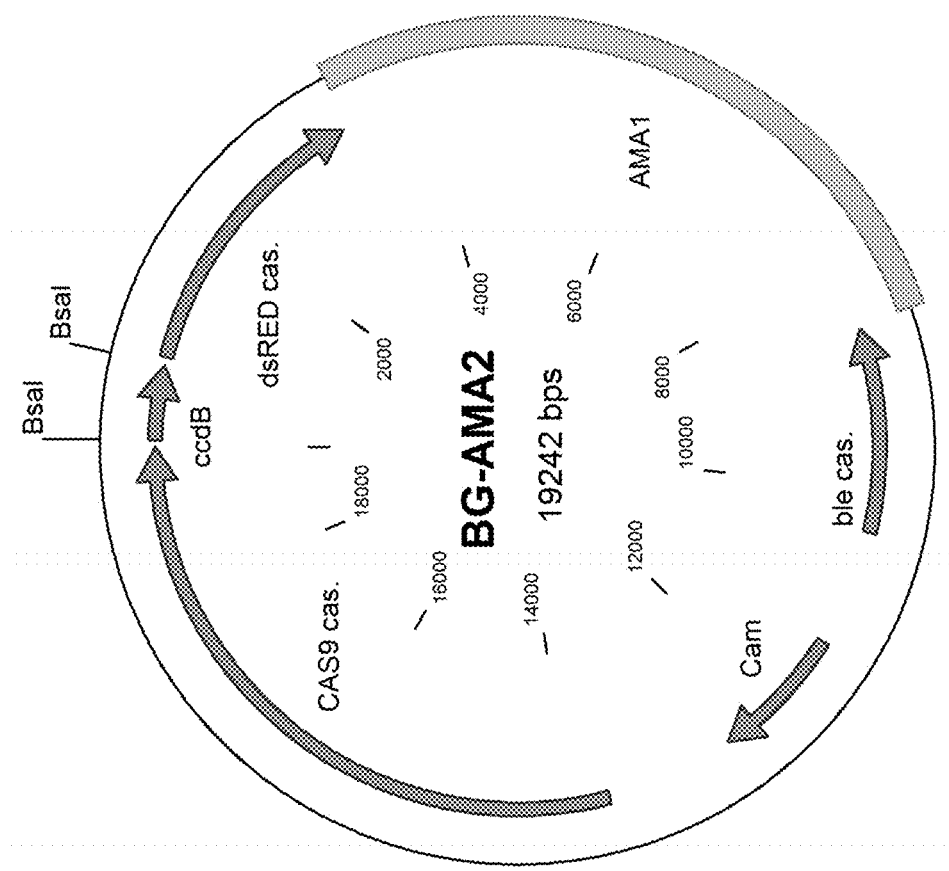
FIG. 3 depicts a plasmid map of vector BG-AMA-2.

The Gibson recombination was done with the Gibson Assembly kit of New England Biolabs according to the manual. After transformation to *E. coli* several clones were checked with restriction enzyme analysis and a clone having the correct band pattern was named BG-AMA2 (SEQ ID NO: 110) which contains the functional expression cassette for CAS9. The BG-AMA2 vector was checked using restriction enzymes analysis and used in the following examples. Plasmid map of BG-AMA2 can be found in FIG. 3.

Example 5: Assembly of the Guide-RNA Self-Processing Ribozymes (gRSR) Expression Cassette with *A. niger* fwnA6 as Genomic Target The gRSR cassette was constructed using the Golden Gate cloning method for combining promoter, open reading frame and terminator sequences described as step 1 in patent application WO2013/144257. Two promoters Pc.PAF (SEQ ID NO: 111) and Te.FP036 (SEQ ID NO: 112) and a terminator Pc.Pc20g04380 (SEQ ID NO: 113) fragment were synthesized at DNA2.0 (Menlo Park, Calif., USA) and delivered in a standard cloning vector. The self-processing ribozyme fragment (SEQ ID NO: 114) was synthesized at IDT(gBlocks® Gene Fragments, Integrated DNA Technologies, Inc) and delivered as a dsDNA gBlock fragment.

Figure 4:
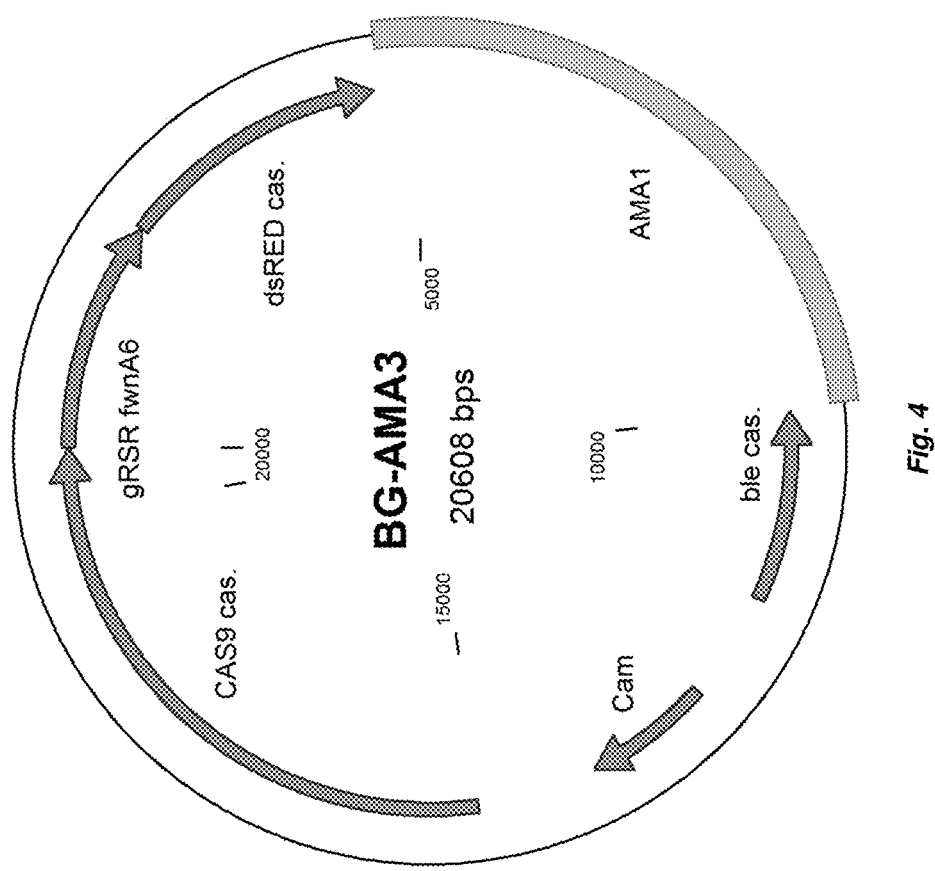
FIG. 4 depicts a plasmid map of vector BG-AMA-3.
Figure 5:
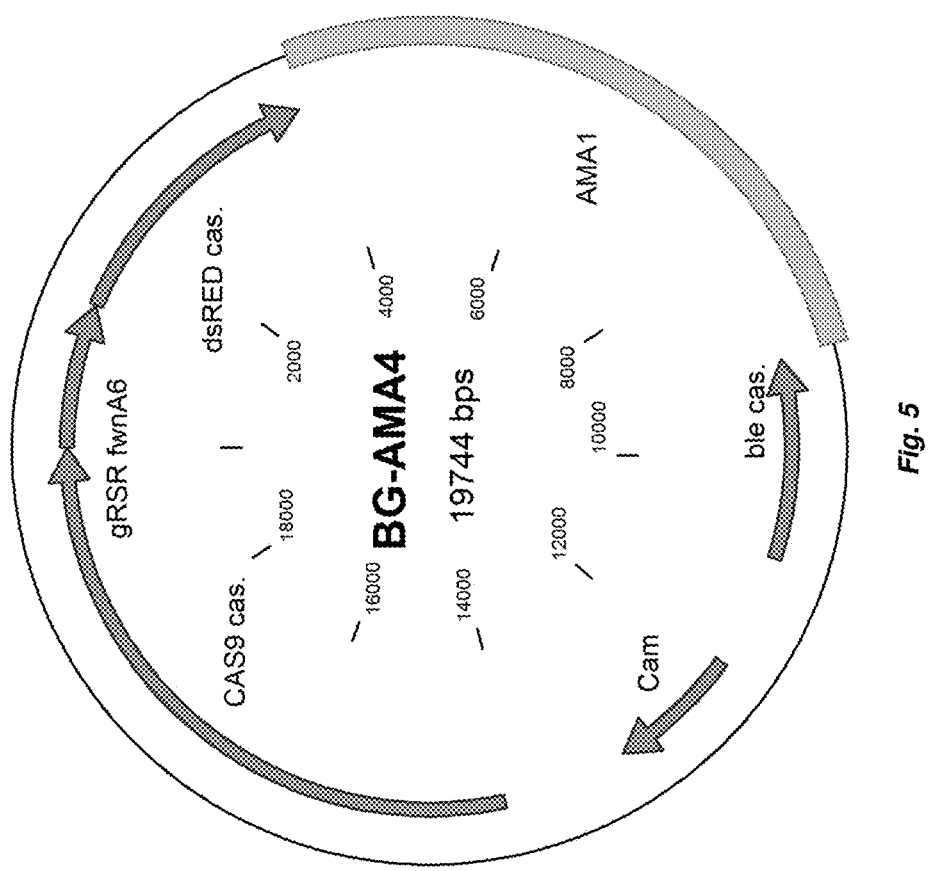
FIG. 5 depicts a plasmid map of vector BG-AMA-4.

Three separate DNA fragments were cloned with a Golden Gate reaction into the receiving backbone vector BG-AMA2. This resulted in the vector named BG-AMA3 (SEQ ID NO: 115) in case Pc.PAF promoter was used and BG-AMA4 (SEQ ID NO: 116) in case Te.FP036 promoter was used. The BG-AMA3 and BG-AMA4 vectors were checked by *E. coli* colony PCR. The PCR was performed using Phusion polymerase (New England Biolabs) according to standard PCR protocols using forward primer DBC-05795 (SEQ ID NO: 117) and reverse primer DBC-05796 (SEQ ID NO: 118). A plasmid map of BG-AMA3 is depicted in FIG. 4 and a plasmid map of BG-AMA4 is depicted in FIG. 5.

Figure 6:
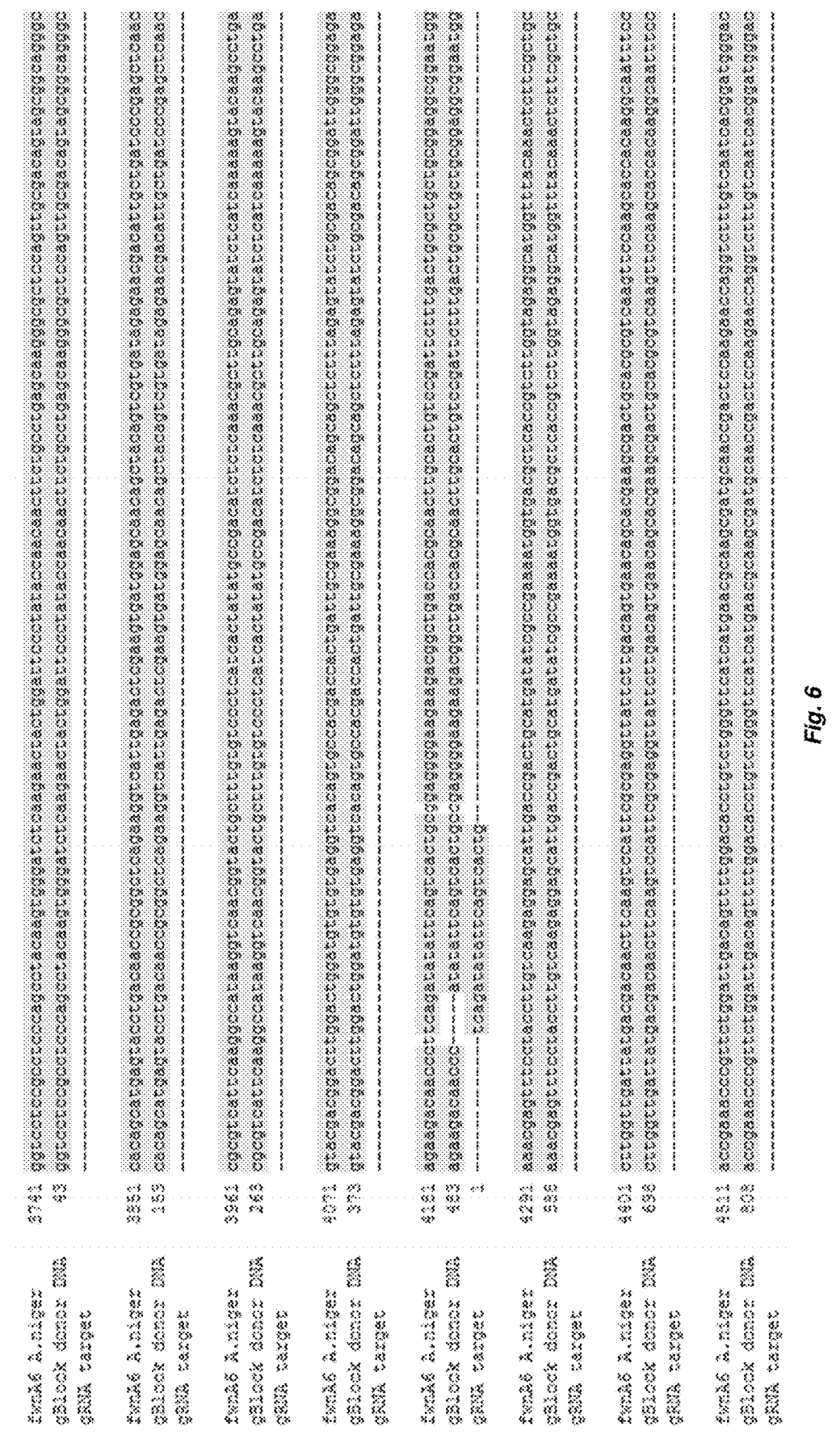

Example 6: Amplification and Purification of BG-AMA3, BG-AMA4 and Donor DNA Fragment The BG-AMA2, BG-AMA3 and BG-AMA4 plasmids were isolated from the *E. coli* culture with Nucleobond Xtra midi kit of Macherey Nagel according to the manual. A gBlock fragment was synthesized at IDT(gBlocks® Gene Fragments, Integrated DNA Technologies, Inc) that contains the donor DNA for the desired mutation (SEQ ID NO: 119). PCR amplification of the donor DNA from the gBlock was done with Phusion polymerase (New England Biolabs) using the forward primer DBC-12195 (SEQ ID NO: 120) and the reverse primer DBC-12196 (SEQ ID NO: 121) according to standard PCR protocols. The PCR fragments were purified with the PCR purification kit from Macherey Nagel according to the manual. DNA concentrations were measured using the NanoDrop (ND-1000 Spectrophotometer, Thermo Scientific). FIG. 6 depicts alignment of the genomic sequence of the fwnA6 gene, the 20 bp that is incorporated in the gRSR responsible for specifically targeting the genome and the donor DNA that will facilitate the repair of the double stranded cut via HDR and thereby introduce the frame shift in fwnA6 and/or the point mutation in the PAM sequence (CGG to CCG).

Example 7: Transformations to *A. niger* GBA 301 and GBA 302

Table 1 shows the specific amounts of DNA transformed to the respective strain in each separate transformation.

Protoplast transformation was performed essentially as in WO1999/32617 and WO1998/46772, which are herein incorporated by reference.

TABLE 1

Schematic of transformations.

| Transformation | strain | AMA plasmid | Donor DNA |
|---|---|---|---|
| 1 | GBA 301 | 0.5 µg BG-AMA2 | 0 µg |
| 2 | GBA 301 | 0.5 µg BG-AMA2 | 0.5 µg |
| 3 | GBA 301 | 0.5 µg BG-AMA2 | 1.5 µg |
| 4 | GBA 301 | 0.5 µg BG-AMA2 | 4 µg |
| 5 | GBA 301 | 0.5 µg BG-AMA3 | 0 µg |
| 6 | GBA 301 | 0.5 µg BG-AMA3 | 0.5 µg |
| 7 | GBA 301 | 0.5 µg BG-AMA3 | 1.5 µg |
| 8 | GBA 301 | 0.5 µg BG-AMA3 | 4 µg |
| 9 | GBA 301 | 0.5 µg BG-AMA4 | 0 µg |
| 10 | GBA301 | 0.5 µg BG-AMA4 | 0.5 µg |
| 11 | GBA 301 | 0.5 µg BG-AMA4 | 1.5 µg |
| 12 | GBA 301 | 0.5 µg BG-AMA4 | 4 µg |
| 13 | GBA 302 | 0.5 µg BG-AMA2 | 0 µg |
| 14 | GBA302 | 0.5 µg BG-AMA2 | 0.5 µg |
| 15 | GBA302 | 0.5 µg BG-AMA2 | 1.5 µg |
| 16 | GBA302 | 0.5 µg BG-AMA2 | 4 µg |
| 17 | GBA 302 | 0.5 µg BG-AMA3 | 0 µg |
| 18 | GBA302 | 0.5 µg BG-AMA3 | 0.5 µg |
| 19 | GBA 302 | 0.5 µg BG-AMA3 | 1.5 µg |
| 20 | GBA302 | 0.5 µg BG-AMA3 | 4 µg |
| 21 | GBA 302 | 0.5 µg BG-AMA4 | 0 µg |
| 22 | GBA302 | 0.5 µg BG-AMA4 | 0.5 µg |
| 23 | GBA 302 | 0.5 µg BG-AMA4 | 1.5 µg |
| 24 | GBA302 | 0.5 µg BG-AMA4 | 4 µg |

After transformation the protoplasts were plated on regeneration media containing 50 µg/ml Phleomycin and incubated at 30° C. for 4-6 days.

Example 8: Colony PCR SDS/LiAC to Produce DNA Fragment for Sequencing

Spores are plated on a PDA plate and incubated for 2-3 days at 30° C. in an incubator. A piece of a colony is taken with an inoculation loop and put in 50 µl Glucanex™ solution (50 mg/ml Glucanex™ dissolved in KG buffer (60 g/l KCl, 2 g/l Citric acid, adjusted with KOH/HCl to pH 6.2)) in an Eppendorf cup. This is incubated for 1 hour at 37° C. After this step, 300 µl DNA dilution buffer (0.58 g/l NaCl, 0.29 g/l EDTA, 1.58 g/l Tris/HCl pH 7.5) is added and the mix is boiled for 5 minutes in a water bath or PCR apparatus with heated lid. Subsequently, 5 µl template (without mixing) is pipetted from the top of the solution and added in the PCR-mix. The PCR is performed according to standard PCR protocols using Phusion polymerase (New England Biolabs) amplifying the genomic fwnA6 location with forward primer DBC-13318 (SEQ ID NO: 122) and reverse primer DBC-13319 (SEQ ID NO: 123). The PCR fragment is purified with the PCR purification kit from Macherey Nagel according to the manual.

Example 9: Sequencing the Genomic Mutation in fwnA6

PCR for sequencing is done with BigDye Terminator v3.1 Cycle Sequencing kit of Applied Biosystems according to the manual using the forward primer DBC-13320 (SEQ ID NO: 124) and fwnA6 sequence fragment as template. Sequencing PCR product is cleaned by ethanol/EDTA precipitation according to supplier manual. The fwnA6 sequence PCR fragment is pelleted in 10 µl HiDi Formamide of Applied Biosystems and suspension used for sequence analysis with the 3500 Genetic Analyzer of Applied Biosystems (Sanger sequencer).

No mutations are found in the control strain. The transformants containing the spore colour change show the intended frame shift mutations as described in FIG. 24. The results show that the CRISPR/CAS9 system is functional in the strains and indeed increased the efficiency of introducing the intended mutations.

Example 10: Assembly of the BG-C20 CAS9 Expression Cassette

The CAS9 expression cassette was constructed using the Golden Gate cloning method as described in example 3. Three fragments were synthesized at DNA2.0 (Menlo Park, Calif., USA) and delivered in a standard cloning vector. First fragment is a promoter fragment Pc.FP017 (SEQ ID NO: 103) functional in *Aspergillus niger*. Second fragment is an open reading frame encoding the CAS9 protein (SEQ ID NO: 104). Third fragment is a terminator Pc.FT029 functional in *A. niger* (SEQ ID NO: 105). The three separate DNA fragments were cloned with a Golden Gate reaction into the receiving backbone vector 5a (SEQ ID NO: 106). This resulted in the vector named BG-C20 (SEQ ID NO: 125) which contains the functional expression cassette for CAS9. The BG-C20 vector was checked using restriction enzyme analysis and used in the following examples.

Example 11: Cloning of CAS9 Expression Cassette in BG-AMA1 Creating BG-AMA5

Gibson cloning (Gibson et al., 2009) was used to clone the CAS9 expression cassette from the BG-C20 vector into the BG-AMA1 plasmid as described in example 4. The CAS9 expression cassette was PCR amplified using forward primer DBC-13112 (SEQ ID NO: 108) and reverse primer DBC-13114 (SEQ ID NO: 109) both with 30 bp flanks (homology to BG-AMA1) and BG-C20 as a template. Vector BG-AMA1 was cut open with KpnI. All fragments, the PCR fragments and the cut-open vector, were purified and the DNA concentration was measured as in example 4.

Figure 7:
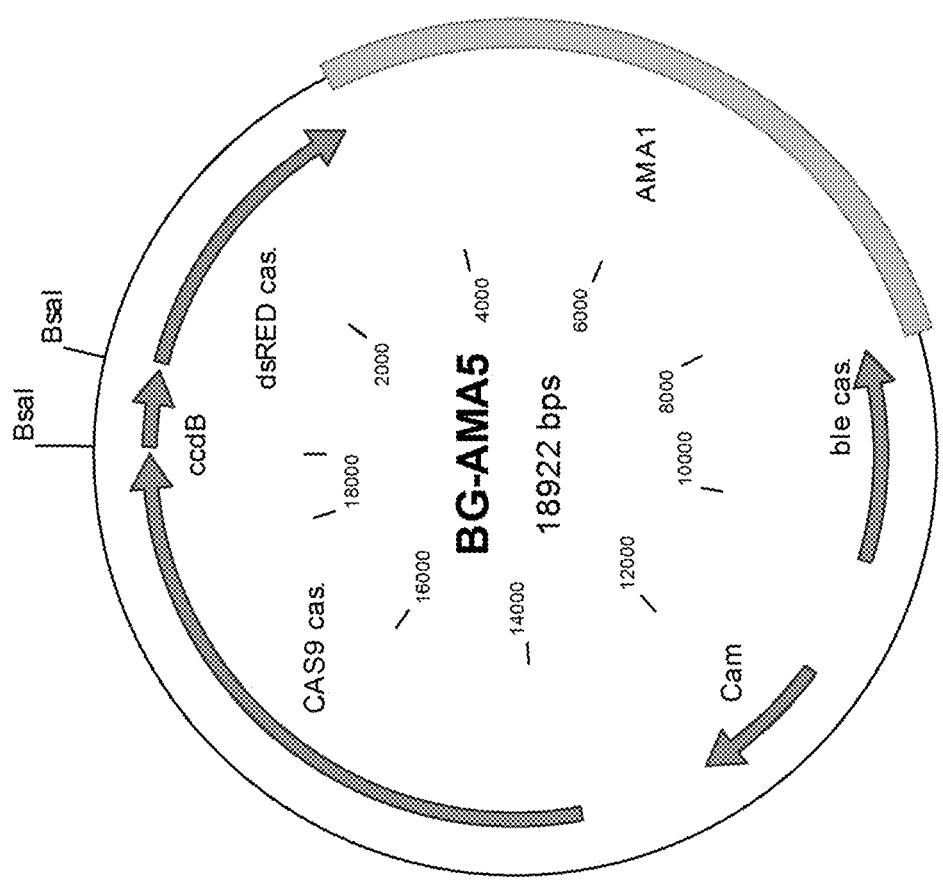
FIG. 7 depicts a plasmid map of vector BG-AMA5.

The Gibson recombination was done with the Gibson Assembly kit of New England Biolabs according to the manual. After transformation to *E. coli* several clones were checked with restriction enzyme analysis and a clone having the correct band pattern was named BG-AMA5 (SEQ ID NO: 126) which contains the functional expression cassette for CAS9. The BG-AMA5 vector was checked using restriction enzyme analysis and used in the following examples. Plasmid map of BG-AMA5 can be found in FIG. 7.

Example 12: Assembly of the Guide-RNA Self-Processing Ribozymes (gRSR) Expression Cassette with *A. niger* fwnA6 as Genomic Target Expressed by a *Aspergillus niger* Tef Promoter The gRSR cassette was constructed as described in Example 5. The promoter An.TEF (SEQ ID NO: 127) and a terminator Pc.Pc20g04380 (SEQ ID NO: 113) fragment were synthesized at DNA2.0 (Menlo Park, Calif., USA) and delivered in a standard cloning vector. The self-processing ribozyme fragment (SEQ ID NO: 114) was synthesized at IDT(gBlocks® Gene Fragments, Integrated DNA Technologies, Inc) and delivered as a dsDNA gBlock fragment.

Figure 8:
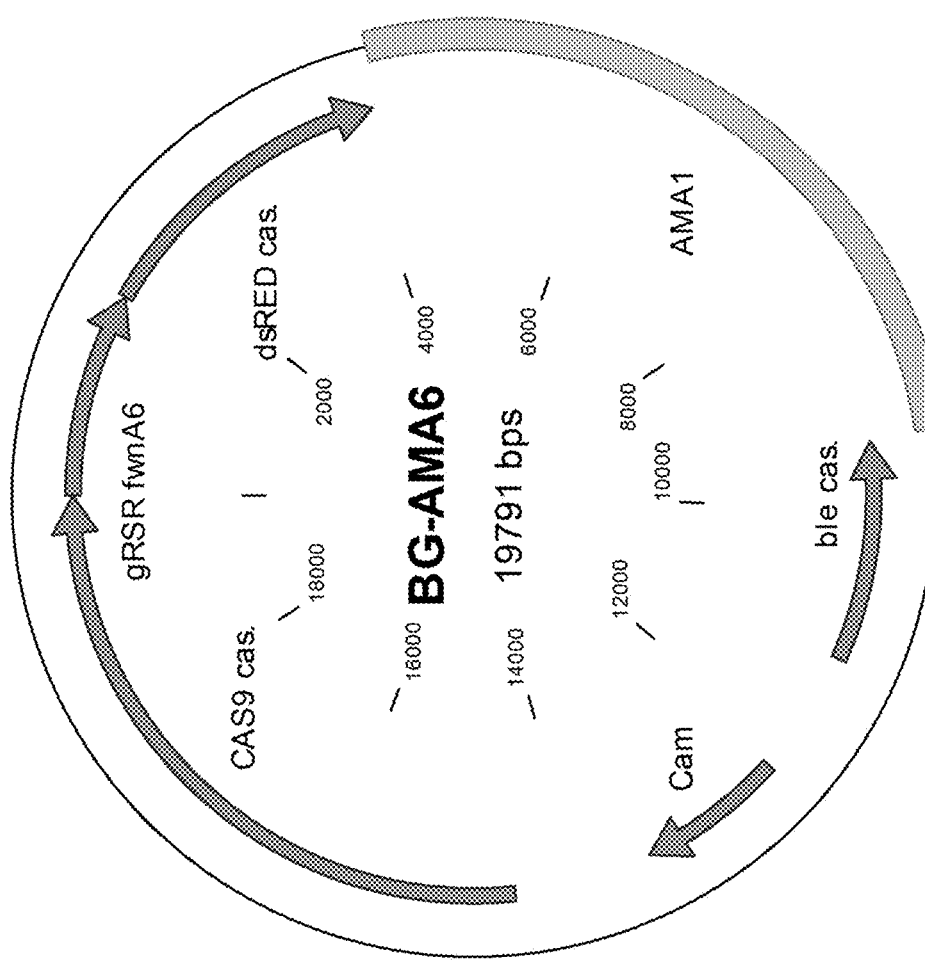
FIG. 8 depicts a plasmid map of vector BG-AMA6.

The three separate DNA fragments were cloned with a Golden Gate reaction into the receiving backbone vector BG-AMA5. This resulted in the vector named BG-AMA6 (SEQ ID NO: 128). The BG-AMA6 vector was checked by *E. coli* colony PCR. The PCR was performed using Phusion polymerase (New England Biolabs) according to standard PCR protocols using forward primer DBC-05795 (SEQ ID NO: 117) and reverse primer DBC-05796 (SEQ ID NO: 118). A plasmid map of BG-AMA6 is depicted in FIG. 8.

Example 13: Amplification and Purification of BG-AMA5, BG-AMA6 and Donor DNA Fragment The BG-AMA5 and BG-AMA6 plasmids were isolated from the *E. coli* culture with Nucleobond Xtra midi kit of Macherey Nagel according to the manual. A gBlock fragment was synthesized at IDT(gBlocks® Gene Fragments, Integrated DNA Technologies, Inc) that contains the donor DNA for the desired mutation (SEQ ID NO: 119). PCR amplification of the donor DNA from the gBlock was done with Phusion polymerase (New England Biolabs) using the forward primer DBC-12195 (SEQ ID NO: 120) and the reverse primer DBC-12196 (SEQ ID NO: 121) according to standard PCR protocols. The PCR fragments were purified with the PCR purification kit from Macherey Nagel according to the manual. DNA concentrations were measured using the NanoDrop (ND-1000 Spectrophotometer, Thermo Scientific). FIG. 6 depicts alignment of the genomic sequence of the fwnA6 gene, as already described in Example 6.

Example 14: Transformations to *A. niger* GBA 301 and GBA 302

Table 2 shows the specific amounts of DNA transformed to the respective strain in each separate transformation. The GBA 302 corresponds to strain GBA 301 wherein the gene ku70 knocked-out.

Protoplast transformation was performed as described in Example 7.

TABLE 2

Overview of performed transformations.

| Transformation | strain  | AMA plasmid   | Donor DNA |
|----------------|---------|---------------|-----------|
| 1              | GBA 301 | 1 µg BG-AMA5  | 0 µg      |
| 2              | GBA 301 | 1 µg BG-AMA5  | 4 µg      |
| 3              | GBA 301 | 1 µg BG-AMA6  | 0 µg      |
| 4              | GBA 301 | 1 µg BG-AMA6  | 4 µg      |
| 5              | GBA 302 | 1 µg BG-AMA5  | 0 µg      |
| 6              | GBA 302 | 1 µg BG-AMA5  | 4 µg      |
| 7              | GBA 302 | 1 µg BG-AMA6  | 0 µg      |
| 8              | GBA 302 | 1 µg BG-AMA6  | 4 µg      |

After transformation the protoplasts were plated on regeneration media plates containing 25 µg/ml Phleomycin and incubated at 30° C. for 4-6 days.

Results of the transformation can be found in table 3.

TABLE 3

Results of the transformations.

| Transformation | strain  | AMA plasmid  | Donor DNA | No. of transformants with fwnA6 phenotype/total no. transformants | % fwnA6 |
|----------------|---------|--------------|-----------|-------------------------------------------------------------------|---------|
| 1              | GBA 301 | 1 µg BG-AMA5 | 0 µg      | 0/62                                                              | 0       |
| 2              | GBA 301 | 1 µg BG-AMA5 | 4 µg      | 0/84                                                              | 0       |
| 3              | GBA 301 | 1 µg BG-AMA6 | 0 µg      | 0/1                                                               | 0       |
| 4              | GBA 301 | 1 µg BG-AMA6 | 4 µg      | 5/22                                                              | 22.7    |
| 5              | GBA 302 | 1 µg BG-AMA5 | 0 µg      | 0/103                                                             | 0       |
| 6              | GBA 302 | 1 µg BG-AMA5 | 4 µg      | 0/32                                                              | 0       |
| 7              | GBA 302 | 1 µg BG-AMA6 | 0 µg      | 0/2                                                               | 0       |
| 8              | GBA 302 | 1 µg BG-AMA6 | 4 µg      | 25/121                                                            | 20.7    |

The transformants from all transformation plates were counted and scored for the white/fawn spore phenotype characteristic of the fwnA mutation. FIG. 9. shows a picture taken from two transformation plates, one from transformation 6 and a plate from transformation 8 to illustrate the difference in results obtained. Results show that in transformations 4 and 8 about 20% of the transformants have the white/fawn spore phenotype (indicated as "% fwnA6" in table 3). These transformations used BG-AMA6, which contains the CAS9 and gRSR cassette, in combination with donor DNA. In contrast the control transformations 2 and 6 did not result in any colonies with the white/fawn spore phenotype. These transformations used the BG-AMA5, with CAS9 but without the gRSR cassette, in combination with donor DNA.

The results show that the CRISPR/CAS9 system with gRSR cassette and together with the donor DNA was functional in the transformations 4 and 8 during transformation and resulted in the rather efficient introduction of the intended mutations.

Example 15: Colony PCR SDS/LiAC to Produce DNA Fragment for Sequencing

Spores were plated on a PDA plate containing 25 µg/ml Phleomycin and incubated for 2-3 days at 30°, in an incubator. For each tested colony a sample of the colony was taken with an inoculation loop and put in 25 µl Glucanex™ solution (50 mg/ml Glucanex™ dissolved in KC buffer (60 g/l KCl, 2 g/l Citric acid, adjusted with KOH/HCl to pH 6.2)) in an Eppendorf cup. After 1 hour incubation at 37° C., 75 µl DNA dilution buffer (0.58 g/l NaCl, 0.29 g/l EDTA, 1.58 g/l Tris/HCl pH 7.5) was added to each cup followed by boiling for 5 minutes in PCR apparatus with heated lid. After boiling 100 µl millQ water was added and mixed very mildly by pipetting up and down three times. Subsequently, 5 µl chromosomal DNA template was pipetted carefully from the top of the solution and added in the PCR-mix for each reaction (without taking along cell debris from the bottom). The PCR reactions were performed according to standard PCR protocols using Phusion polymerase (New England Biolabs) amplifying the genomic fwnA6 location with forward primer DBC-13320 (SEQ ID NO: 124) and reverse primer DBC-13319 (SEQ ID NO: 123). The PCR fragments were purified with the PCR purification kit from Macherey Nagel according to the manual.

Example 16: Sequencing the Genomic Mutation in fwnA6

PCR for sequencing was done with BigDye Terminator v3.1 Cycle Sequencing kit of Applied Biosystems according to the manual using the reverse primer DBC-13319 and fwnA6 sequence fragment as template. Sequencing PCR product was cleaned by ethanol/EDTA precipitation according to supplier manual. The fwnA6 sequence PCR fragment pellet was dissolved in 10 µl HiDi Formamide of Applied Biosystems and suspension used for sequence analysis with the 3500 Genetic Analyzer of Applied Biosystems (Sanger sequencer).

No mutations were found in the strains with black spores. The transformants containing the spore colour change showed in about 80% of the cases the intended frame shift mutation. Half of these transformants also contained the PAM sequence change. The remaining 20% showed a variation of other kind of mutations.

The results show that the CRISPR/CAS9 (CAS9 and gRSR cassette) system applied with donor DNA is functional in the strains and results in rather efficient introduction of the intended mutations.

Figure 10:
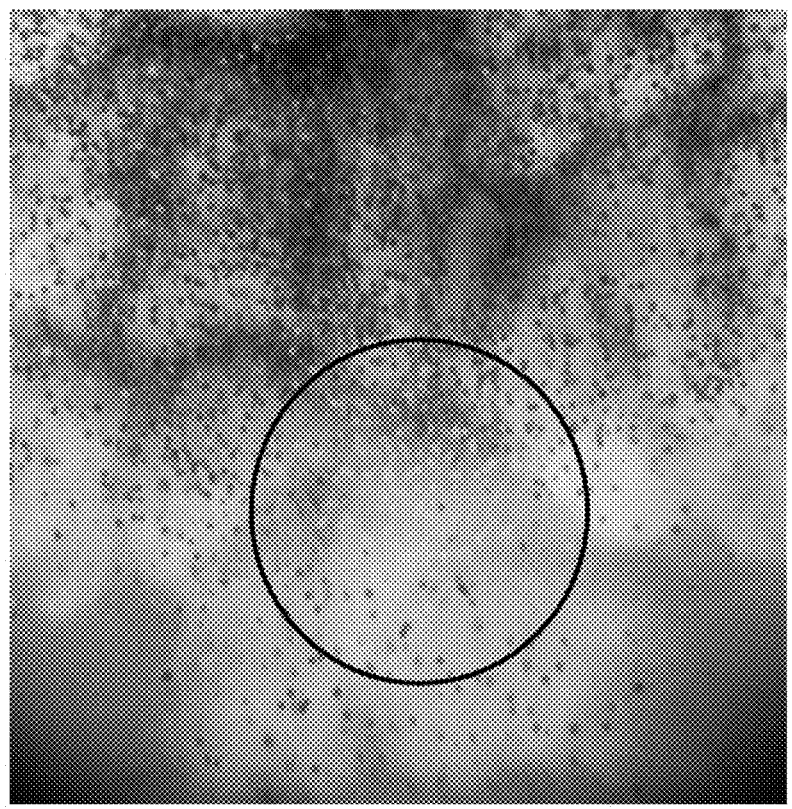
FIG. 10 depicts a zoomed-in picture taken from a colony showing a mix of black spores and white/fawn spores as an example of spore color changes seen with original black spore transformants from transformation 4 and 8 of Table 3.

Example 17: Examination of Transformants with Black Spores from Transformations Using BG-AMA6 after Growth with Additional Generations An interesting observation was made after transferring the transformants with black spores from the BG-AMA6 transformation plate to a PDA plate containing 25 µg/ml Phleomycin. After incubation at 30° C. for 4-6 days black colored spore colonies and white/fawn colored spore colonies appeared. In contrast to this, the transformations where BG-AMA5 was used, black spore colonies remained 100% black spore colonies after transferring to the new plate. As an example, FIG. 10 shows a picture zoomed in on a colony having a mixed population of black and white/fawn spores. Several white/fawn colonies and also some of the black spore colonies were further examined with sequencing using the same methods as described in example 15 and 16. The results showed a variety of mutations at the genomic fwnA6 location. Apparently the CRISPR/CAS9 system expressed from the BG-AMA6 plasmid is still active in the cell cutting in the genome at fwnA6 which results after several generations in a mutation in the fwnA6 gene. Without available donor DNA, at this stage already degraded and/or diluted out, the strains repair the double strand break produced by CAS9 using their double strand DNA repair mechanisms until a mutation is made in the fwnA6 gene making the site unavailable for CRISPR/CAS9, either by a mutation in the PAM site, or the specific polynucleotide target for the encoded guide-polynucleotide molecule.

The sequencing results show a difference in the mutations produced immediately and picked up by phenotypic screening at the transformation plates and after more extensive growth after replating under selective pressure. Mutations observed in colonies directly from the fwnA6 phenotype (white/fawn spores) transformation plate for both GBA301 and GBA302 strain backgrounds comprise at high frequency the mutations delivered by the donor DNA. After more extensive growth mutations observed are typically not introduced by the donor DNA. A difference in occurrence of the mutation pattern is observed for the two different strain backgrounds.

The sequencing results of strains obtained after extended growth, show a difference in the mutations produced by the repair mechanisms in the GBA302 comprising a knock-out of the gene ku70 if compared with those produced in the wild type GBA301 strain. In the strains derived from GBA301 mainly insertion of a nucleobase at a specific location in the fwnA6 gene are introduced.

For GBA301, in about 5/8 instances a nucleotide is added or removed at the expected cleavage position between nucleotide+3 and +4 from the PAM sequence, and in the other 3/8 cases a deletion of about 10-20 nucleotides is observed. In the strains derived from GBA302 instead a deletion of a polynucleotide with a length of 42 or of a polynucleotide of 45 nucleobases is observed. The sequence of the polynucleotide having the same length is the same through the different samples. Further analysing this data shows that a unique recombination effect takes place over identical sequences on both sites of the cleavage site, namely either an identical 9-bp "gtcttcttc" sequence for the 42-nucleotide deletion or an identical 6-bp "tcttct" sequence for the 45 nucleotide deletion. These results indicate that in a host cell, e.g. a filamentous fungus host cell, deficient in a gene involved in NHEJ it is possible to obtain deletions in the host cell genome in a controlled way by using the CRISPR/CAS9 system together with homologous polynucleotide sequences at both sites of the intended cleavage site, preferably a CRISPR/CAS9 system expressed from a AMA-plasmid, preferably a CRISPR/CAS9 system not comprising donor DNA, most preferably a CRISPR/CAS9 system expressed from a AMA-plasmid and not comprising donor DNA.

The described results are of interest for all kinds of genomic modifications, e.g. methods where library based mutagenesis could be of use. This could be for example in strain improvement programs or in large-scale knock-out studies.

Example 18: Donor DNA as PCR Fragment or as Plasmid in Combination with CRISPR/CAS9 and a gRSR Fragment This example describes the functionality of CRISPR/CAS9 in *A. niger* using Cas9 in combination with a gRSR fragment that targets fwnA when using a donor DNA PCR-fragment compared to a plasmid-based donor DNA. PCR-generated donor DNA was used to efficiently introduce a frame shift mutation into the fwnA gene which is involved in spore color formation. Strains with a mutation in the fwnA gene will have a color change in the spores from black to fawn (Jorgensen et al., 2011).

Donor DNA

Figure 11:
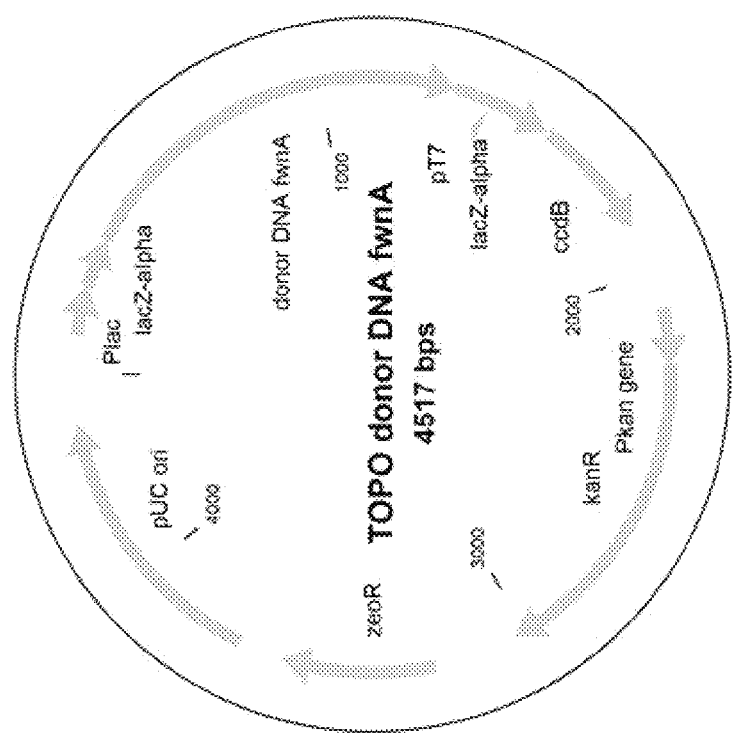
FIG. 11 depicts a plasmid map of vector TOPO donor DNA fwnA.

A gBlock fragment was synthesized at IDT (gBlocks® Gene Fragments, Integrated DNA Technologies, Inc) that contained the donor DNA with the desired mutation (SEQ ID NO: 119). This gBlock-based DNA was cloned into a TOPO Zero Blunt vector using the Zero Blunt TOPO PCR Cloning Kit of Invitrogen (SEQ ID NO: 129). A plasmid map of the resulting vector called "TOPO donor DNA fwnA" is depicted in FIG. 11. PCR amplification of the donor DNA from the TOPO-vector was done with Phusion polymerase (New England Biolabs) using the forward primer as set out in SEQ ID NO: 120 and the reverse primer as set out in SEQ ID NO: 121 according to standard PCR protocols. The PCR fragments were purified using the PCR purification kit from Macherey Nagel according to manufacturer's instructions. DNA concentrations were measured using the NanoDrop (ND-1000 Spectrophotometer, Thermo Scientific). FIG. 6 depicts an alignment of the genomic sequence of the fwnA gene together with the designed donor DNA, as already described in Example 6.

Construction of BG-AMA7

The promoter Anid.TEF (SEQ ID NO: 130) and terminator Pc.Pc20g04380 (SEQ ID NO: 113) fragments were synthesized at DNA2.0 (Menlo Park, Calif., USA) and delivered in two separate standard cloning vectors. The self-processing ribozyme fragment containing the genomic target (SEQ ID NO: 114) was synthesized at IDT (gBlocks® Gene Fragments, Integrated DNA Technologies, Inc) and delivered as a gBlock double stranded DNA fragment. This gBlock fragment was cloned into a TOPO Zero Blunt vector using the Zero Blunt TOPO PCR Cloning Kit of Invitrogen.

Figure 12:
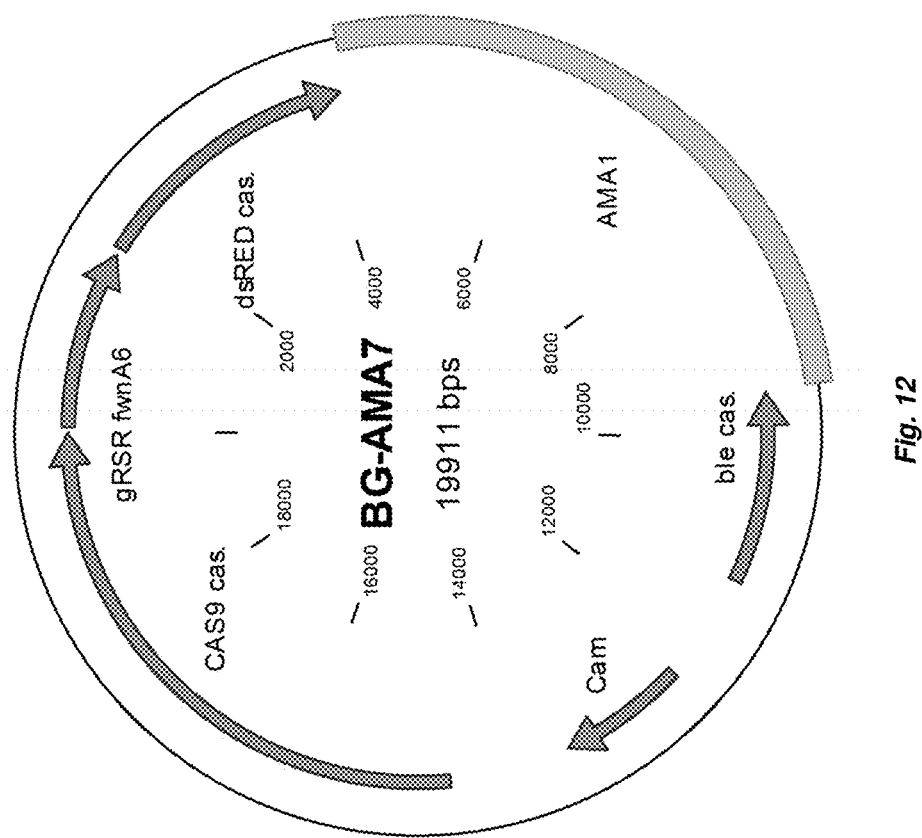
FIG. 12 depicts a plasmid map of vector BG-AMA7.

The three separate DNA vectors were used to obtain the promoter-, the self-processing ribozyme- and the terminator fragment, which subsequently were cloned using a Golden Gate reaction (according to example 1 in patent application WO2013/144257) into the receiving backbone vector BG-AMA5 (SEQ ID NO: 126 described in Example 8). This resulted in the vector named BG-AMA7 (SEQ ID NO: 131). A plasmid map of BG-AMA7 is depicted in FIG. 12. The BG-AMA7 vector was checked by *E. coli* colony PCR to check the size of the cloned gRSR fwnA cassette. The PCR was performed using Phusion polymerase (New England Biolabs) according to standard PCR protocols using forward primer as set out in SEQ ID NO: 117 and reverse primer as set out in SEQ ID NO: 118.

Plasmid Isolation Cas9 AMA-Plasmids with or without Guide RNA

Plasmid BG-AMA5 (SEQ ID NO:126 described in Example 8), plasmid BG-AMA6 (SEQ ID NO:128 described in Example 9) and plasmid BG-AMA7 (SEQ ID NO: 131) were isolated from the *E. coli* culture with Nucleobond Xtra midi kit of Macherey Nagel according to manufacturer's instructions. DNA concentrations were measured using the NanoDrop (ND-1000 Spectrophotometer, Thermo Scientific).

Transformation

Table 4 shows an overview of the AMA-plasmids used in the transformation.

Table 5 shows the specific amounts of DNA transformed to the strain GBA 301 in each separate transformation.

Protoplast transformation was performed as described in Example 4.

TABLE 4

Overview of used AMA-plasmids

| AMA-plasmid | Description |
| --- | --- |
| BG-AMA5 | Pc.FP017.pro-Cas9-Pc.FT029.ter/no guide RNA cassette |
| BG-AMA6 | Pc.FP017.pro-Cas9-Pc.FT029.ter/*A. niger*.TEF.pro-gRSR fwnA-Pc.Pc20g04380 |
| BG-AMA7 | Pc.FP017.pro-Cas9-Pc.FT029.ter/*A. nidulans*.TEF.pro-gRSR fwnA-Pc.Pc20g04380 |

TABLE 5

Overview of performed transformations.

| Transformation | Strain | AMA plasmid | Donor DNA |
| --- | --- | --- | --- |
| 1 | GBA 301 | 1.5 µg BG-AMA5 | 0 µg |
| 2 | GBA 301 | 1.5 µg BG-AMA5 | 4 µg PCR-fragment |
| 3 | GBA 301 | 1.5 µg BG-AMA5 | 1 µg TOPO-vector |
| 4 | GBA 301 | 1.5 µg BG-AMA5 | 4 µg TOPO-vector |
| 5 | GBA 301 | 1.5 µg BG-AMA6 | 0 µg |
| 6 | GBA 301 | 1.5 µg BG-AMA6 | 4 µg PCR-fragment |
| 7 | GBA 301 | 1.5 µg BG-AMA6 | 1 µg TOPO-vector |
| 8 | GBA 301 | 1.5 µg BG-AMA6 | 4 µg TOPO-vector |
| 9 | GBA 301 | 1.5 µg BG-AMA7 | 0 µg |
| 10 | GBA 301 | 1.5 µg BG-AMA7 | 4 µg PCR-fragment |
| 11 | GBA 301 | 1.5 µg BG-AMA7 | 1 µg TOPO-vector |
| 12 | GBA 301 | 1.5 µg BG-AMA7 | 4 µg TOPO-vector |

After transformation the protoplasts were plated on regeneration media plates containing 50 µg/ml Phleomycin (InvivoGen) and incubated at 30° C. for 4-6 days. Subsequently phenotypes (spore color) was determined and scored directly from the transformation plates.

Results of the spore color phenotype assessment after transformation can be found in table 6.

TABLE 6

Results of the transformations. The no. of fwnA phenotype indicates the number of fawn colored colonies identified in the total number of transformants.

| Transformation | Strain | AMA plasmid | Donor DNA | No. of fwnA phenotype/ total no. transformants | % of fwnA phenotype of total no. transformants |
|---|---|---|---|---|---|
| 1 | GBA 301 | 1.5 µg BG-AMA5 (CRISPR/CAS9) | 0 µg | 0/42 | 0 |
| 2 | GBA 301 | | 4 µg PCR-fragment | 0/169 | 0 |
| 3 | GBA 301 | | 1 µg TOPO-vector | 0/153 | 0 |
| 4 | GBA 301 | | 4 µg TOPO-vector | 0/289 | 0 |
| 5 | GBA 301 | 1.5 µg BG-AMA6 (CRISPR/CAS9 & gRSR) | 0 µg | 10/84 | 11.9 |
| 6 | GBA 301 | | 4 µg PCR-fragment | 19/61 | 31.1 |
| 7 | GBA 301 | | 1 µg TOPO-vector | 63/160 | 39.4 |
| 8 | GBA 301 | | 4 µg TOPO-vector | 64/169 | 37.9 |
| 9 | GBA 301 | 1.5 µg BG-AMA7 (CRISPR/CAS9 & gRSR) | 0 µg | 6/35 | 17.1 |
| 10 | GBA 301 | | 4 µg PCR-fragment | 54/142 | 38.0 |
| 11 | GBA 301 | | 1 µg TOPO-vector | 52/136 | 38.2 |
| 12 | GBA 301 | | 4 µg TOPO-vector | 57/133 | 42.9 |

The transformants from all transformation plates were counted and scored for the fawn spore phenotype characteristic of the fwnA mutation.

A small effect was found in the total amount of obtained transformants with or without the presence of donor DNA (PCR fragment or plasmid based). A higher amount of transformants as a result of an increased amount of DNA present in a transformation is seen more often. The presence/absence of guide RNA (transformations 1-4 versus 5-12 in table B) had no effect on transformation frequencies.

No fwnA phenotype transformants were observed when CRISPR/CAS9 was present but no guide RNA was present with or without adding of donor DNA (transformations 1-4 in table B, results in Table C). The results with gRSR show that in transformations 5 and 9 on average 15% of the transformants had the fwnA phenotype when transforming an AMA-plasmid with guide RNA and no addition of donor DNA. This indicates that targeted mutations in fwnA arise. This might be derived from imprecise non-homologous end joining (NHEJ)-mediated repair that can produce insertion and/or deletion mutations of variable length at the site of the DSB (Sander and Joung, 2014). In case of the transformations with Cas9 cassette, guide RNA cassette and donor DNA (transformations 6-8 and 10-12) on average 38% of fwnA phenotype mutants were obtained, a clear improvement compared to frequencies without donor DNA present. Thus, including donor DNA in the transformation increased the number of targeted modifications, in this case fwnA phenotype mutants.

When comparing transformations 5-12, the results showed the same performance of targeted modifications for the various types of donor DNA used, in this case the percentage of fwnA phenotype mutants. Both a homologous (*A. niger* TEF promoter) and a heterologous (*A. nidulans* TEF promoter) promoter used for expression of the guide RNA and both types of donor DNA used in the transformation (PCR-fragment or plasmid based) work equally well.

Dependent on the application, the use of PCR fragments as donor (PCR amplification can be automated and can be done in high throughput more easily) can have specific benefits, compared to the use and isolation of plasmid DNA. When using the CRISPR-Cas system in multiplex approach (the use of 2 or more guide RNA's targeting to different loci) it could be beneficial to place all donor DNA's on one plasmid.

Colony PCR SDS/LiAC to Produce DNA Fragment for Sequencing

Spores were plated on a PDA plate (Difco) and incubated for 2-3 days at 30° C. in an incubator. Colony PCR SDS/LiAC was done as described in example 32 for obtaining template material for checking genetic modifications obtained in fwnA by sequencing PCR fragments.

Confirming the Genomic Mutation in fwnA by Sequencing

All handlings were done as described in example 33. For each transformation, a maximum of 10 transformants showing a fwnA phenotype were sequenced. The percentage of transformants that contain the designed 5 bp deletion compared to the total number of transformants can be found in table 7.

TABLE 7

Results of the sequencing indicated as the percentage of transformants that contain the designed 5 bp deletion compared to the total number of transformants.

| Transformation | Strain | AMA plasmid | Donor DNA | % of transformants with the designed 5 bp deletion |
|---|---|---|---|---|
| 1 | GBA 301 | 1.5 µg BG-AMA5 (CRISPR/CAS9) | 0 µg | 0 |
| 2 | GBA 301 | | 4 µg PCR-fragment | 0 |

TABLE 7-continued

Results of the sequencing indicated as the percentage
of transformants that contain the designed 5 bp deletion
compared to the total number of transformants.

| Transformation | Strain | AMA plasmid | Donor DNA | % of transformants with the designed 5 bp deletion |
|---|---|---|---|---|
| 3 | GBA 301 | | 1 µg TOPO-vector | 0 |
| 4 | GBA 301 | | 4 µg TOPO-vector | 0 |
| 5 | GBA 301 | 1.5 µg BG-AMA6 | 0 µg | 0 |
| 6 | GBA 301 | (CRISPR/CAS9) & gRSR | 4 µg PCR-fragment | 25 |
| 7 | GBA 301 | | 1 µg TOPO-vector | 31 |
| 8 | GBA 301 | | 4 µg TOPO-vector | 27 |
| 9 | GBA 301 | 1.5 µg BG-AMA7 | 0 µg | 0 |
| 10 | GBA 301 | (CRISPR/CAS9) & gRSR | 4 µg PCR-fragment | 11 |
| 11 | GBA 301 | | 1 µg TOPO-vector | 27 |
| 12 | GBA 301 | | 4 µg TOPO-vector | 30 |

Results of transformations 6-8 and 10-12 show an equal effect in the percentage of transformants with the designed 5 bp deletion. There seems to be no effect of the promoter used for expression of the guide RNA and the type of donor DNA used in the transformation (PCR-fragment or plasmid based).

Example 19: The Use (and Assembly) of gRSR fwnA Fragment in Three Different *A. niger* Strains This example describes the use of a separate gRSR fwnA fragment compared to gRSR fwnA present on an AMA-plasmid in the CRISPR/Cas9 system. A circular AMA-plasmid without guide RNA was used and compared to a linearized AMA-plasmid without guide RNA when a separate gRSR fwnA fragment was transformed to an *A. niger* strain. For this example the *A. niger* strains GBA 301, GBA 301 with an integrated Cas9 expression cassette and a phleomycin marker (GBA 301-CAS9/Phleo) and GBA 302 (=GBA 301 with ΔhdfA) were used. PCR generated donor DNA was used to introduce a frame shift mutation into the fwnA gene which is involved in spore color formation. Strains with the mutation in the spores will have a color change in the spores from black to fawn (Jorgensen et al., 2011).

Obtaining Strain GBA 301 with Randomly Integrated Cas9/Phleo Fragment

Plasmid BG-AMA5 (SEQ ID NO: 126 described in Example 8) was cut with BsaI-HF (New England Biolabs)+HpaI (New England Biolabs). The Cas9 expression cassette combined with a phleomycin marker (Cas9/phleo) part (SEQ ID NO: 132) was isolated from gel with the QIAquick Gel Extraction Kit (Qiagen) according to manufacturer's instructions. 0.84 µg Cas9/phleo fragment was transformed to strain GBA 301 via the protoplast transformation as described in Example 4. After transformation the protoplasts were plated on regeneration media plates containing 50 µg/ml Phleomycin (InvivoGen) and incubated at 30° C. for 4-6 days.

Spores of obtained transformants were plated on a PDA plate (Difco) containing 25 µg/ml Phleomycin and incubated for 2-3 days at 30° C. in an incubator. Colony PCR was performed as already described in example 12 using the forward primer as set out in SEQ ID NO: 133 and the reverse primer as set out in SEQ ID NO: 134 to check the presence of the Cas9 open reading frame.

Donor DNA

A gBlock fragment was synthesized at IDT (gBlocks® Gene Fragments, Integrated DNA Technologies, Inc) that contained the donor DNA with the desired mutation (SEQ ID NO: 119). This gBlock based DNA was cloned into a TOPO Zero Blunt vector using the Zero Blunt TOPO PCR Cloning Kit of Invitrogen (SEQ ID NO: 129). A plasmid map of the resulting vector called "TOPO donor DNA fwnA" is depicted in FIG. 8. PCR amplification of the donor DNA from the TOPO-vector was done with Phusion DNA polymerase (New England Biolabs) using forward primer as set out in SEQ ID NO: 120 and reverse primer as set out in SEQ ID NO: 121 according to standard PCR protocols. The PCR fragments were purified with the PCR purification kit from Macherey Nagel according to manufacturer's instructions. DNA concentrations were measured using the NanoDrop (ND-1000 Spectrophotometer, Thermo Scientific). FIG. 6 depicts an alignment of the genomic sequence of the fwnA gene, as already described in Example 6.

Construction of the BG-AMA8 Vector

Figure 13:
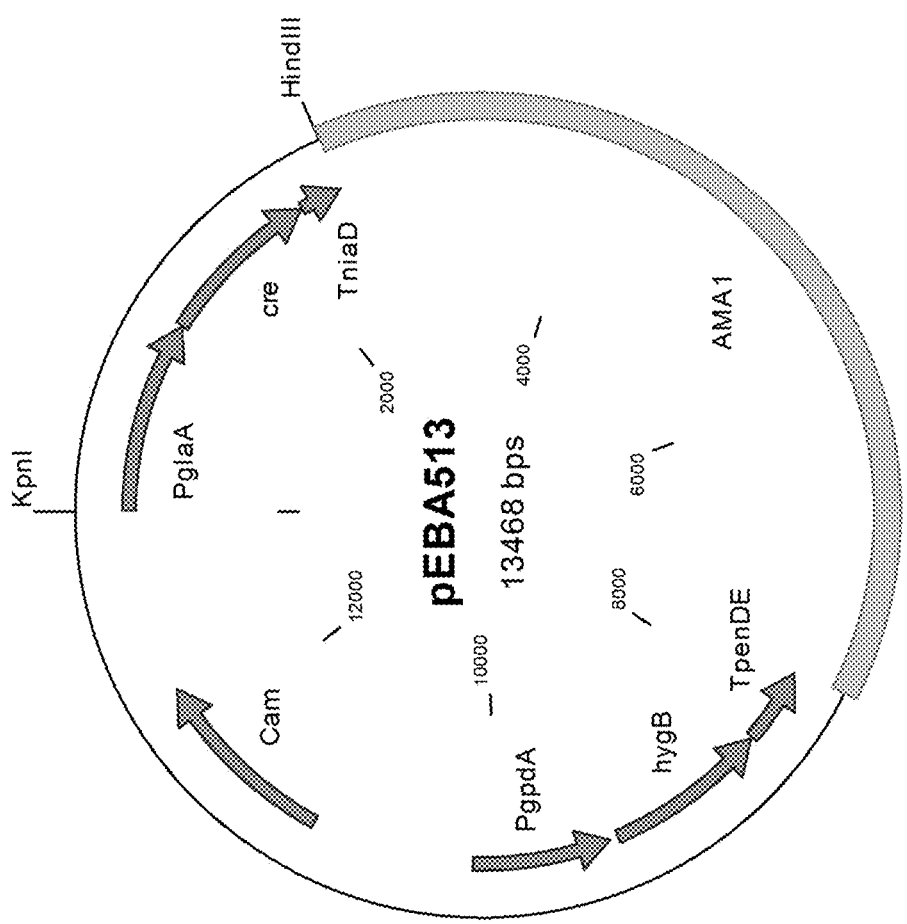
FIG. 13 depicts a plasmid map of vector pEBA513.

The construction of plasmid pEBA513 (SEQ ID NO: 135) was described in example 8. A plasmid map can be found in FIG. 13.

Plasmid pEBA513 contains the dominant selectable hygB marker cassette which confers resistance to hygromycin in filamentous fungi, the Cam gene offering resistance to chloramphenicol antibiotic in *E. coli*, the AMA part for autonomous replication in filamentous fungi and the Cre gene controlled by PglaA (gluco-amylase) promoter. The Cre gene was replaced by two fragments as explained below by using restriction enzymes KpnI (New England Biolabs) and HindIII (New England Biolabs) cutting a 2480 bp fragment from the vector followed by a Gibson cloning reaction adding two new fragments to the vector. Fragment one contains a dsRED expression cassette which will give strains containing the AMA vector with dsRED a clear detectable fluorescent signal. Fragment two contains the ccdB counter selection gene flanked by BsaI sites. The BsaI sites can be used in a Golden Gate assembly described in example 1 in patent application WO2013/144257, the ccdB counter selections aids in the cloning efficiency increasing the percentage correct clones after Golden Gate cloning.

Figure 14:
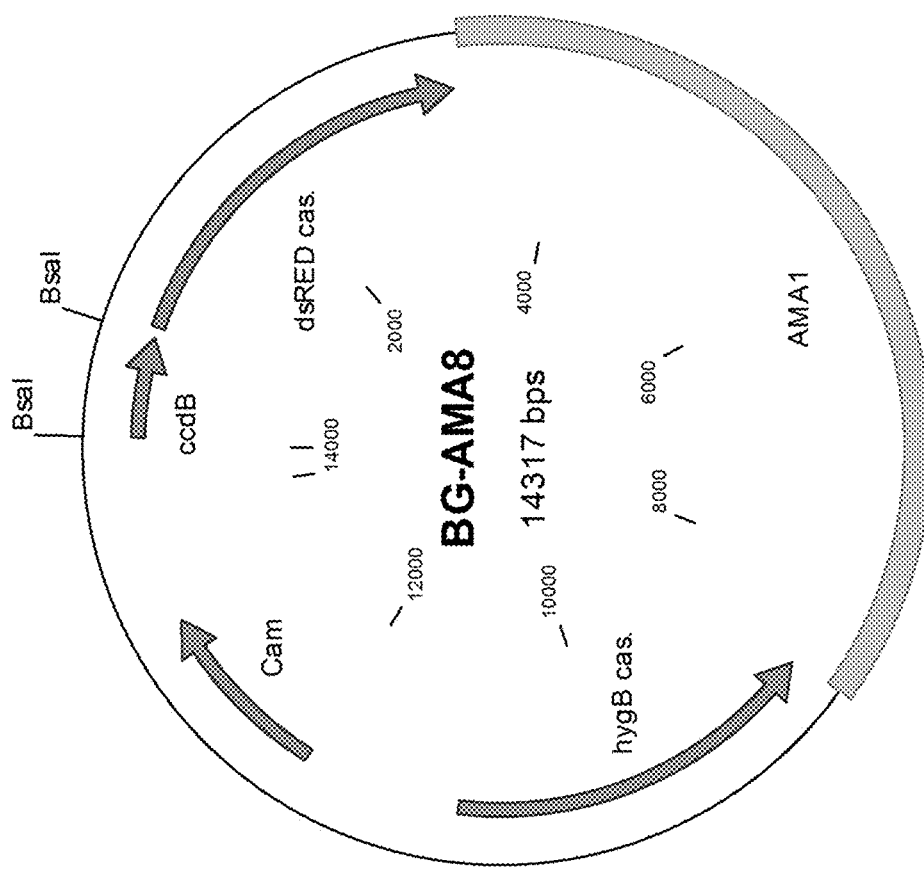
FIG. 14 depicts a plasmid map of vector BG-AMA8.

The forward primer as set out in SEQ ID NO: 96 and reverse primer as set out in SEQ ID NO: 97 were used to PCR amplify the dsRED expression cassette. A plasmid containing the dsRED expression cassette as set out in SEQ ID NO: 98 was used as template in the PCR. The forward primer as set out in SEQ ID NO: 99 and reverse primer as set out in SEQ ID NO: 100 were used to PCR amplify the ccdB fragment from a plasmid as set out in SEQ ID NO: 101 containing this fragment. PCR reactions to obtain fragments with homology were done using Phusion polymerase (New England Biolabs) according to standard PCR protocols. All PCR fragments were purified with the PCR purification kit from Macherey Nagel used according to manufacturer's instructions. DNA concentrations were measured using the NanoDrop (ND-1000 Spectrophotometer, Thermo Scientific). The vector fragment restricted with KpnI and HindIII was excised and purified from gel after agarose electrophoresis using the Gel extraction kit from Macherey Nagel used according to standard protocol. The purified fragments were used in the Gibson cloning reaction. The Gibson recombination was done with the Gibson Assembly kit of New England Biolabs according to manufacturer's instructions. After the reaction, % of the mix was transformed to ccdB resistant E. coli cells. Several clones were checked with restriction enzyme analysis and a clone having the correct band pattern was named BG-AMA8 (SEQ ID NO: 136). A plasmid map of BG-AMA8 can be found in FIG. 14.

Construction of the BG-AMA9 Vector

The promoter An.TEF (SEQ ID NO: 127) and terminator Pc.Pc20g04380 (SEQ ID NO: 113) fragments were synthesized at DNA2.0 (Menlo Park, Calif., USA) and delivered in two separate standard cloning vectors. The self-processing ribozyme fragment containing the genomic target (SEQ ID NO: 114) was synthesized at IDT (gBlocks® Gene Fragments, Integrated DNA Technologies, Inc) and delivered as a gBlock double stranded DNA fragment. This gBlock fragment was cloned into a TOPO Zero Blunt vector with the Zero Blunt TOPO PCR Cloning Kit of Invitrogen.

Figure 15:
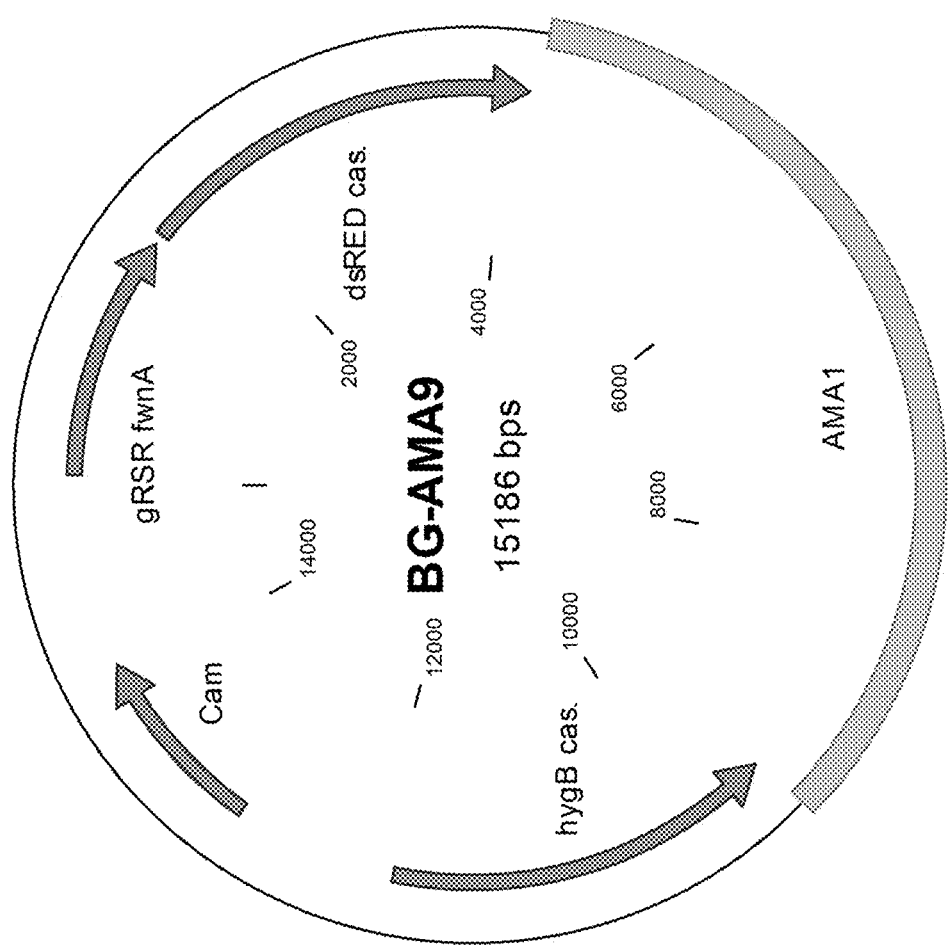
FIG. 15 depicts a plasmid map of vector BG-AMA9.

The three separate DNA vectors were used to obtain the promoter-, the self-processing ribozyme- and the terminator fragment, which subsequently were cloned using a Golden Gate reaction (according to example 1 in patent application WO2013/144257) into the receiving backbone vector BG-AMA8 (SEQ ID NO: 136). This resulted in the vector named BG-AMA9 (SEQ ID NO: 137). A plasmid map of BG-AMA9 is depicted in FIG. 15. The BG-AMA9 vector was checked by E. coli colony PCR to check the size of the cloned gRSR fwnA cassette. The PCR was performed using Phusion polymerase (New England Biolabs) according to standard PCR protocols using forward primer as set out in SEQ ID NO: 117 and reverse primer as set out in SEQ ID NO: 118.

Plasmid Isolation Cas9 AMA-Plasmids with or without Guide RNA

Plasmid BG-AMA5 (SEQ ID NO:126 described in Example 28), plasmid BG-AMA6 (SEQ ID NO:128 described in Example 9), BG-AMA8 (SEQ ID NO: 136) and plasmid BG-AMA9 (SEQ ID NO. 137) were isolated from the E. coli culture with the Nucleobond Xtra midi kit of Macherey Nagel according to manufacturer's instructions. DNA concentrations were measured using the NanoDrop (ND-1000 Spectrophotometer, Thermo Scientific).

Amplification of the gRSR fwnA Cassette

Plasmid BG-AMA6 (SEQ ID NO. 128) was used as template for PCR amplification of the gRSR fwnA cassette with 50 bp overlap with the receiving vectors (SEQ ID NO:138). The PCR was performed using Phusion polymerase (New England Biolabs) according to standard PCR protocols using forward primer as set out in SEQ ID NO: 117 and reverse primer as set out in SEQ ID NO: 118. The gRSR fwnA cassette with overlap was isolated from gel with the OIAquick Gel Extraction Kit (Qiagen) according to manufacturer's instructions. DNA concentrations were measured using the NanoDrop (ND-1000 Spectrophotometer, Thermo Scientific).

Linearization of Plasmids BG-AMA5 and BG-AMA8

BG-AMA5 (SEQ ID NO: 126) and BG-AMA8 (SEQ ID NO. 136) were cut with BsaI-HF (New England Biolabs). Both vectors were isolated from gel with the QIAquick Gel Extraction Kit (Qiagen) according to manufacturer's instructions. DNA concentrations were measured using the NanoDrop (ND-1000 Spectrophotometer, Thermo Scientific).

Transformation

Table 8 shows an overview of the used AMA-plasmids in the transformation.

Table 9 shows the specific amounts of DNA transformed to the strains GBA 301, GBA 301 with randomly integrated Cas9/phleo fragment or GBA 302 in each separate transformation.

Protoplast transformation was performed as described in Example 4.

TABLE 8

Overview of used AMA-plasmids.

| AMA-plasmid | Description |
|---|---|
| BG-AMA5 | Pc.FP017.pro-Cas9-Pc.FT029.ter/no guide RNA cassette |
| BG-AMA6 | Pc.FP017.pro-Cas9-Pc.FT029.ter/An.TEF.pro-gRSR fwnA-Pc.Pc20g04380 |
| BG-AMA8 | No Cas9 cassette/no guide RNA cassette |
| BG-AMA9 | No Cas9/An.TEF.pro-gRSR fwnA-Pc.Pc20g04380 |

TABLE 9

Overview of performed transformations. Transformations were performed to strains GBA 301 GBA 301-CAS9/Phleo (GBA 301 transformed with CAS9 (and a phleomycin marker)) and GBA 302. Different AMA plasmids were used (see also table 8), either as circular plasmids or linearized with BsaI. The gRSR fwnA expression cassette was either not added in the transformation (indicated by x), it was added as PCR fragment with overlap to the linearized BG-AMA5 or BG-AMA8 plasmid, or it was present on the (circular) AMA plasmid. As donor DNA, a PCR fragment containing desired mutations was included in some of the transformations, as indicated in the table below. In total 27 transformations were performed. The row and column numbers indicated in this table refer to table 8.

| Transformation | Row | Column | Strain | AMA plasmid | gRSR fwnA expression cassette | Donor DNA |
|---|---|---|---|---|---|---|
| 1 | A | 1 + 2 | GBA 301 | 1.5 µg BG-AMA5 | x | 0 µg |
| 2 | B | 1 + 2 | GBA 301 | 1.5 µg BG-AMA5 | x | 4 µg PCR-fragment |
| 3 | C | 1 + 2 | GBA 301 | 1.5 µg BG-AMA5 | PCR fragment with overlap | 0 µg |
| 4 | D | 1 + 2 | GBA 301 | 1.5 µg BG-AMA5 | PCR fragment with overlap | 4 µg PCR-fragment |

TABLE 9-continued

Overview of performed transformations. Transformations were performed to strains GBA 301 GBA 301-CAS9/Phleo (GBA 301 transformed with CAS9 (and a phleomycin marker)) and GBA 302. Different AMA plasmids were used (see also table 8), either as circular plasmids or linearized with BsaI. The gRSR fwnA expression cassette was either not added in the transformation (indicated by x), it was added as PCR fragment with overlap to the linearized BG-AMA5 or BG-AMA8 plasmid, or it was present on the (circular) AMA plasmid. As donor DNA, a PCR fragment containing desired mutations was included in some of the transformations, as indicated in the table below. In total 27 transformations were performed. The row and column numbers indicated in this table refer to table 8.

| Transformation | Row | Column | Strain | AMA plasmid | gRSR fwnA expression cassette | Donor DNA |
|---|---|---|---|---|---|---|
| 5 | E | 1 + 2 | GBA 301 | 1.5 μg BG-AMA5 linearized BsaI | x | 0 μg |
| 6 | F | 1 + 2 | GBA 301 | 1.5 μg BG-AMA5 linearized BsaI | PCR fragment with overlap | 0 μg |
| 7 | G | 1 + 2 | GBA 301 | 1.5 μg BG-AMA5 linearized BsaI | PCR fragment with overlap | 4 μg PCR-fragment |
| 8 | H | 1 + 2 | GBA 301 | 1.5 μg BG-AMA6 | on AMA-plasmid | 0 μg |
| 9 | I | 1 + 2 | GBA 301 | 1.5 μg BG-AMA6 | on AMA-plasmid | 4 μg PCR-fragment |
| 10 | A | 3 + 4 | GBA 301-Cas9/Phleo | 1.5 μg BG-AMA8 | x | 0 μg |
| 11 | B | 3 + 4 | GBA 301-Cas9/Phleo | 1.5 μg BG-AMA8 | x | 4 μg PCR-fragment |
| 12 | C | 3 + 4 | GBA 301-Cas9/Phleo | 1.5 μg BG-AMA8 | PCR fragment with overlap | 0 μg |
| 13 | D | 3 + 4 | GBA 301-Cas9/Phleo | 1.5 μg BG-AMA8 | PCR fragment with overlap | 4 μg PCR-fragment |
| 14 | E | 3 + 4 | GBA 301-Cas9/Phleo | 1.5 μg BG-AMA8 linearized BsaI | x | 0 μg |
| 15 | F | 3 + 4 | GBA 301-Cas9/Phleo | 1.5 μg BG-AMA8 linearized BsaI | PCR fragment with overlap | 0 μg |
| 16 | G | 3 + 4 | GBA 301-Cas9/Phleo | 1.5 μg BG-AMA8 linearized BsaI | PCR fragment with overlap | 4 μg PCR-fragment |
| 17 | H | 3 + 4 | GBA 301-Cas9/Phleo | 1.5 μg BG-AMA9 | on AMA-plasmid | 0 μg |
| 18 | I | 3 + 4 | GBA 301-Cas9/Phleo | 1.5 μg BG-AMA9 | on AMA-plasmid | 4 μg PCR-fragment |
| 19 | A | 5 + 6 | GBA 302 | 1.5 μg BG-AMA5 | x | 0 μg |
| 20 | B | 5 + 6 | GBA 302 | 1.5 μg BG-AMA5 | x | 4 μg PCR-fragment |
| 21 | C | 5 + 6 | GBA 302 | 1.5 μg BG-AMA5 | PCR fragment with overlap | 0 μg |
| 22 | D | 5 + 6 | GBA 302 | 1.5 μg BG-AMA5 | PCR fragment with overlap | 4 μg PCR-fragment |
| 23 | E | 5 + 6 | GBA 302 | 1.5 μg BG-AMA5 linearized BsaI | x | 0 μg |
| 24 | F | 5 + 6 | GBA 302 | 1.5 μg BG-AMA5 linearized BsaI | PCR fragment with overlap | 0 μg |
| 25 | G | 5 + 6 | GBA 302 | 1.5 μg BG-AMA5 linearized BsaI | PCR fragment with overlap | 4 μg PCR-fragment |
| 26 | H | 5 + 6 | GBA 302 | 1.5 μg BG-AMA6 | on AMA-plasmid | 0 μg |
| 27 | I | 5 + 6 | GBA 302 | 1.5 μg BG-AMA6 | on AMA-plasmid | 4 μg PCR-fragment |

After transformation the protoplasts were plated on regeneration media plates containing 50 µg/ml Phleomycin (InvivoGen) for the transformation 1-9 and 19-27. Protoplasts of transformations 10-18 were plated on regeneration media plates containing 60 µg/ml Hygromycin B (Invitrogen). All plates were incubated at 30° C. for 4-6 days. Subsequently phenotypes (spore color) was determined and scored directly from the transformation plates.

Results of the spore color phenotype assessment after transformation can be found in table 10

The results in column 4 (strain GBA 301-Cas9/Phleo) showed that when donor DNA was present, a higher percentage fwnA phenotype transformants were obtained when guide RNA PCR fragment with overlap to the AMA-vector was transformed in combination with linearized AMA-plasmid (row G—69%) compared to guide RNA present on a AMA-plasmid (row I—54%) and guide RNA fragment with overlap to the AMA-vector in combination with circular AMA-plasmid (row D—43%). The highest percentage of fwnA phenotype transformants (91%) was obtained with a CAS9 cassette integrated in the genome and with guide

TABLE 10

Results of the 27 transformation experiments. Columns 1,3 and 5 indicate the number of transformants containing the fwnA phenotype and the total number of transformants obtained. Columns 2, 4 and 6 indicate the percentage of fawn colored colonies, containing the fwnA phenotype, identified in the total number of transformants.

| | | | | 1 | 2 | 3 | 4 | 5 | 6 |
|---|---|---|---|---|---|---|---|---|---|
| | | | | GBA 301 (Cas9 on AMA-plasmid) | | GBA 301-CAS9/Phleo | | GBA 302 (Cas9 on AMA-plasmid) | |
| | AMA-plasmid | gRSR fwnA | donor DNA | No. of fwnA phenotype/ total no. transformants | % of fwnA phenotype of total no. transformants | No. of fwnA phenotype/ total no. transformants | % of fwnA phenotype of total no. transformants | No. of fwnA phenotype/ total no. transformants | % of fwnA phenotype of total no. transformants |
| A | Circular | no gRSR | 0 µg | 0/116 | 0 | 0/184 | 0 | 0/92 | 0 |
| B | Circular | no gRSR | 4 µg | 0/22 | 0 | 0/229 | 0 | 0/22 | 0 |
| C | Circular | PCR fragment with overlap | 0 µg | 14/49 | 28.6 | 22/75 | 29.3 | 0/39 | 0 |
| D | Circular | PCR fragment with overlap | 4 µg | 16/34 | 47.1 | 40/94 | 42.6 | 13/21 | 61.9 |
| E | linearized BsaI | no gRSR | 0 µg | 0/25 | 0 | 0/18 | 0 | 0/10 | 0 |
| F | linearized BsaI | PCR fragment with overlap | 0 µg | 13/25 | 52 | 10/11 | 90.9 | 0/12 | 0 |
| G | linearized BsaI | PCR fragment with overlap | 4 µg | 10/22 | 45.5 | 61/90 | 67.8 | 8/13 | 61.5 |
| H | Circular | on AMA-plasmid | 0 µg | 18/87 | 20.7 | 4/12 | 33.3 | 0/41 | 0 |
| I | Circular | on AMA-plasmid | 4 µg | 15/46 | 32.6 | 91/168 | 54.2 | 13/18 | 72.2 |

The transformants from all transformation plates were counted and scored for the fawn spore phenotype characteristic of the fwnA mutation (columns 1, 2, 3, 4, 5 and 6).

When a guide RNA expression cassette was not included with or without the presence of donor DNA in the transformations, no colonies with a fwnA phenotype were obtained (rows A, B and E). This indicated that the donor DNA does not integrate, at least not with a high efficiency, at the intended locus in genomic DNA.

It was observed that more transformants were obtained when circular AMA-plasmid (rows A, C and D) was used compared to linearized AMA-plasmid (row E, F and G).

The results in column 2 (strain GBA 301) showed that when transforming the guide RNA as a separate fragment with overlap to the AMA vector in the presence of donor DNA (row D and G), a higher percentage fwnA phenotype transformants (average of 46%) were obtained compared to transforming an AMA-plasmid containing the guide RNA (row I—21% fwnA phenotype). However also a higher percentage fwnA phenotype transformants were obtained when no donor DNA was added (comparing rows C, F with H). This indicates that targeted mutations in fwnA might arise. This might be from imprecise non-homologous end joining (NHEJ)-mediated repair that can produce insertion and/or deletion mutations of variable length at the site of the DSB (Sander and Joung, 2014). The highest percentage of fwnA phenotype transformants (52%) was obtained with guide RNA as a separate fragment with overlap to a linearized AMA-plasmid and the absence of donor DNA (column 2, row F).

RNA delivered as a separate fragment together with linearized AMA-plasmid and in the absence of donor DNA (column 4, row F).

The results in column 6 (strain GBA 302) show that in general the total amount of transformants is lower compared to GBA 301 and GBA 301-Cas9/Phleo strain backgrounds. For GBA 302, in the absence of donor DNA, but with the presence of guide RNA, no fwnA phenotype transformants were obtained (row C, F and H). Thus, these results suggest that in the absence of hdfA (a mutation causing a deficiency of the non-homologous-end-joining (NHEJ) pathway), a low percentage of mutations occur at the guide RNA target site. A slightly higher percentage of fwnA phenotype transformants were obtained when the guide RNA was on the AMA-plasmid (row I—72%) compared to the percentage fwnA phenotype transformants with guide RNA as a separate fragment (row D and G—both 62%).

Colony PCR SDS/LiAC to Produce DNA Fragment for Sequencing

Spores of transformations 1-27 were plated on a PDA plate (Difco) and incubated for 2-3 days at 30° C. in an incubator. Colony PCR SDS/LiAC to produce DNA fragment for sequencing (confirming the genomic mutation in fwnA) were done according to description in example 12.

Confirming the Genomic Mutation in fwnA by Sequencing

Figure 24:
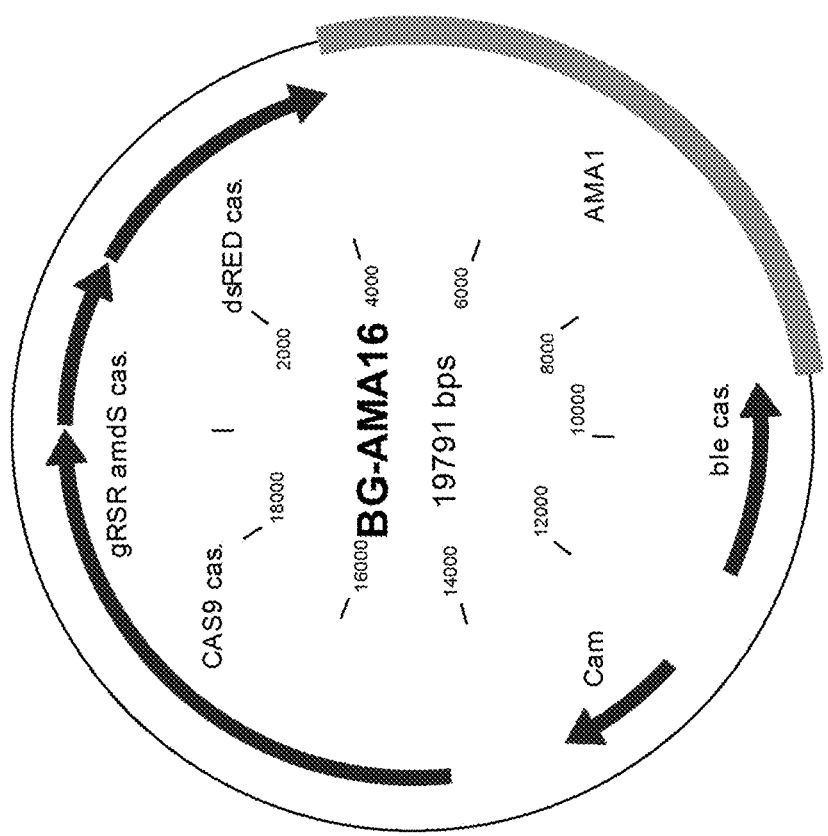
FIG. 24 depicts a plasmid map of vector BG-AMA16.

All handlings were performed as described in example 33. For each transformation, a maximum of 10 transformants showing a fwnA phenotype were sequenced. The percentage of transformants that contain the designed 5 bp deletion (FIG. 24 depicts an alignment of the genomic sequence of the fwnA gene) compared to the total number of transformants can be found in table 11.

TABLE 11

Results of sequencing indicated as the percentage of transformants that contain the designed 5 bp deletion compared to the total number of transformants.

| | | | | 1 | 2 | 3 |
|---|---|---|---|---|---|---|
| | | | | % designed 5 bp deletion of total number of transformants | | |
| | AMA-plasmid | gRSR fwnA | donor DNA | GBA 301 (Cas9 on AMA-plasmid) | GBA 301-Cas9/Phleo | GBA 302 (Cas9 on AMA-plasmid) |
| A | Circular | PCR fragment with overlap | 4 µg | 47.1 | 42.6 | 61.9 |
| B | linearized BsaI | PCR fragment with overlap | 4 µg | 36.4 | 67.8 | 59.3 |
| C | Circular | on AMA-plasmid | 4 µg | 23.3 | 46.5 | 72.2 |

With strain GBA 301 and GBA 301-Cas9/Phleo, the total amount of transformants seemed higher compared to a GBA302 (deficient in NHEJ) strain background.

With strain GBA 301, the highest percentage (47%) of transformants containing the designed 5 bp deletion were obtained with a circular AMA-plasmid and guide RNA as a fragment (row A, column 1).

With strain GBA 301 having Cas9 integrated in its genomic DNA, the highest percentage (68%) of transformants containing the designed 5 bp deletion were obtained with a linearized AMA-plasmid and guide RNA as a PCR fragment (row B, column 2). Perhaps this is because the used linearized AMA-plasmid is around 4.5 kb (AMA-plasmid without Cas9) smaller than the linearized AMA-plasmid used in both other strains.

With strain GBA 302 the highest percentage (72%) of transformants containing the designed 5 bp deletion were obtained with the guide RNA on a circular AMA-plasmid (row C, column 3).

Generally the highest percentage of transformants with the designed 5 bp deletion were obtained when using strain GBA 302 (ΔhdfA), followed by strain GBA 301 with integrated Cas9, followed by strain GBA 301 which contained the lowest percentage of transformants with the designed 5 bp deletion. When making a strain with a combination of ΔhdfA and Cas9 integrated in genome, it could increase the transformation efficiency even further.

Check Assembly of Guide RNA in AMA-Plasmid in *A. niger*

Spores from transformation plate were plated on a PDA plate containing 25 µg/ml Phleomycin (transformations 4, 7, 22 and 25) or 30 µg/ml hygromycin B (transformations 13 and 16) and incubated for 2-3 days at 30° C. in an incubator. For each transformation, 2 black spore phenotype transformants and a maximum of 10 transformants showing a fwnA phenotype were used for colony PCR. Colony PCR SDS/LiAC to check the assembly of the gRSR fwnA fragment into the AMA-plasmid were done according to description in example 32 using forward primer as set out in SEQ ID NO: 139 (in gRSR fwnA cassette) and reverse primer as set out in SEQ ID NO: 140 (in dsRED cassette).

Table 12 shows the number and percentage of transformants showing a correct assembly of the gRSR fwnA fragment into the AMA-plasmid compared to the total number of transformants tested.

TABLE 12

Results of the colony PCR indicated as the number and percentage of transformants showing a correct assembly of the gRSR fwnA fragment into the AMA-plasmid compared to the total number of transformants tested.

| Transformation no. | Strain | AMA-plasmid | gRSR fwnA | donor DNA | No. of correct assembled gRSR in AMA-plasmid based on PCR/ total no. transformants checked | % of correct assembled gRSR fwnA cassette into AMA-vector of tested transformants |
|---|---|---|---|---|---|---|
| 4 | GBA 301 (Cas9 on AMA-plasmid) | Circular | PCR fragment with overlap | 4 µg | 0/12 | 0 |
| 7 | GBA 301 (Cas9 on AMA-plasmid) | linearized BsaI | PCR fragment with overlap | 4 µg | 2/12 | 17 |
| 13 | GBA 301 + Cas9/phleo on genome | Circular | PCR fragment with overlap | 4 µg | 1/12 | 8.3 |
| 16 | GBA 301 + Cas9/phleo on genome | linearized BsaI | PCR fragment with overlap | 4 µg | 4/12 | 33.3 |
| 22 | GBA 302 (Cas9 on AMA-plasmid) | Circular | PCR fragment with overlap | 4 µg | 0/12 | 0 |

TABLE 12-continued

Results of the colony PCR indicated as the number and percentage of transformants showing a correct assembly of the gRSR fwnA fragment into the AMA-plasmid compared to the total number of transformants tested.

| Transformation no. | Strain | AMA-plasmid | gRSR fwnA | donor DNA | No. of correct assembled gRSR in AMA-plasmid based on PCR/ total no. transformants checked | % of correct assembled gRSR fwnA cassette into AMA-vector of tested transformants |
|---|---|---|---|---|---|---|
| 25 | GBA 302 (Cas9 on AMA-plasmid) | linearized BsaI | PCR fragment with overlap | 4 µg | 10/10 | 100 |

Results in table 12 shows that except in the case of 1 transformant (transformation 13-strain GBA 301-Cas9/phleo) all tested transformants when using a circular AMA-plasmid in combination with gRSR fwnA PCR fragment didn't show the assembly of the gRSR fwnA cassette into the AMA-plasmid (transformation 4 and 22).

All tested transformants of strain GBA 302 when using a linearized AMA-plasmid in combination with gRSR fwnA PCR fragment (including the 2 black spore phenotype transformants) were showing a correct assembly of the gRSR fwnA cassette into the AMA-plasmid (transformation 25). In case of strain GBA 301 17% (transformation 7) and strain GBA 301-Cas9/phleo 33.3% (transformation 16) of the tested transformants contained an assembled gRSR fwnA cassette in the AMA-plasmid.

Figure 16A:
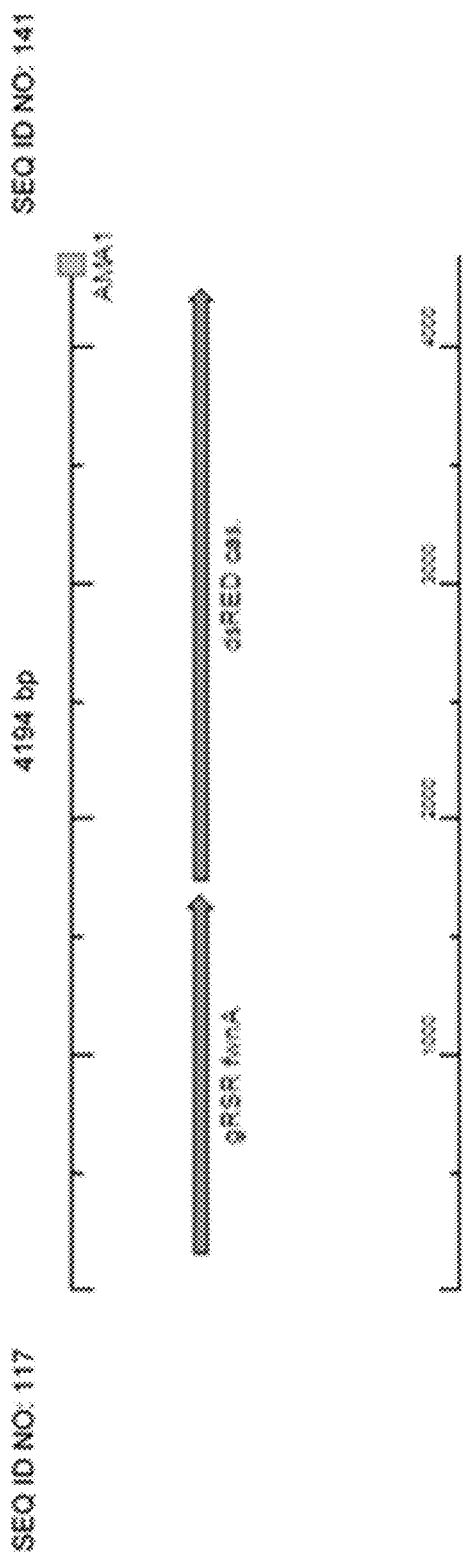
FIG. 16A-B depicts a schematic overview of colony PCR to check the assembly of gRSR cassette into a AMA-plasmid.
Figure 16B:
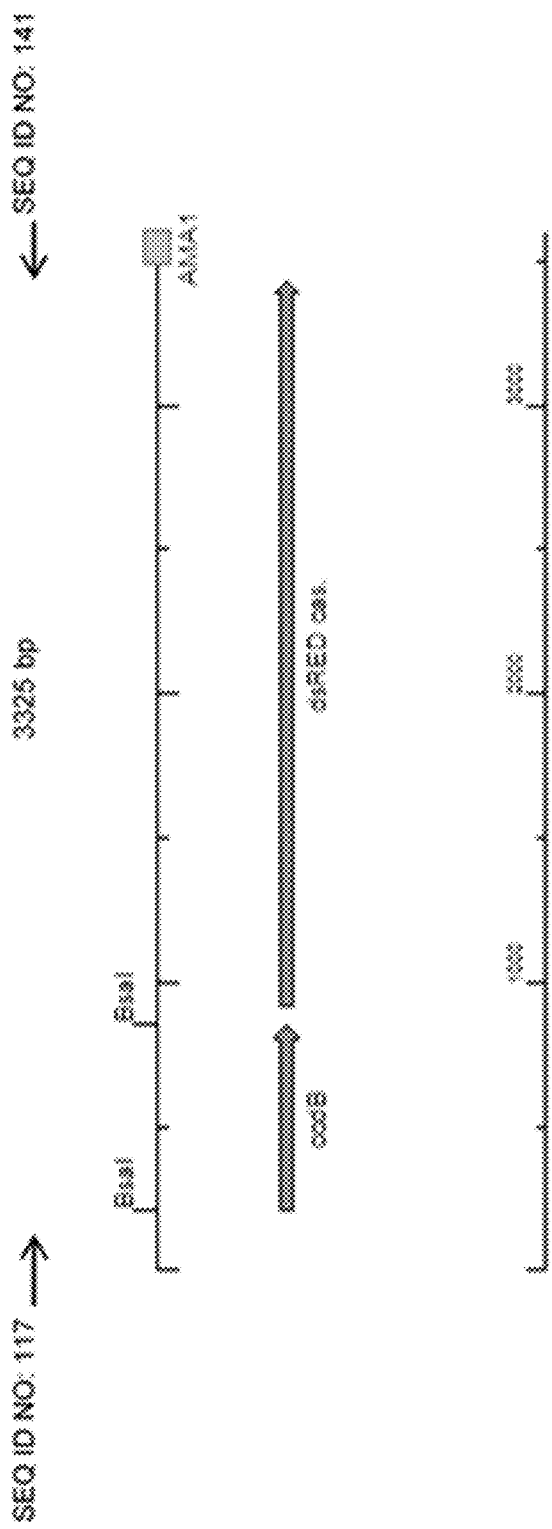
Figure 17:
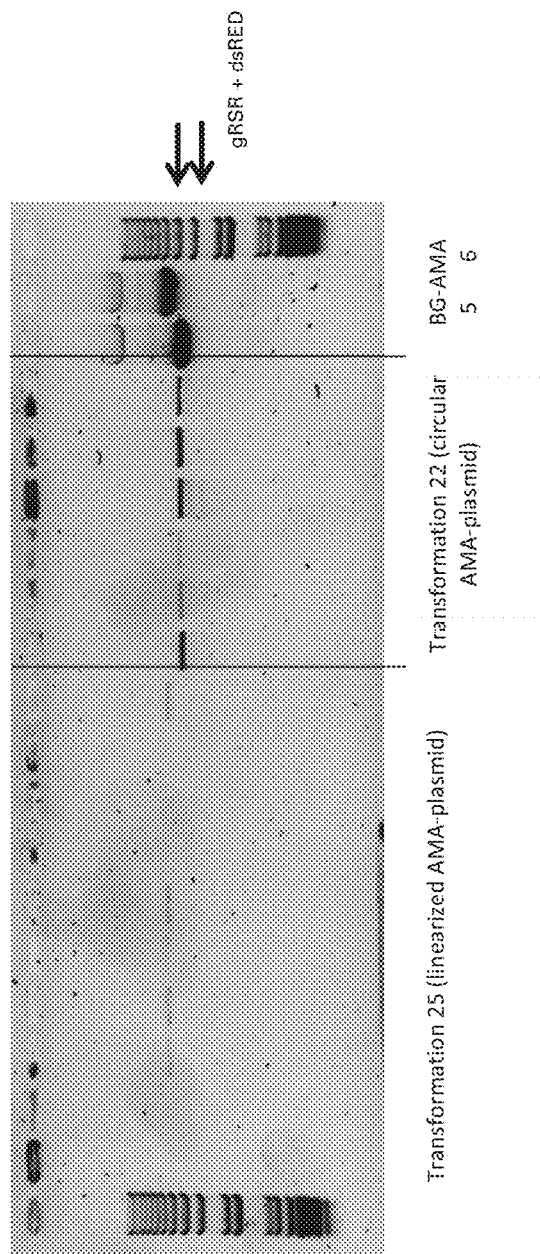
FIG. 17 depicts an image of an electrophorese gel, checking the correct assembly of the gRSR fwnA cassette into the AMA-plasmid.

The same template of transformants of transformation 25 showing the correct assembly of the guide RNA into the AMA-plasmid and as a negative control some transformants of transformation 22 were used in a second colony PCR SDS/LiAC (done according to description in example 32) using forward primer as set out in SEQ ID NO: 117 and reverse primer as set out in SEQ ID NO: 141). A schematic overview of the PCR reaction can be found in FIGS. 16A and 16B. The gel electrophorese image of the performed colony PCR can be found in FIG. 17.

Results of the electrophorese gel (FIG. 17) showed that the PCR product of the transformants of transformation 22, strain GBA 302 with circular AMA-plasmid in combination with gRSR fwnA fragment had the size of ccdB+dsRED which is the same as the used BG-AMA5 plasmid. 5 out of 10 tested transformants which were showing the correct assembly with the primer combination as set out in SEQ ID NO. 211+212, showed again the correct assembly of gRSR fwnA cassette into the AMA-plasmid. With the other 5 transformants no PCR band was obtained. The absence of a PCR band was probably caused by the combination of a large PCR-product with the use of colony PCR method.

Example 20: Making Mutations in Two Different Loci in Genomic DNA of A. niger by Using the CRISPR-CAS System (Multiplex) in One Step This example describes the use of the CRISPR/CAS9 system in combination with two different gRSR fragments that targets fwnA and nicB in one step. For both targets donor DNA was added to introduce a frame shift (target fwnA) or a replacement by a selectable marker (target nicB).

The fwnA gene is involved in spore color formation. Strains with a mutation in the fwnA gene will have a color change in the spores from black to fawn (Jorgensen et al., 2011). The nicB gene is involved in the formation of nicotinamide. Strains in which the nicB gene is replaced by a selectable marker needs supplementation of nicotinamide in minimal medium to be able to grow (Verdoes et al., 1994) and will confer a selectable resistance marker phenotype to a strain.

Figure 18:
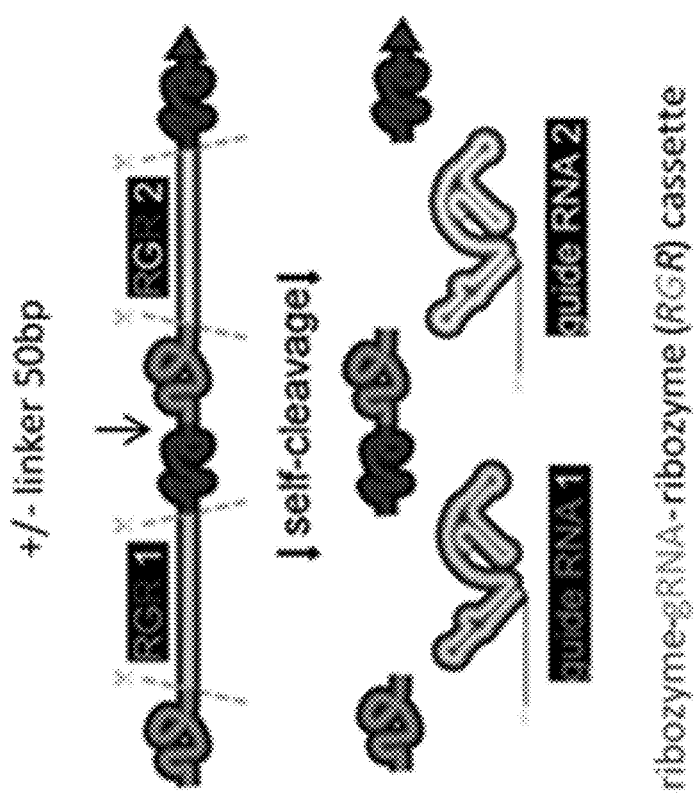
FIG. 18 depicts a schematic drawing of tandemly joined gRSR (ribozyme-guideRNA-ribozyme) fragments.

The gRSR fragments are joined tandemly with or without a 50 bp linker between the 2 different gRSR fragments and placed between a promoter and a terminator. A schematic drawing of tandemly joined gRSR fragments can be found in FIG. 18 (Zhao et al, webpage info 2013-2014).

Donor DNA fwnA Gene

A gBlock fragment was synthesized at IDT (gBlocks® Gene Fragments, Integrated DNA Technologies, Inc) that contained the donor DNA with the desired mutation (SEQ ID NO: 119). This gBlock-based DNA was cloned into a TOPO Zero Blunt vector using the Zero Blunt TOPO PCR Cloning Kit of Invitrogen (SEQ ID NO: 129). A plasmid map of the resulting vector called "TOPO donor DNA fwnA" is depicted in FIG. 11. PCR amplification of the donor DNA from the TOPO-vector was done with Phusion polymerase (New England Biolabs) using the forward primer as set out in SEQ ID NO: 120 and the reverse primer as set out in SEQ ID NO: 121 according to standard PCR protocols. The PCR fragments were purified using the PCR purification kit from Macherey Nagel according to manufacturer's instructions. DNA concentrations were measured using the NanoDrop (ND-1000 Spectrophotometer, Thermo Scientific). FIG. 6 depicts an alignment of the genomic sequence of the fwnA gene together with the designed donor DNA, as already described in Example 6.

Donor DNA nicB Gene

Figure 19:
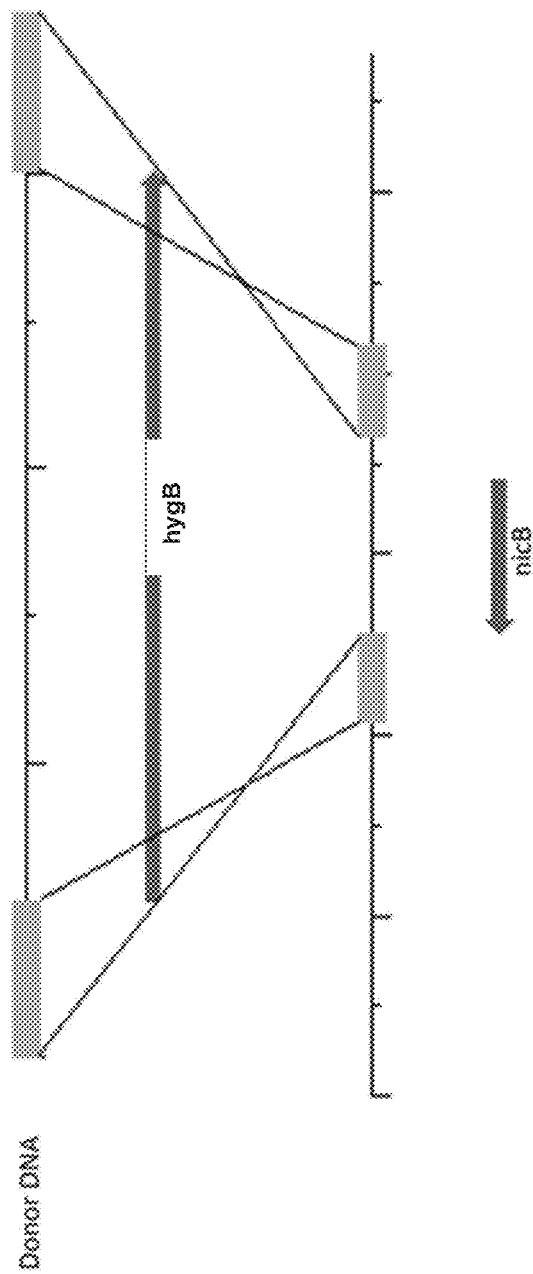
FIG. 19 depicts a schematic overview of replacement of nicB with marker hygB.

Donor DNA for replacing the nicB gene (SEQ ID NO: 142) with GFP cassette was synthesized at DNA2.0 (Menlo Park, Calif., USA) and delivered in a standard cloning vector. PCR amplification of the donor DNA from the cloning vector was done with Phusion polymerase (New England Biolabs) using forward primer as set out in SEQ ID NO: 143 and reverse primer as set out in SEQ ID NO: 144 according to standard PCR protocols. The PCR fragments were purified with the PCR purification kit from Macherey Nagel according to manufacturer's instructions. DNA concentrations were measured using the NanoDrop (ND-1000 Spectrophotometer, Thermo Scientific). FIG. 19 depicts an schematic overview of the nicB gene replacement by a hygB expression cassette.

Construction of the BG-AMA10 Vector

The promoter An.TEF (SEQ ID NO: 127) and terminator Pc.Pc20g04380 (SEQ ID NO: 113) fragments were synthesized at DNA2.0 (Menlo Park, Calif., USA) and delivered in two separate standard cloning vectors. The self-processing ribozyme fragment containing the genomic target for nicB (SEQ ID NO: 145) was synthesized at IDT (gBlocks® Gene Fragments, Integrated DNA Technologies, Inc) and delivered as a gBlock double stranded DNA fragment. This gBlock fragment was cloned into a TOPO Zero Blunt vector using the Zero Blunt TOPO PCR Cloning Kit of Invitrogen.

Figure 20:
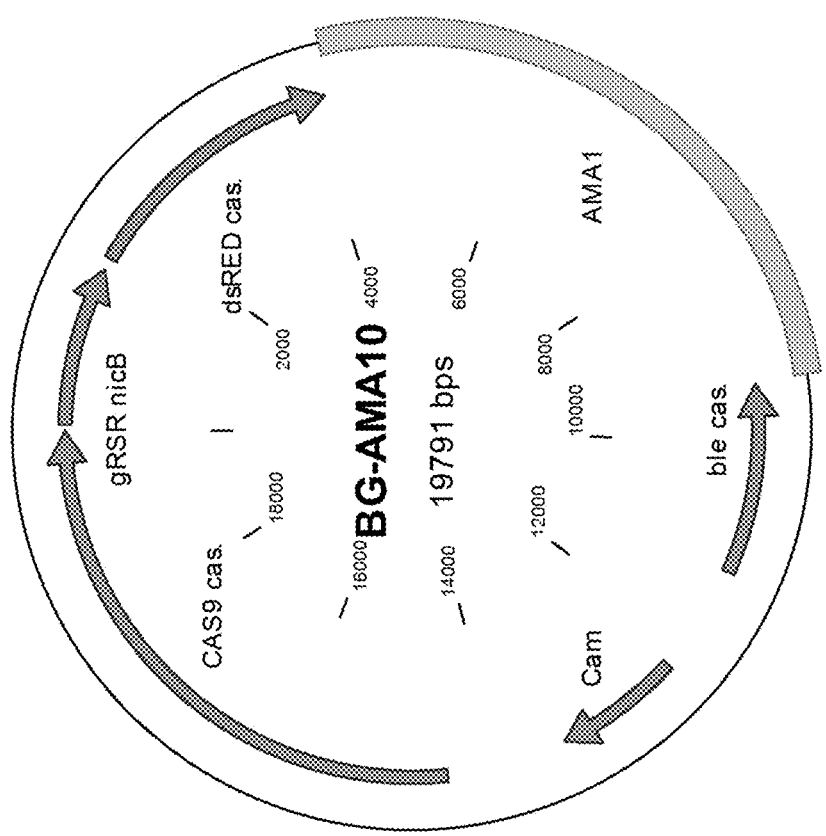
FIG. 20 depicts a plasmid map of vector BG-AMA10.

The three separate DNA vectors were used to obtain the promoter-, the self-processing ribozyme- and the terminator fragment, which subsequently were cloned using a Golden Gate reaction (according to example 1 in patent application WO2013/144257) into the receiving backbone vector BG-AMA5 (SEQ ID NO: 126 described in Example 8). This resulted in the vector named BG-AMA10 (SEQ ID NO: 146). A plasmid map of BG-AMA10 is depicted in FIG. 20. The BG-AMA10 vector was checked by *E. coli* colony PCR for the correct size and DNA sequencing for correctness of the cloned gRSR fwnA cassette. The PCR was performed using Phusion polymerase (New England Biolabs) according to standard PCR protocols using forward primer as set out in SEQ ID NO: 117 and reverse primer as set out in SEQ ID NO: 118.

Construction of the BG-AMA11 Vector

Figure 21:
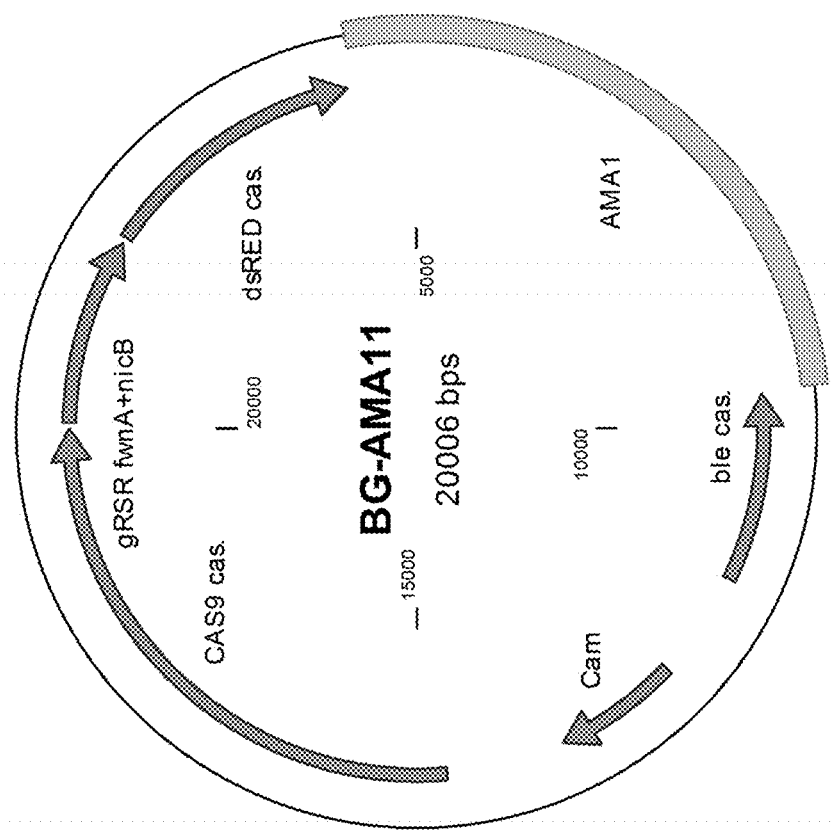
FIG. 21 depicts a plasmid map of vector BG-AMA11.

The promoter An.TEF (SEQ ID NO: 127) and terminator Pc.Pc20g04380 (SEQ ID NO: 113) fragments were synthesized at DNA2.0 (Menlo Park, Calif., USA) and delivered in two separate standard cloning vectors. The fwnA self-processing ribozyme fragment (SEQ ID NO: 147) and the nicB self-processing ribozyme fragment (SEQ ID NO. 148) were synthesized at IDT (gBlocks® Gene Fragments, Integrated DNA Technologies, Inc) and delivered as two separate double stranded gBlock fragments. These gBlock fragments were cloned into a TOPO Zero Blunt vector using the Zero Blunt TOPO PCR Cloning Kit of Invitrogen. The four separate DNA vectors were used to obtain the promoter-, the self-processing ribozymes- and the terminator fragment, which subsequently were cloned using a Golden Gate reaction (according to example 1 in patent application WO2013/144257) into the receiving backbone vector BG-AMA5 (SEQ ID NO: 126 described in Example 8). This resulted in the vector named BG-AMA11 (SEQ ID NO: 149). A plasmid map of BG-AMA11 is depicted in FIG. 21.

The BG-AMA11 vector was checked by *E. coli* colony PCR for the correct size and DNA sequencing for correctness of the cloned gRSR fwnA/nicB cassette. The PCR was performed using Phusion polymerase (New England Biolabs) according to standard PCR protocols using forward primer as set out in SEQ ID NO: 117 and reverse primer as set out in SEQ ID NO: 118.

Construction of the BG-AMA12 Vector

The promoter An.TEF (SEQ ID NO: 127) and terminator Pc.Pc20g04380 (SEQ ID NO: 113) fragments were synthesized at DNA2.0 (Menlo Park, Calif., USA) and delivered in two separate standard cloning vectors. The fwnA self-processing ribozyme fragment with 50 bp linker (SEQ ID NO: 150) and the nicB self-processing ribozyme fragment (SEQ ID NO. 151) were synthesized at IDT (gBlocks® Gene Fragments, Integrated DNA Technologies, Inc) and delivered as two separate gBlock double stranded DNA fragments. These gBlock fragments were cloned into a TOPO Zero Blunt vector using the Zero Blunt TOPO PCR Cloning Kit of Invitrogen.

Figure 22:
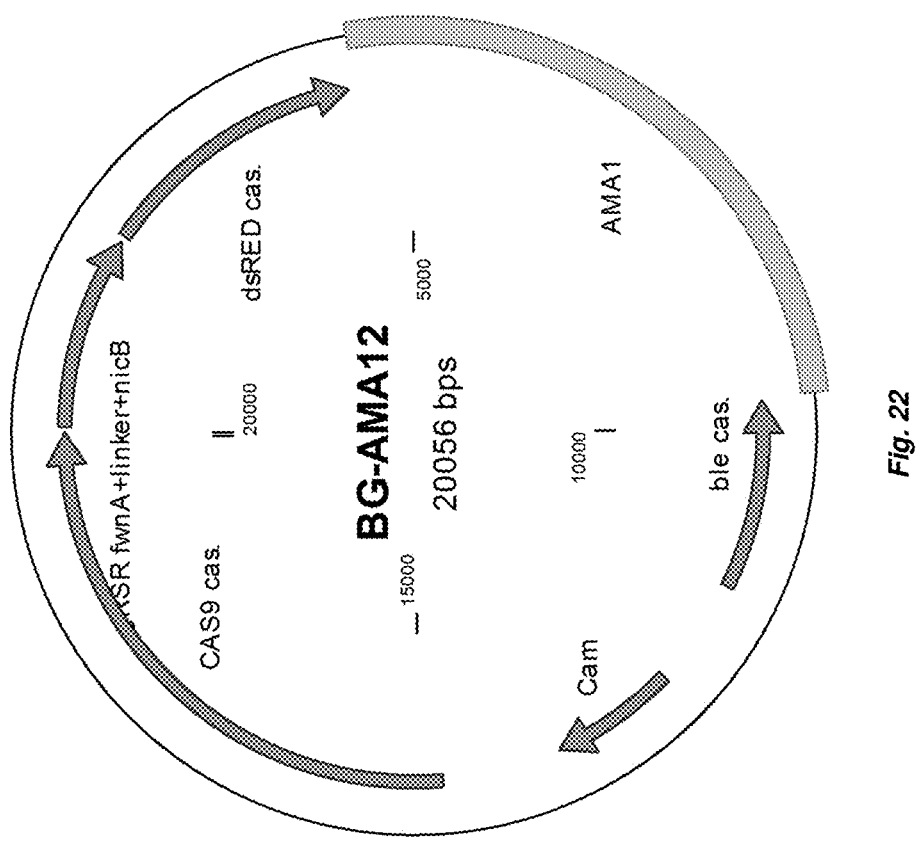
FIG. 22 depicts a plasmid map of vector BG-AMA12.

The four separate DNA vectors were used to obtain the promoter-, the self-processing ribozymes- and the terminator fragment, which subsequently were cloned using a Golden Gate reaction (according to example 1 in patent application WO2013/144257) into the receiving backbone vector BG-AMA5 (SEQ ID NO: 126 described in Example 8). This resulted in the vector named BG-AMA12 (SEQ ID NO: 152). A plasmid map of BG-AMA12 is depicted in FIG. 22.

The BG-AMA12 vector was checked by *E. coli* colony PCR for the correct size and DNA sequencing for correctness of the cloned gRSR fwnA+linker/nicB cassette. The PCR was performed using Phusion polymerase (New England Biolabs) according to standard PCR protocols using forward primer as set out in SEQ ID NO: 117 and reverse primer as set out in SEQ ID NO: 118.

Plasmid Isolation AMA-Plasmids

Plasmid BG-AMA5 (SEQ ID NO:126 described in Example 8), plasmid BG-AMA6 (SEQ ID NO:128 described in Example 9), plasmid BG-AMA10 (SEQ ID NO: 146), plasmid BG-AMA11 (SEQ ID NO: 149) and plasmid BG-AMA12 (SEQ ID NO: 152) were isolated from the *E. coli* culture with Nucleobond Xtra midi kit of Macherey Nagel according to manufacturer's instructions. DNA concentrations were measured using the NanoDrop (ND-1000 Spectrophotometer, Thermo Scientific).

Transformation

Table 13 shows an overview of the used AMA-plasmids in the transformation.

TABLE 13

Overview of used AMA-plasmids

| AMA-plasmid | Description |
|---|---|
| BG-AMA5 | Pc.FP017.pro-Cas9-Pc.FT029.ter/no gRSR cassette |
| BG-AMA6 | Pc.FP017.pro-Cas9-Pc.FT029.ter/An.TEF.pro-gRSR fwnA-Pc.Pc20g04380 |
| BG-AMA10 | Pc.FP017.pro-Cas9-Pc.FT029.ter/An.TEF.pro-gRSR nicB-Pc.Pc20g04380 |
| BG-AMA11 | Pc.FP017.pro-Cas9-Pc.FT029.ter/An.TEF.pro-gRSR fwnA + nicB-Pc.Pc20g04380 |
| BG-AMA12 | Pc.FP017.pro-Cas9-Pc.FT029.ter/An.TEF.pro-gRSR fwnA + linker + nicB-Pc.Pc20g04380 |

Table 14 shows the specific amounts of DNA transformed to the strain GBA 302 (ΔhfdA) in each separate transformation. Protoplast transformation was performed as described in Example 4.

TABLE 14

Overview of performed transformations.

| Transformation | Strain | AMA plasmid | Donor DNA fwnA | Donor DNA nicB |
|---|---|---|---|---|
| 1 | GBA 302 | 1.5 µg BG-AMA5 | 0 µg | 0 µg |
| 2 | GBA 302 | 1.5 µg BG-AMA6 | 0 µg | 0 µg |
| 3 | GBA 302 | 1.5 µg BG-AMA10 | 0 µg | 0 µg |
| 4 | GBA 302 | 1.5 µg BG-AMA11 | 0 µg | 0 µg |
| 5 | GBA 302 | 1.5 µg BG-AMA12 | 0 µg | 0 µg |

TABLE 14-continued

Overview of performed transformations.

| Transformation | Strain | AMA plasmid | Donor DNA fwnA | Donor DNA nicB |
|---|---|---|---|---|
| 6 | GBA 302 | 1.5 µg BG-AMA5 | 4 µg PCR-fragment | 4 µg PCR-fragment |
| 7 | GBA 302 | 1.5 µg BG-AMA6 | 4 µg PCR-fragment | 4 µg PCR-fragment |
| 8 | GBA 302 | 1.5 µg BG-AMA10 | 4 µg PCR-fragment | 4 µg PCR-fragment |
| 9 | GBA 302 | 1.5 µg BG-AMA11 | 4 µg PCR-fragment | 4 µg PCR-fragment |
| 10 | GBA 302 | 1.5 µg BG-AMA12 | 4 µg PCR-fragment | 4 µg PCR-fragment |

After transformation the protoplasts were plated on regeneration media plates containing 60 µg/ml hygromycinB (Invitrogen) and 1 mg/l Nicotinamide (Sigma). All plates were incubated at 30° C. for 4-6 days. Subsequently phenotypes (spore color) was determined and scored directly from the transformation plates.

Results of the spore color phenotype assessment after transformation can be found in table 15.

TABLE 15

Results of the transformations. The percentage of fwnA phenotype indicates the number of fawn colored colonies identified in the total number of transformants.

| Transformation | Strain | AMA plasmid | Donor DNA fwnA | Donor DNA nicB | No. of fwnA phenotype/ total no. transformants | % of fwnA phenotype of total no. transformants |
|---|---|---|---|---|---|---|
| 1 | GBA 302 | 1.5 µg BG-AMA5 | 0 µg | 0 µg | 0 | 0 |
| 2 | GBA 302 | 1.5 µg BG-AMA6 | 0 µg | 0 µg | 0 | 0 |
| 3 | GBA 302 | 1.5 µg BG-AMA10 | 0 µg | 0 µg | 0 | 0 |
| 4 | GBA 302 | 1.5 µg BG-AMA11 | 0 µg | 0 µg | 0 | 0 |
| 5 | GBA 302 | 1.5 µg BG-AMA12 | 0 µg | 0 µg | 0 | 0 |
| 6 | GBA 302 | 1.5 µg BG-AMA5 | 4 µg PCR-fragment | 4 µg PCR-fragment | 0/9 | 0 |
| 7 | GBA 302 | 1.5 µg BG-AMA6 | 4 µg PCR-fragment | 4 µg PCR-fragment | 2/6 | 33 |
| 8 | GBA 302 | 1.5 µg BG-AMA10 | 4 µg PCR-fragment | 4 µg PCR-fragment | 1/50 | 2 |
| 9 | GBA 302 | 1.5 µg BG-AMA11 | 4 µg PCR-fragment | 4 µg PCR-fragment | 2/9 | 22 |
| 10 | GBA 302 | 1.5 µg BG-AMA12 | 4 µg PCR-fragment | 4 µg PCR-fragment | 3/14 | 21 |

The transformants from all transformation plates were selected on hygromycin, and thus have integrated the nicB donor DNA cassette within the genome. All transformants obtained were counted and scored for the fawn spore phenotype characteristic of the fwnA mutation.

Results in table 15 show that no colonies were obtained when no donor DNA was added to the transformations (transformation 1-5), which is in agreement with expectations.

When no guide RNA was present (transformation 6), 9 colonies were obtained. Colonies were resistant to hygromycin, so they integrated the nicB donor DNA. None of these colonies had the fwnA phenotype.

In transformation 7 (only guide RNA for fwnA present) 6 transformants were obtained which were able to grow on plates with hygromycin of which one third (2 transformants) had a fwnA phenotype.

Most transformants (50) were obtained when using plasmid BG-AMA10 containing Cas9 and gRSR nicB (transformation 8), suggesting increased integration efficiencies for the nicB donor DNA cassette. One colony of these transformants was showing the fwnA phenotype (2% of the total number of transformants). Since no guide RNA for the fwnA gene was present, the fwnA phenotype was probably caused by homologous recombination of the fwnA donor DNA.

As in transformation 7, also for transformation 9 and 10 the highest percentages (21-33%) transformants with a fwnA phenotype were obtained. In all these transformations guide RNA for fwnA was present.

Colony PCR SDS/LiAC to Produce DNA Fragment for Sequencing

Spores showing a fwnA mutation phenotype in transformation 9 and 10 were plated on a PDA plate (Difco) and incubated for 2-3 days at 30° C. in an incubator. Colony PCR SDS/LiAC to produce DNA fragment for sequencing (confirming the genomic mutation in fwnA) were done according to description in example 12 using forward primer as set out in SEQ ID SEQ: 151 and reverse primer as set out in SEQ ID SEQ: 123.

Confirming the Genomic Mutation in fwnA by Sequencing

All handlings were done according to description in example 13 using forward primer SEQ ID SEQ: 151. The sequence results can be found in table 16.

TABLE 16

Results of the sequencing indicated as the percentage of transformants that contain the designed 5 bp deletion or another mutation within the total number of transformants with fwnA phenotype obtained.

| Transformation | Strain | AMA plasmid | Donor DNA fwnA | Donor DNA nicB | % designed 5 bp deletion of total number of transformants |
|---|---|---|---|---|---|
| 9 | GBA BG-302 | 1.5 µg AMA11 | 4 µg PCR-fragment | 4 µg PCR-fragment | 100 |
| 10 | GBA BG-302 | 1.5 µg AMA12 | 4 µg PCR-fragment | 4 µg PCR-fragment | 33 |

Results of table 16 shows that both tested transformants (100% of total number of fwnA transformants) in transformation 9 had the designed 5 bp deletion in the fwnA gene.

In transformation 10, 1 transformant (33% of total number of fwnA transformants) had the exact designed 5 bp deletion in the fwnA gene, showing applicability of the method of the invention.

Confirming the Genomic Mutation in nicB by Replica Plating

Spores of transformations 6-10 to a maximum of 10 transformants (including all transformants showing a fwnA phenotype) were plated on a PDA plate (Difco) and incubated for 2-3 days at 30° C. in an incubator.

Spores of on PDA plates were used for replica plating on PDA plates (Difco), minimal medium plates and minimal medium plates with 1 mg/l Nicotinamide (Sigma). Plates were incubated for 2-3 days at 30° C. in an incubator. Subsequently transformants that need nicotinamide to grow on minimal medium were determined and scored from the replica plates.

Figure 23:
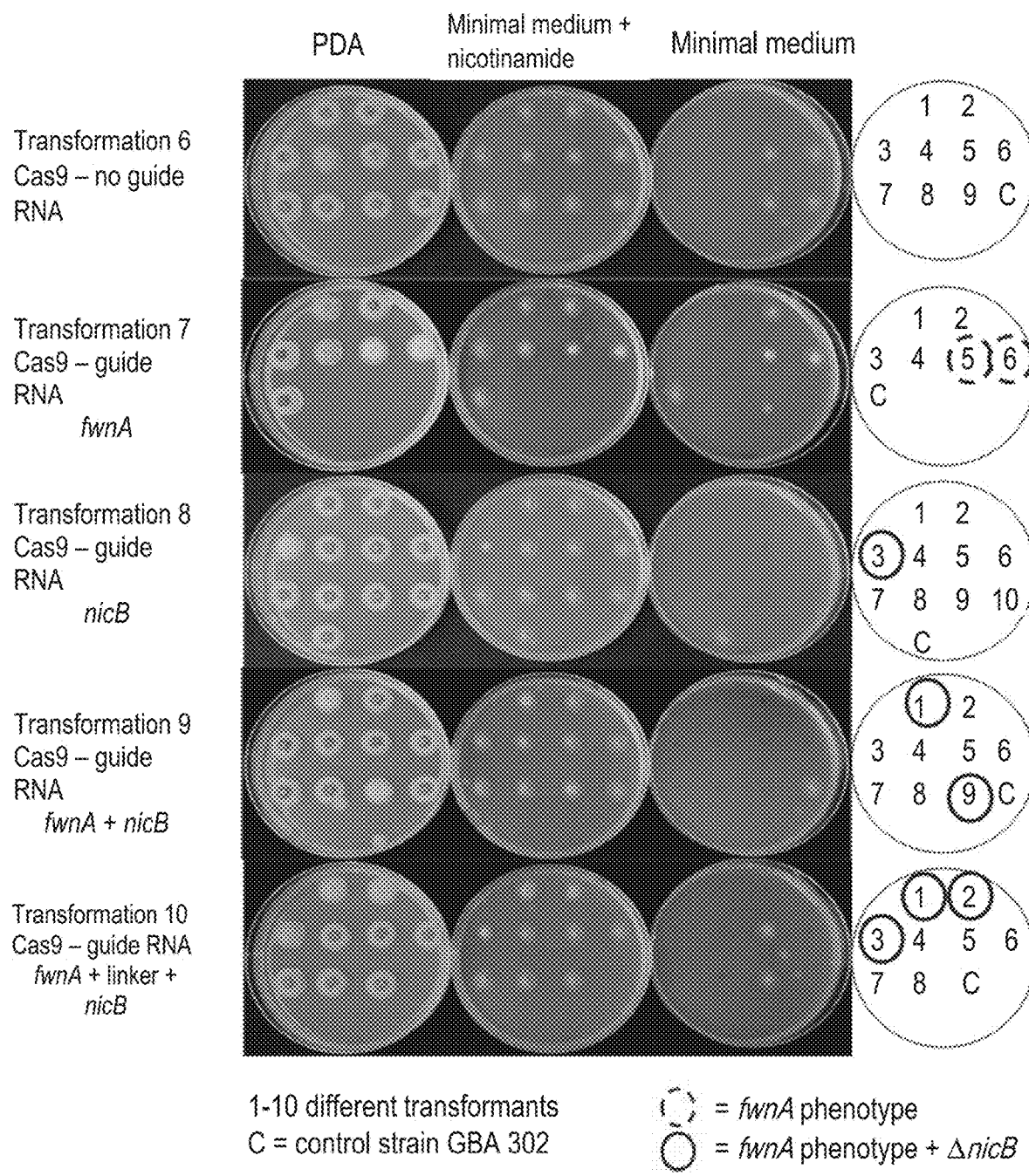
FIG. 23 depicts replica plating of transformants on different media.

Results of the replica plating can be found in table 17. Pictures of the replica plating plates can be found in FIG. 23.

fwnA and nicB gene. This clearly shows the use of gRSR results in an improvement for targeting a donor DNA.

In transformations 9 and 10, 90-100% of the obtained transformants need nicotinamide to be able to grow on minimal medium including all the obtained fwnA phenotype transformants. This means that for almost all hygromycin resistant colonies with guide RNA present for both nicB and fwnA gene, a double mutation in both selected genes has occurred. This means tandem gRSR cassettes clearly provide a benefit for making multiple targeted mutations in a strain, using CRISPR/CAS9 and donor DNA's, with optionally a direct selection or phenotype screening after transformation for integration of at least one of the donor DNA's and/or targeted modification of a (genomic) target DNA.

Example 21: Donor DNA as PCR Fragment with Different Flank Lengths in Combination with CRISPR/CAS9 and a gRSR Fragment This example describes the functionality of CRISPR/CAS9 in *A. niger* using CAS9 in combination with a gRSR fragment that targets the fwnA gene. Variations according to the invention include for example when using donor DNA PCR-fragments with different flank lengths. Donor DNA was used to introduce a frame shift mutation into the fwnA gene which is involved in spore color formation. Strains with a mutation in the fwnA gene will have a color change in the spores from black to fawn (Jorgensen et al., 2011).

Donor DNA

A gBlock fragment was synthesized at IDT (gBlocks® Gene Fragments, Integrated DNA Technologies, Inc) that contains the donor DNA with the desired mutation (SEQ ID NO: 119). This gBlock based DNA was cloned into a TOPO Zero Blunt vector using the Zero Blunt TOPO PCR Cloning Kit of Invitrogen (SEQ ID NO: 129). A plasmid map of the resulting vector called "TOPO donor DNA fwnA" is depicted in FIG. 11. PCR amplification of the donor DNA

TABLE 17

Results of replica plating indicated as the percentage of transformants with a fwnA phenotype, nicotinamide auxotrophic transformants and mutants with double phenotype versusf total number of transformants

| Transformation | Strain | AMA plasmid | Donor DNA fwnA | Donor DNA nicB | % of fwnA phenotype of total no. transformants | % of nicotinamide needed transformants of total no. of transformants | % of double mutants (nicotinamide auxotrophic and with fwnA phenotype) |
|---|---|---|---|---|---|---|---|
| 6 | GBA 302 | 1.5 µg BG-AMA5 | 4 µg PCR-fragment | 4 µg PCR-fragment | 0 | 66.7 | 0 |
| 7 | GBA 302 | 1.5 µg BG-AMA6 | 4 µg PCR-fragment | 4 µg PCR-fragment | 33 | 50 | 0 |
| 8 | GBA 302 | 1.5 µg BG-AMA10 | 4 µg PCR-fragment | 4 µg PCR-fragment | 2 | 100 | 2 |
| 9 | GBA 302 | 1.5 µg BG-AMA11 | 4 µg PCR-fragment | 4 µg PCR-fragment | 22 | 100 | 22 |
| 10 | GBA 302 | 1.5 µg BG-AMA12 | 4 µg PCR-fragment | 4 µg PCR-fragment | 21 | 87.5 | 21 |

Results in table 17 show that in the transformations 6 and 7 (no guide RNA present for the nicB gene) 50-67% of the (hygromycin resistant) transformants need nicotinamide to be able to grow, indicating that the nicB gene was mutated and suggesting homologous integration of the donor DNA.

In transformation 8 (only guide RNA for nicB present) all 10 tested transformants need nicotinamide to be able to grow. One of these transformants had a fwnA phenotype, so 2% of all obtained transformants had a mutation in both the from the TOPO-vector was done with Phusion polymerase (New England Biolabs) to standard PCR protocols. SEQ ID NO of the used primers to obtain donor DNA with different flank lengths can be found in table 18. The ID SEQ NO of the obtained PCR-fragments can also be found in table 18. The PCR fragments were purified with the PCR purification kit from Macherey Nagel according to manufacturer's instructions. DNA concentrations were measured using the NanoDrop (ND-1000 Spectrophotometer, Thermo Scientific). FIG. 6 depicts an alignment of the genomic sequence of the fwnA gene with 500 bp flanks, as already described in Example 6.

TABLE 18

Overview of SEQ ID NO: of primers used for amplification of donor DNA and the resulted fwnA donor DNA

| Flank length | Forward primer | Reverse primer | Donor DNA |
|---|---|---|---|
| 500 bp | SEQ ID NO: 120 | SEQ ID NO: 121 | SEQ ID NO: 119 |
| ~350 bp | SEQ ID NO: 153 | SEQ ID NO: 154 | SEQ ID NO: 161 |
| ~250 bp | SEQ ID NO: 155 | SEQ ID NO: 156 | SEQ ID NO: 162 |
| ~130 bp | SEQ ID NO: 157 | SEQ ID NO: 158 | SEQ ID NO: 163 |
| ~55 bp | SEQ ID NO: 159 | SEQ ID NO: 160 | SEQ ID NO: 164 |

Plasmid Isolation Cas9 AMA-Plasmids with/without Guide RNA

The BG-AMA5 (SEQ ID NO:126 described in Example 8) and BG-AMA6 (SEQ ID NO:128 described in Example 9) were isolated from the *E. coli* culture with Nucleobond Xtra midi kit of Macherey Nagel according to manufacturer's instructions. DNA concentrations were measured using the NanoDrop (ND-1000 Spectrophotometer, Thermo Scientific).

Transformation

Table 19 shows an overview of the used AMA-plasmids in the transformation. These vectors contain a CRISPR/CAS9 cassette and optionally a guide RNA cassette. Table 20 shows the specific amounts of donor DNA transformed to the strain GBA 301 and GBA 302 in each separate transformation.

Protoplast transformation was performed as described in Example 4.

TABLE 19

Overview of used AMA-plasmids

| AMA-plasmid | Description |
|---|---|
| BG-AMA5 | Pc.FP017.pro-Cas9-Pc.FT029.ter/no guide RNA cassette |

TABLE 19-continued

Overview of used AMA-plasmids

| AMA-plasmid | Description |
|---|---|
| BG-AMA6 | Pc.FP017.pro-Cas9-Pc.FT029.ter/An.TEF.pro-gRSR fwnA-Pc.Pc20g04380 |

TABLE 20

Overview of performed transformations.

| Transformation | Strain | AMA-plasmid | Donor DNA (PCR fragment) |
|---|---|---|---|
| 1 | GBA 301 | 1.5 µg BG-AMA5 | 0 µg |
| 2 | GBA 301 | | 4 µg 500 bp flanks |
| 3 | GBA 301 | | 2.8 µg 350 bp flanks |
| 4 | GBA 301 | | 2 µg 250 bp flanks |
| 5 | GBA 301 | | 1 µg 130 bp flanks |
| 6 | GBA 301 | | 0.44 µg 55 bp flanks |
| 7 | GBA 301 | 1.5 µg BG-AMA6 | 0 µg |
| 8 | GBA 301 | | 4 µg 500 bp flanks |
| 9 | GBA 301 | | 2.8 µg 350 bp flanks |
| 10 | GBA 301 | | 2 µg 250 bp flanks |
| 11 | GBA 301 | | 1 µg 130 bp flanks |
| 12 | GBA 301 | | 0.44 µg 55 bp flanks |
| 13 | GBA 302 | 1.5 µg BG-AMA5 | 0 µg |
| 14 | GBA 302 | | 4 µg 500 bp flanks |
| 15 | GBA 302 | | 2.8 µg 350 bp flanks |
| 16 | GBA 302 | | 2 µg 250 bp flanks |
| 17 | GBA 302 | | 1 µg 130 bp flanks |
| 18 | GBA 302 | | 0.44 µg 55 bp flanks |
| 19 | GBA 302 | 1.5 µg BG-AMA6 | 0 µg |
| 20 | GBA 302 | | 4 µg 500 bp flanks |
| 21 | GBA 302 | | 2.8 µg 350 bp flanks |
| 22 | GBA 302 | | 2 µg 250 bp flanks |
| 23 | GBA 302 | | 1 µg 130 bp flanks |
| 24 | GBA 302 | | 0.44 µg 55 bp flanks |

After transformation the protoplasts were plated on regeneration media plates containing 50 µg/ml Phleomycin and incubated at 30° C. for 4-6 days. Subsequently phenotypes (spore color) was determined and scored directly from the transformation plates.

Results of the spore color phenotype assessment after transformation can be found in table 21.

TABLE 21

Results of the transformations indicated as the no. of colonies with fwnA phenotype versus the total number of transformants and additionally the percentage of fwnA phenotype transformants versus the total no. of transformants.

| Transformation | Strain | AMA-plasmid | Donor DNA | No. of fwnA phenotype/total no. transformants | % of fwnA phenotype vs. total no. transformants |
|---|---|---|---|---|---|
| 1 | GBA 301 | 1.5 µg BG-AMA5 | 0 µg | 0/107 | 0 |
| 2 | GBA 301 | | 4 µg 500 bp flanks | 1/123 | 0.8 |
| 3 | GBA 301 | | 2.8 µg 350 bp flanks | 0/32 | 0 |
| 4 | GBA 301 | | 2 µg 250 bp flanks | 0/90 | 0 |
| 5 | GBA 301 | | 1 µg 130 bp flanks | 0/127 | 0 |
| 6 | GBA 301 | | 0.44 µg 55 bp flanks | 0/122 | 0 |
| 7 | GBA 301 | 1.5 µg BG-AMA6 | 0 µg | 21/76 | 27.6 |
| 8 | GBA 301 | | 4 µg 500 bp flanks | 74/247 | 30.0 |
| 9 | GBA 301 | | 2.8 µg 350 bp flanks | 17/35 | 48.6 |
| 10 | GBA 301 | | 2 µg 250 bp flanks | 23/66 | 34.8 |
| 11 | GBA 301 | | 1 µg 130 bp flanks | 20/67 | 29.9 |
| 12 | GBA 301 | | 0.44 µg 55 bp flanks | 11/30 | 36.7 |

TABLE 21-continued

Results of the transformations indicated as the no. of colonies with fwnA phenotype versus the total number of transformants and additionally the percentage of fwnA phenotype transformants versus the total no. of transformants.

| Transformation | Strain | AMA-plasmid | Donor DNA | No. of fwnA phenotype/total no. transformants | % of fwnA phenotype vs. total no. transformants |
|---|---|---|---|---|---|
| 13 | GBA 302 | 1.5 µg BG-AMA5 | 0 µg | 0/65 | 0 |
| 14 | GBA 302 | | 4 µg 500 bp flanks | 0/124 | 0 |
| 15 | GBA 302 | | 2.8 µg 350 bp flanks | 0/176 | 0 |
| 16 | GBA 302 | | 2 µg 250 bp flanks | 0/126 | 0 |
| 17 | GBA 302 | | 1 µg 130 bp flanks | 0/88 | 0 |
| 18 | GBA 302 | | 0.44 µg 55 bp flanks | 0/54 | 0 |
| 19 | GBA 302 | 1.5 µg BG-AMA6 | 0 µg | 0/15 | 0 |
| 20 | GBA 302 | | 4 µg 500 bp flanks | 4/13 | 30.8 |
| 21 | GBA 302 | | 2.8 µg 350 bp flanks | 8/25 | 32 |
| 22 | GBA 302 | | 2 µg 250 bp flanks | 12/51 | 23.5 |
| 23 | GBA 302 | | 1 µg 130 bp flanks | 12/36 | 33.3 |
| 24 | GBA 302 | | 0.44 µg 55 bp flanks | 3/16 | 18.8 |

The transformants from all transformation plates were counted and scored for the fawn spore phenotype characteristic as very illustrative for the fwnA mutation.

One transformant, showing the fwnA phenotype, was obtained (transformation 2) in the absence of guide RNA and in the presence donor DNA with 500 bp flanks.

In transformation 7 (GBA 301 with Cas9, guide RNA and without donor DNA) 27.6% of the transformants had a fwnA phenotype. In transformation 19 (GBA 302 with Cas9, guide RNA and without donor DNA) no transformants were obtained with the fwnA phenotype.

This shows that in a NHEJ wild-type background (KU70/KU80 wt) CAS9 and the fwnA-specific guide RNA are sufficient to have targeted modification of the fwnA gene in sufficient quantities.

When comparing transformations 8-12 (GBA 301 with Cas9, guide RNA and donor DNA with different flank lengths) results show that in almost all transformations an equal effect was obtained in the percentage of fwnA phenotype transformants (30-37%). Only when donor DNA with 350 bp flank length was used the percentage of transformants with a fwnA phenotype was slightly higher (49%). This shows that using CAS9 and guide RNA of the invention, targeted modification can be done with long (500 bp) but also very short (55 bp) donor DNA. Especially the use of short (50-100 bp) flanks, or without the use of donor DNA for targeting and targeted modification in a strain with a NHEJ wild-type background is a real benefit compared to state of the art targeted modification techniques where long flanks, such as 1 kb of a single PCR fragment were needed for successful targeted integration and modification.

When comparing transformations 20-24 (GBA 302 with Cas9, guide RNA and donor DNA with different flank lengths) results show that in transformation almost all transformations an equal effect was obtained in the percentage of fwnA phenotype transformants. Perhaps when donor DNA with 55 bp flank length was used the percentage of transformants with a fwnA phenotype was slightly lower. This shows that using CAS9 and guide RNA of the invention in a strain with reduced NHEJ (KU mutation), targeted modification can be done with long (500 bp) but also very short (55 bp) donor DNA. Especially the use of short (50-100 bp) flanks for targeting and targeted modification is a real benefit compared to state of the art targeted modification techniques (see example 7 of WO2005/095624), where 1 kb of a single PCR fragment was needed for successful targeted integration and shorter flanks were rather unsuccessful). In addition, if compared to other advantageous targeted modification techniques, such as detailed in WO2013135728, WO2013/135729 and WO2013/135732, the method of the invention represents a good improvement for targeted modification(s) in filamentous fungi. This example also demonstrates that irrespective of the host strain modifications in NHEJ system (Wild-type of NHEJ impaired by mutation), the CAS9 and guide RNA of the invention together with long and/or short donor DNA provide a robust and extremely useful method for strain modification.

Colony PCR SDS/LiAC to Produce DNA Fragment for Sequencing

Spores of transformations 1-24 were plated on a PDA plate (Difco) and incubated for 2-3 days at 30° C. in an incubator. Colony PCR SDS/LiAC to produce DNA fragment for sequencing (confirming the genomic mutation in fwnA) were done according to description in example 12.

Confirming the Genomic Mutation in fwnA by Sequencing

All handlings were done according to description in example 13. For each transformation, a maximum of 10 transformants showing a fwnA phenotype were sequenced. The percentage of transformants that contain the designed 5 bp deletion compared to the total number of transformants and the percentage of designed 5 bp deletion compared to the total number fwnA phenotype transformants can be found in table 22.

TABLE 22

Results of the sequencing indicated as the percentage of transformants that contain the designed 5 bp deletion compared to total no. fwnA phenotype transformants and the percentage of designed 5 bp deletion compared to the total no. of transformants.

| | | 1 | 2 | 3 | 4 |
|---|---|---|---|---|---|
| | | GBA 301 | | GBA 302 | |
| | AMA-plasmid | Donor DNA | % of designed 5 bp deletion of total no. fwnA phenotype transformants | % of designed 5 bp deletion of total no. transformants | % of designed 5 bp deletion of total no. fwnA phenotype transformants | % of designed 5 bp deletion of total no. transformants |
| A | 1.5 µg BG-AMA6 | 4 µg 500 bp flanks | 88.9 | 26.7 | 100 | 30.8 |
| B | 1.5 µg BG-AMA6 | 2.8 µg 350 bp flanks | 66.7 | 32.4 | 100 | 32 |
| C | 1.5 µg BG-AMA6 | 2 µg 250 bp flanks | 88.9 | 30.9 | 100 | 23.5 |
| D | 1.5 µg BG-AMA6 | 1 µg 130 bp flanks | 85.7 | 25.6 | 88.9 | 29.6 |
| E | 1-5 µg BG-AMA6 | 0.44 µg 55 bp flanks | 28.6 | 10.5 | 100 | 18.8 |

Results of strain GBA 301 shows that by using donor DNA with ~55 bp flanks (row E, column 1 and 2) the percentage of obtained designed 5 bp deletion was significant lower compared to the other transformations (row A-D, column 1 and 2). This shows that in strain with a NHEJ wild-type background, the CAS9 and guide RNA of the invention be used together with small and (55 bp) and longer (500 bp) flanks of the donor DNA. Short flanks of 55 bp a can be used but efficiencies of targeted & desired modification decrease compared to longer flanks of the donor DNA When using strain GBA 302 (column 3) almost all obtained fwnA phenotype transformants contained the designed 5 bp deletion. The lowest percentage (around 19%) of the designed 5 bp deletion was obtained when using ~55 bp flanks (row E, column 4) and the highest percentage (around 32%) of the designed 5 bp deletion was obtained when using ~350 bp flanks (row E, column 4). This shows that in strain with an impaired NHEJ background, the CAS9 and guide RNA of the invention be used together with small (55 bp) and longer (500 bp) flanks of the donor DNA. Both short and longer flanks (55 bp-500 bp) can be used efficiently for targeted modifications in this background. The desired/exact modification % even increases among the mutants with a phenotype making this a very efficient method for exact and correct targeted modification of DNA's.

Especially the use of small flanks of the donor DNA is a real improvement in strain modification, avoiding the labor- and cost-intensive construction of large flanks for efficient targeted modification of DNA or host strains.

Example 22: Testing the CRISPR-Cas System in Combination with Self-Processing Ribozymes in *Penicillium chrysogenum*

This example describes the functionality of CRISPR/CAS9 in *P. chrysogenum* using Cas9 in combination with a self-processing ribozyme fragment (gRSR fragment) that targets the acetamide gene (amdS).

The function of the acetamidase expression cassette is to express an enzyme, acetamidase, that converts acetamide into ammonia and acetate. The host strains have a very poor capacity for this conversion. The genetically modified strains (transformants) containing the acetamidase expression cassette have an increased capacity for this conversion. The acetamidase expression cassette is used as a transformant selection marker.

*Penicillium chrysogenum* strains that have lost or have a mutation in the amdS gene do not grow in the presence of acetamide *Penicillium chrysogenum* transformation with amdS is described in WO1998/46772.

In the example described, *P. chrysogenum* DS17690 is used which is a derivative of the *P. chrysogenum* Wis 54-1255 wild-type strain (Wisconsin 54-1255 is also known as ATCC 28089).

Obtaining *P. chrysogenum* Strain with Randomly Integrated amdS Cassette

An amdS expression cassette with around 2 Kb flanks targeting HEL-Y (SEQ ID NO: 165) was synthesized at DNA2.0 (Menlo Park, Calif., USA) and delivered in a standard backbone vector. PCR amplification of the amdS cassette was done with Phusion polymerase (New England Biolabs) using the forward primer as set out in SEQ ID NO: 166 and the reverse primer as set out in SEQ ID NO: 167 according to standard PCR protocols. The PCR fragments were purified using the PCR purification kit from Macherey Nagel according to manufacturer's instructions. DNA concentrations were measured using the NanoDrop (ND-1000 Spectrophotometer, Thermo Scientific).

0.25 µg PCR amplified amdS cassette was transformed to strain DS17690 via the protoplast transformation. Preparation of *P. chrysogenum* protoplasts and their transformation were performed in accordance with established protocols (Cantoral et al., 1987 Bio/Technol. 5, 494-497). After transformation the protoplasts were plated on regeneration media plates containing 0.1% acetamide (Sigma) and incubated at 25° C. for 4-6 days. After the first incubation colonies were transferred from the regeneration plate to a glucose-limited defined acetamide medium were sporulation can take place containing the following reagents in g/l: glucose, 5.0; lactose, 36; Na$_2$SO$_4$, 2.9; K$_2$HPO$_4$, 4.8; KH$_2$PO$_4$, 5.2; Acetamide, 1.0 (Sigma); Agar no. 1, 17.5 (Oxoid); supplemented with 10 ml of a trace element solution containing (in g/i): FeSO$_4$.7H$_2$O, 24.84; MgSO$_4$.7H$_2$O, 0.0125; EDTA, 31.25; C$_6$H$_6$Na$_2$O$_7$, 43.75; ZnSO$_4$.7H$_2$O, 2.5; CaCl$_2$.2H$_2$O, 1.6; MgSO$_4$—H$_2$O, 3.04; H$_3$BO$_3$, 0.0125; CuSO$_4$.5H$_2$O, 0.625; Na$_2$MoO.2H$_2$O, 0.0125; CoSO$_4$.7H$_2$O, 0.625. All chemicals were from Merck unless otherwise indicated. Solution was adjusted to pH 6.5. Plates were incubated 2-3 days at 30° C. in an incubator.

Strains were checked using standard PCR protocols for correct integration of the amdS cassette (data not shown).

The obtained transformant DS17690+amdS was used to check the CRISPR/CAS9 system in this example.

Construction of BG-AMA16

The promoter An.TEF (SEQ ID NO: 127) and terminator Pc.Pc20g04380 (SEQ ID NO: 113) fragments were synthesized at DNA2.0 (Menlo Park, Calif., USA) and delivered in two separate standard cloning vectors. The self-processing ribozyme fragment containing the genomic target (SEQ ID NO: 168) was synthesized at IDT (gBlocks® Gene Fragments, Integrated DNA Technologies, Inc) and delivered as a gBlock double stranded DNA fragment. This gBlock fragment was cloned into a TOPO Zero Blunt vector using the Zero Blunt TOPO PCR Cloning Kit of Invitrogen.

The three separate DNA vectors were used to obtain the promoter-, the self-processing ribozyme- and the terminator fragment, which subsequently were cloned using a Golden Gate reaction (according to example 1 in patent application WO2013/144257) into the receiving backbone vector BG-AMA5 (SEQ ID NO: 126 described in Example 8). This resulted in the vector named BG-AMA16 (SEQ ID NO: 169). A plasmid map of BG-AMA16 is depicted in FIG. 24. The BG-AMA16 vector was checked by *E. coli* colony PCR to check the size of the cloned gRSR fwnA cassette. The PCR was performed using Phusion polymerase (New England Biolabs) according to standard PCR protocols using forward primer as set out in SEQ ID NO: 117 and reverse primer as set out in SEQ ID NO: 118.

Plasmid Isolation Cas9 AMA-Plasmids with or without Guide RNA

Plasmid BG-AMA5 (SEQ ID NO:126 described in Example 8) and plasmid BG-AMA16 (SEQ ID NO: 169) were isolated from the *E. coli* culture with Nucleobond Xtra midi kit of Macherey Nagel according to manufacturer's instructions. DNA concentrations were measured using the NanoDrop (ND-1000 Spectrophotometer, Thermo Scientific).

Transformation

Table 23 shows an overview of the used AMA-plasmids in the transformation.

Table 24 shows the specific amounts of DNA transformed to the strain DS17690 in each separate transformation.

Protoplast transformation was performed as described in Cantoral et al., 1987 Bio/Technol. 5, 494-497.

TABLE 23

Overview of used AMA-plasmids

| AMA-plasmid | Description |
|---|---|
| BG-AMA5 | Pc.FP017.pro-Cas9-Pc.FT029.ter/no guide RNA cassette |

TABLE 23-continued

Overview of used AMA-plasmids

| AMA-plasmid | Description |
|---|---|
| BG-AMA16 | Pc.FP017.pro-Cas9-Pc.FT029.ter/An.TEF.pro-gRSR amdS-Pc.Pc20g04380 |

TABLE 24

Overview of performed transformations.

| Transformation | Strain | AMA plasmid |
|---|---|---|
| 1 | DS17690 + amdS | 1.5 µg BG-AMA5 |
| 2 | DS17690 + amdS | 1.5 µg BG-AMA16 |

After transformation the protoplasts were plated on regeneration media plates containing 50 µg/ml Phleomycin (InvivoGen) and incubated at 25° C. for 4-6 days. After the first incubation colonies were transferred from the regeneration plate to glucose-limited defined phleomycin medium were sporulation can take place containing the following reagents in g/l: glucose, 5.0; lactose, 36; urea 4,5; Na$_2$SO$_4$, 2.9; (NH$_4$)$_2$SO$_4$, 1.1; K$_2$HPO$_4$, 4.8; KH$_2$PO$_4$, 5.2; Agar no. 1 (Oxoid), 17.5; Phleomycin (InvivoGen), 0.1; supplemented with 10 ml of a trace element solution containing (in g/l): FeSO$_4$.7H$_2$O, 24.84; MgSO$_4$.7H$_2$O, 0.0125; EDTA, 31.25; C$_6$H$_6$Na$_2$O$_7$, 43.75; ZnSO$_4$.7H$_2$O, 2.5; CaCl$_2$.2H$_2$O, 1.6; MgSO$_4$—H$_2$O, 3.04; H$_3$BO$_3$, 0.0125; CuSO$_4$.5H$_2$O, 0.625; Na$_2$MoO.2H$_2$O, 0.0125; CoSO$_4$.7H$_2$O, 0.625. All chemicals were from Merck or indicated different. Solution was adjusted to pH 6.5. Plates were incubated at 25° C. for 2-3 days.

Results of the transformation can be found in table 25.

TABLE 25

Results of the transformations indicated as the no. transformants on the transformation plates.

| Transformation | Strain | AMA plasmid | No. of transformants |
|---|---|---|---|
| 1 | DS17690 + amdS | 1.5 µg BG-AMA5 | >1000 |
| 2 | DS17690 + amdS | 1.5 µg BG-AMA16 | >1000 |

After the first incubation single colonies were transferred from the regeneration plate to glucose-limited defined phleomycin medium were sporulation can take place containing the following reagents in g/l: glucose, 5.0; lactose, 36; urea 4,5; Na$_2$SO$_4$, 2.9; (NH$_4$)$_2$SO$_4$, 1.1; K$_2$HPO$_4$, 4.8; KH$_2$PO$_4$, 5.2; Agar no. 1 (Oxoid), 17.5; Phleomycin (InvivoGen), 0.1; supplemented with 10 ml of a trace element solution containing (in g/i): FeSO$_4$.7H$_2$O, 24.84; MgSO$_4$.7H$_2$O, 0.0125; EDTA, 31.25; C$_6$H$_6$Na$_2$O$_7$, 43.75; ZnSO$_4$.7H$_2$O, 2.5; CaCl$_2$.2H$_2$O, 1.6; MgSO$_4$—H$_2$O, 3.04; H$_3$BO$_3$, 0.0125; CuSO$_4$.5H$_2$O, 0.625; Na$_2$MoO.2H$_2$O, 0.0125; CoSO$_4$.7H$_2$O, 0.625. All chemicals were from Merck or indicated different. Solution was adjusted to pH 6.5. Plates were incubated at 25° C. for 2-3 days.

The use AMA-plasmids with or without the presence of guide RNA had an equal effect in the amount of transformants. The high number of obtained transformants indicated that the uptake of the AMA-plasmid was very efficient.

Replica Plating to Check the Functionality of amdS Gene

Spores of single colonies were plated on glucose-limited defined phleomycin medium and glucose-limited defined acetamide medium and incubated for 4-6 days at 25° C. in an incubator.

Figure 25:
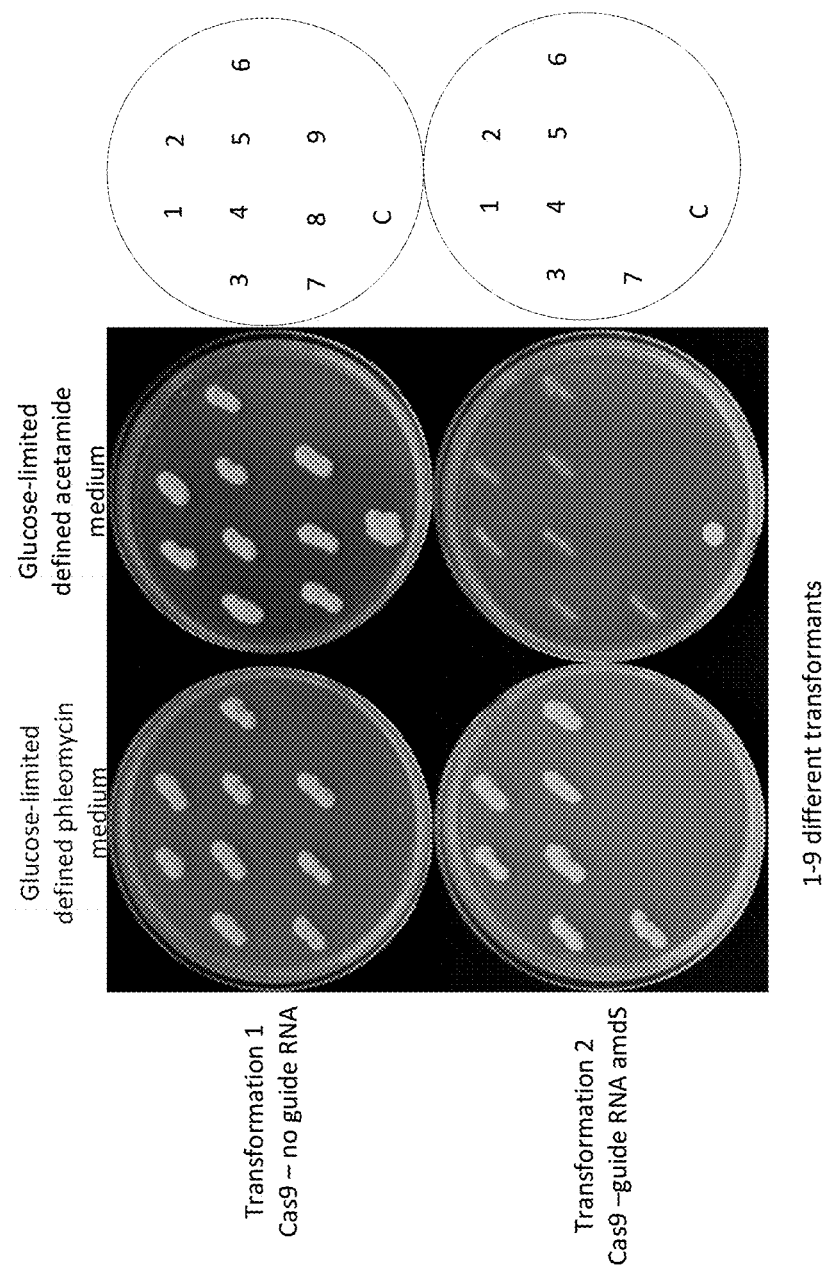
FIG. 25 depicts replica plating of transformants on different media.

Picture of the replica plates can be found in FIG. 25. The number of transformants able to grow on glucose-limited defined phleomycin medium and glucose-limited defined acetamide medium and the percentage of transformants not able to grow on glucose-limited defined acetamide medium.

TABLE 26

Results of the replica plating indicated as the number of transformants able to grow in the presence of phleomycin or acetamide and the percentage of transformants not able to grow in the presence of acetamide.

| Transformation | Strain | AMA plasmid | No. of transformants which grow on glucose limited defined phleomycin medium | No. of transformants which grow on glucose limited defined acetamide medium | % of transformants which no not grow on glucose limited defined acetamide medium |
|---|---|---|---|---|---|
| 1 | DS17690 + amdS | 1.5 µg BG-AMA5 - no guide RNA | 9 | 9 | 0 |
| 2 | DS17690 + amdS | 1.5 µg BG-AMA16 - guide RNA amdS | 7 | 0 | 100 |

The picture in FIG. 25 showed that the parent strain of the transformation was unable to grow on plates containing phleomycin and could grow in the presence of acetamide.

All transformants used for replica plating from transformation 1 (no guide RNA) were able to grow in the presence of phleomycin and acetamide. This indicated that the AMA-plasmid was taken up and that the amdS-gene was still functional.

All transformants used for replica plating from transformation 2 (guide RNA amdS) were able to grow in the presence of phleomycin, but not in the presence of acetamide. This indicated that the AMA-plasmid was taken up and that amdS-gene wasn't present anymore or was mutated. This also indicated that the CRISPR/CAS9 system combined with self-processing ribozymes was functional in targeting the amdS-gene.

Rasamsonia (Talaromyces) emersonii Examples

The following two examples describes the functionality of CRISPR/CAS9 in R. emersonii using CAS9 in combination with a guide RNA self-processing ribozyme fragment (gRSR fragment) that targets amdS when using a donor DNA PCR-fragment. The amdS sequence of R. emersonii is NCBI Genbank (NCBI Reference Sequence XM_013475101.1, website:
www.ncbi.nlm.nih.gov/nucleotide/
915165068?report=genbank&log$=nuclalign&blast_
rank=1&RID=8MX12BM7015). Donor DNA was used to introduce a stop codon mutation into the amdS or a deletion of the amdS gene which is involved in acetamide degradation. Strains with the mutation are able to grow on fluoro-acetamide as described in EP06035574.

Rasamsonia (Talaromyces) emersonii strain was deposited at CENTRAAL BUREAU VOOR SCHIMMELCULTURES, Uppsalalaan 8, P.O. Box 85167, NL-3508 AD Utrecht, The Netherlands in December 1964, having the Accession Number CBS 393.64. Other suitable strains can be equally used in the present examples to show the effect and advantages of the invention. For example Rasamsonia (Talaromyces) emersonii strain TEC-101 (also designated as FBG 101, which was deposited at CENTRAAL BUREAU VOOR SCHIMMELCULTURES, Uppsalalaan 8, P.O. Box 85167, NL-3508 AD Utrecht, The Netherlands on 30 Jun. 2010 having the Accession Number CBS 127450) or TEC-210 are suitable Rasamsonia strains which are described in WO2011/000949.

Example 23: Functionality of the CRISPR-Cas System in Rasamsonia emersonii

Donor DNA

Figure 26:
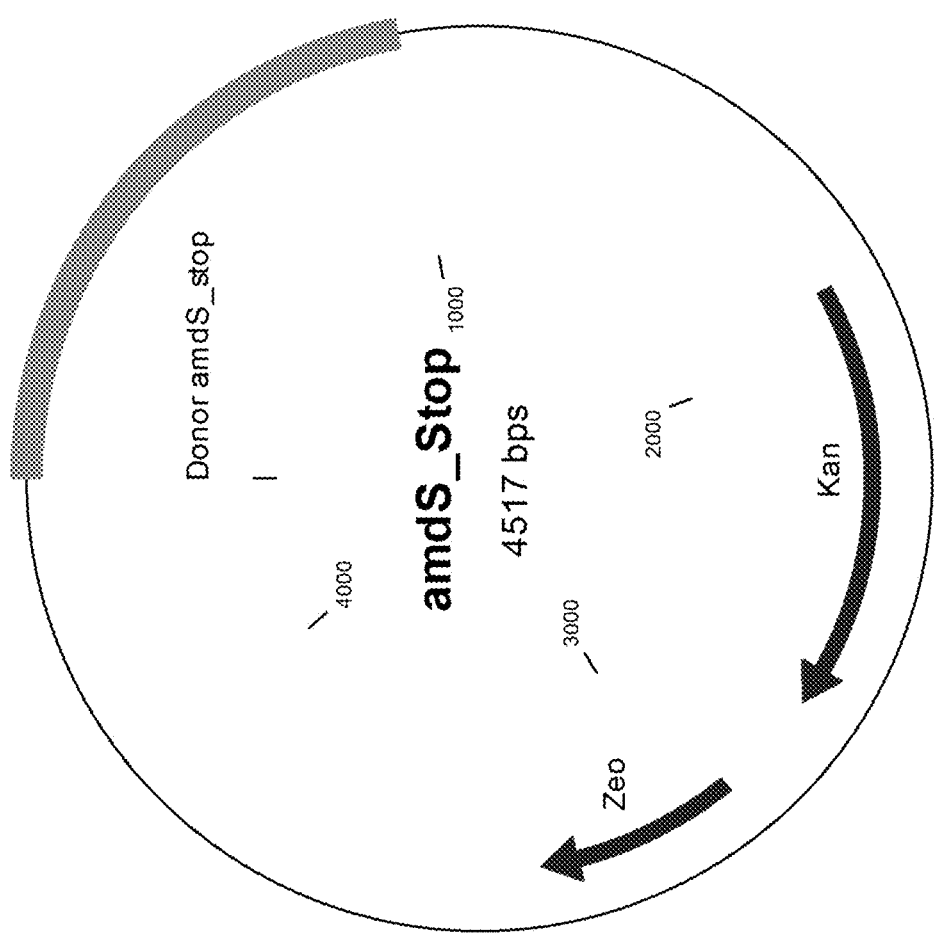
FIG. 26 depicts a map of vector "TOPO donor DNA amdS_stop" that can be used to introduce a stop codon into the amdS gene in R. emersonii.
Figure 27:
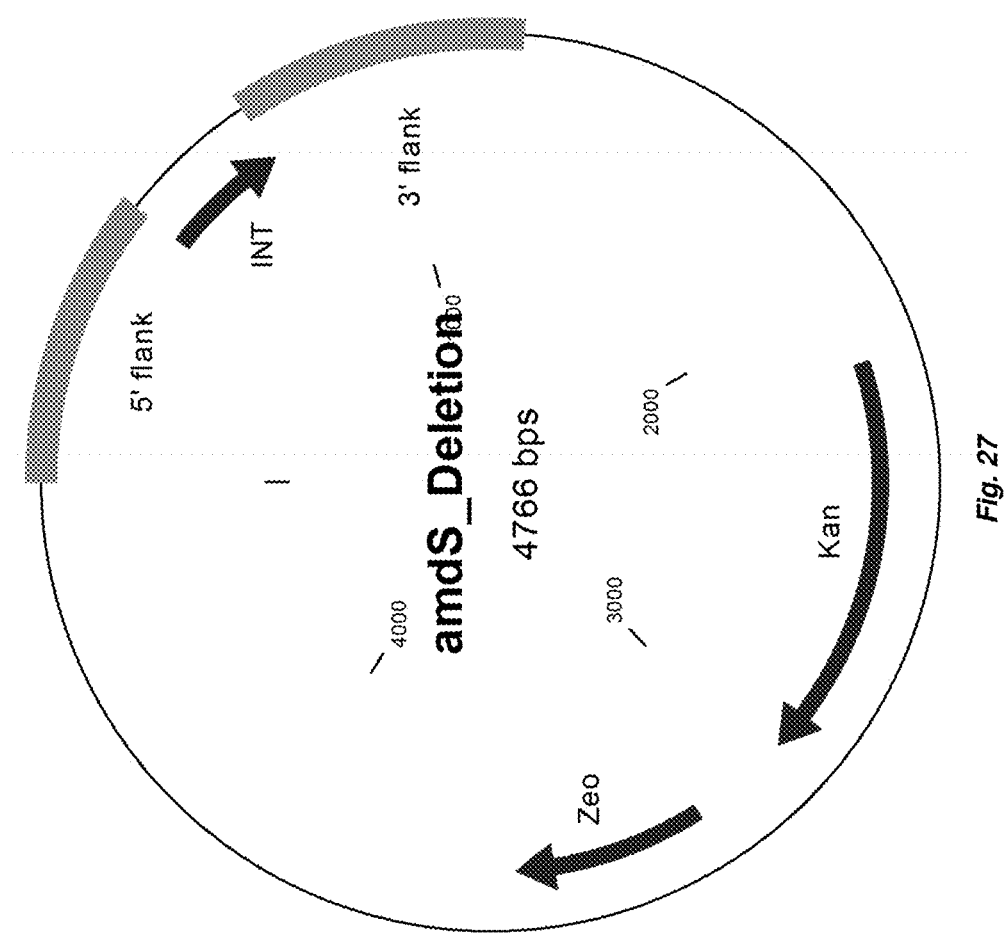
FIG. 27 depicts a map of vector "TOPO donor DNA amdS_deletion" that can be used to delete the amdSgene in R. emersonii. 500 bp flanks genomic DNA sequences positioned immediately 5' of the start codon and immediately 3' of the stop codon of the amdS gene are included in the donor DNA together with 247 bp non-coding sequence (named INT).
Figure 28:
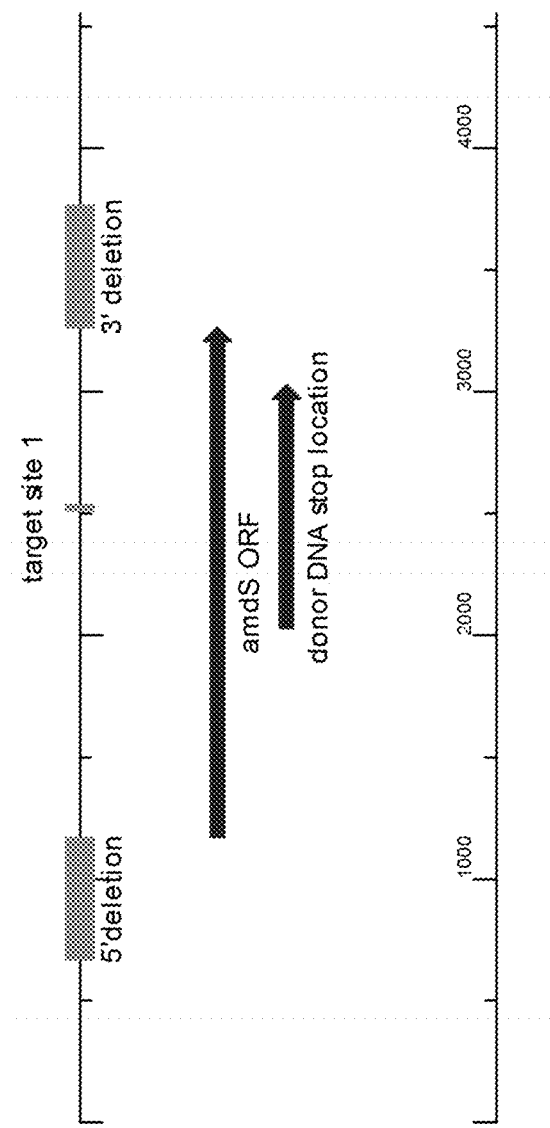
FIG. 28 depicts a representation of positions of the donor DNA sequences relative to the genomic sequence of the amdS gene. Target site 1 represents the genomic target of the guide RNA. Deletion depicts the position of the flanks present in the donor DNA of TOPO donor DNA amdS_deletion.

GBlock fragments were synthesized at IDT (gBlocks® Gene Fragments, Integrated DNA Technologies, Inc, Leuven, Belgium) that contained the donor DNA for the desired mutation, i.e. introduction of a TAA stop codon, (SEQ ID NO: 170) or deletion (SEQ ID NO: 171) of the amdS gene. This gBlock based DNA was cloned into a TOPO Zero Blunt vector using the Zero Blunt TOPO PCR Cloning Kit of Invitrogen. A plasmid map of the resulting vector called "TOPO donor DNA amdS_stop" (SEQ ID NO: 172) is depicted in FIG. 26 and "TOPO donor DNA amdS_deletion" (SEQ ID NO: 173) is depicted in FIG. 27. FIG. 28 depicts an alignment of the donor DNA's with the genomic sequence of the amdS gene.

Construction of BG-AMA13

The promoter Pc.TEF (SEQ ID NO: 174) and terminator Pc.Pc20g04380 (SEQ ID NO: 113) fragments were synthesized at DNA2.0 (Menlo Park, Calif., USA) and delivered in two separate standard cloning vectors. The self-processing ribozyme fragment (SEQ ID NO: 175) was synthesized at IDT (gBlocks® Gene Fragments, Integrated DNA Technologies, Inc, Leuven, Belgium) and delivered as a double stranded DNA fragment. This gBlock fragment was cloned into a TOPO Zero Blunt vector with the Zero Blunt TOPO PCR Cloning Kit of Invitrogen.

Figure 29:
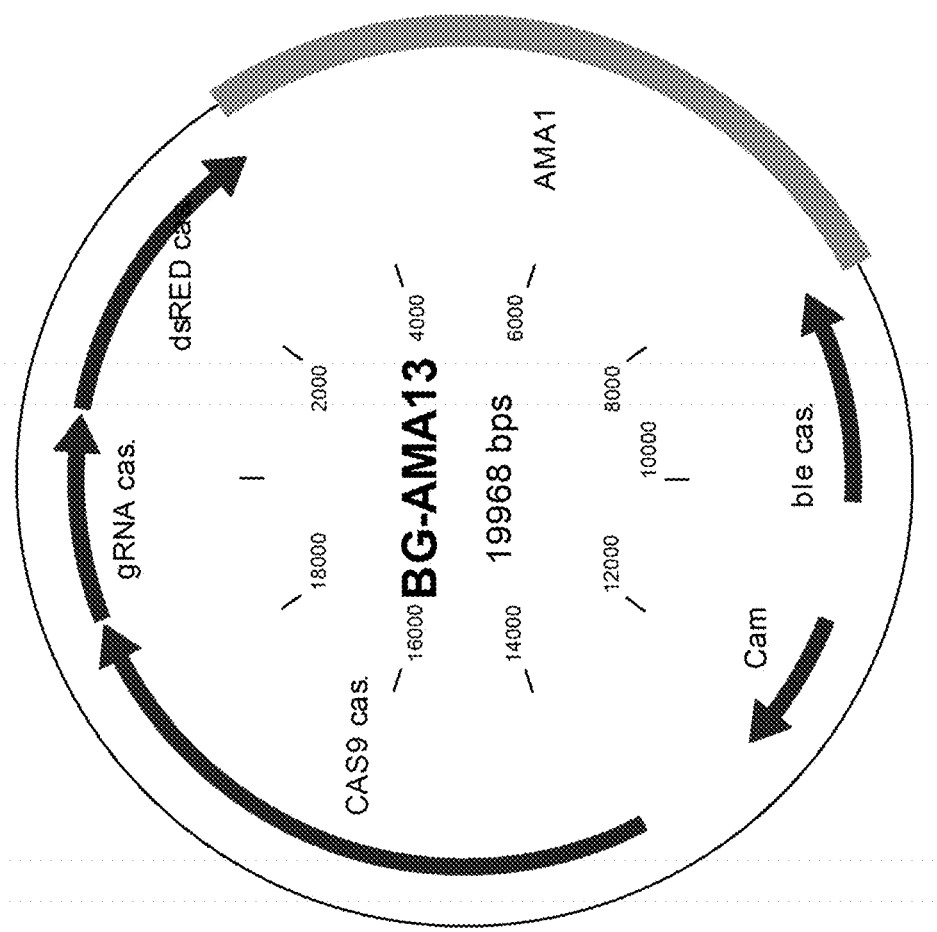
FIG. 29 depicts a map of vector BG-AMA13 that can be used to express CAS9 with the 20 Pc_FP017 promoter and guide RNA with the Pc_tef promoter.

The three separate DNA fragments were used to obtain the promoter-, the self-processing ribozyme- and the terminator fragment, which subsequently were cloned using a Golden Gate reaction (according to example 1 in patent application WO2013/144257) into the receiving backbone vector BG-AMA5 (SEQ ID NO: 126 described in Example 11). This resulted in the vector named BG-AMA13 (SEQ ID NO: 176). A plasmid map of BG-AMA13 is depicted in FIG. 29. The BG-AMA13 vector was checked by E. coli colony PCR to check the size of the cloned gRSR amdS cassette. The PCR was performed using Phusion polymerase (New England Biolabs) according to standard PCR protocols using forward primer as set out in SEQ ID NO: 117 and reverse primer as set out in SEQ ID NO: 118.

Assembly of the BG-C21 CAS9 Expression Cassette

The CAS9 expression cassette was constructed using the Golden Gate cloning method. Three fragments were synthesized at DNA2.0 (Menlo Park, Calif., USA) and delivered in a standard cloning vector. The first fragment is the promoter fragment Anid_TEF (SEQ ID NO: 130) that is functional in *Rasamsonia emersonii*. The second fragment is an open reading frame encoding the CAS9 protein (SEQ ID NO: 104). The third fragment is a terminator Pc_FT029 (SEQ ID NO: 105) that is functional in *R. emersonii*. The three separate DNA fragments were used to obtain the promoter, the CAS9 and the terminator fragment, which subsequently were cloned using a Golden Gate reaction into the receiving backbone vector 5a (SEQ ID NO: 106). The Gibson recombination was done with the Gibson Assembly kit of New England Biolabs according to manufacturer's instructions. This resulted in the vector named BG-C21 (SEQ ID NO: 177) which contains the functional expression cassette for CAS9. The BG-C21 vector was checked using restriction enzyme analysis.

Cloning of CAS9 Expression Cassette in BG-AMA1 Creating BG-AMA14

Gibson cloning (Gibson et al., 2009) was used to clone the CAS9 expression cassette from the BG-C21 vector into the BG-AMA1 plasmid as described in example 11. The CAS9 expression cassette was PCR amplified using forward primer as set out in SEQ ID NO: 178 and reverse primer as set out in SEQ ID NO: 109 both with 30 bp flanks (homology to BG-AMA1) and BG-C21 as a template. Vector BG-AMA1 was cut open with KpnI (New England Biolabs). All fragments, the PCR fragments and the cut-open vector, were purified and the DNA concentration was measured as described in example 11.

Figure 30:
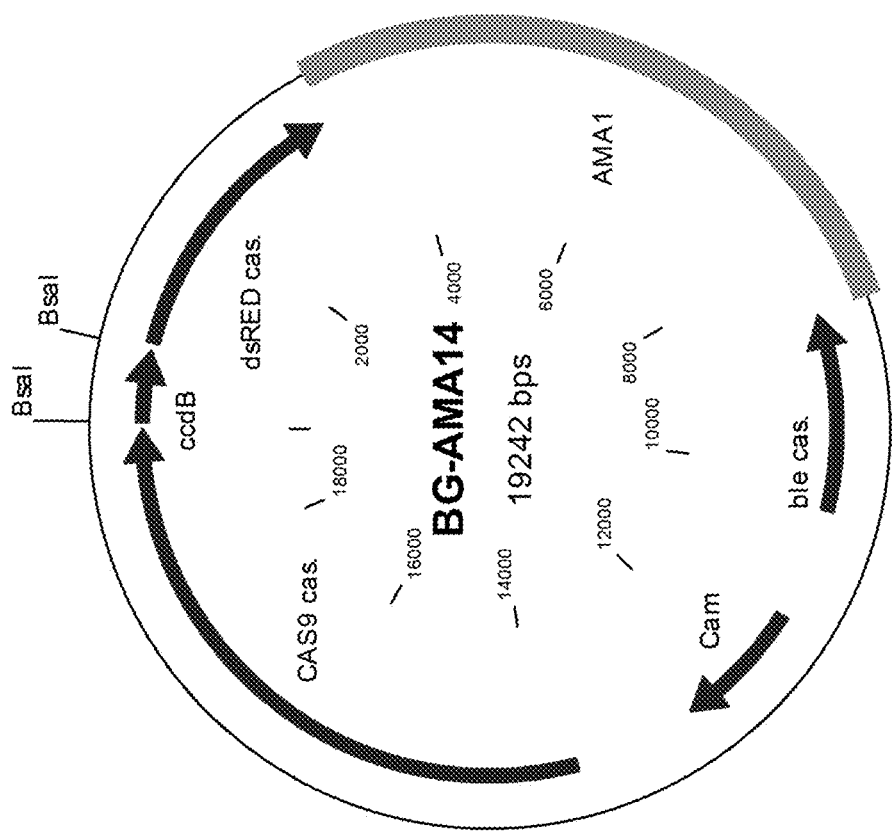
FIG. 30 depicts a map of vector BG-AMA14 with a CAS9 expression cassette under control of the Anid_tef promoter which can be used as backbone for a golden gate reaction to obtain a guide RNA cassette.

The Gibson recombination was done with the Gibson Assembly kit of New England Biolabs according to manufacturer's instructions. After transformation to *E. coli* several clones were checked with restriction enzyme analysis and a clone having the correct band pattern was named BG-AMA14 (SEQ ID NO: 179) which contained the functional expression cassette for CAS9. The plasmid map of BG-AMA14 can be found in FIG. 30. The BG-AMA14 vector was checked using restriction enzyme analysis.

Construction of BG-AMA15

The promoter Pc.TEF (SEQ ID NO: 174) and terminator Pc.Pc20g04380 (SEQ ID NO: 113) fragments were synthesized at DNA2.0 (Menlo Park, Calif., USA) and were delivered in two separate standard cloning vectors. The self-processing ribozyme fragment (SEQ ID NO: 175) was synthesized at IDT (gBlocks® Gene Fragments, Integrated DNA Technologies, Inc, Leuven, Belgium) and was delivered as a double stranded fragment. This gBlock fragment was cloned into a TOPO Zero Blunt vector using the Zero Blunt TOPO PCR Cloning Kit of Invitrogen.

Figure 31:
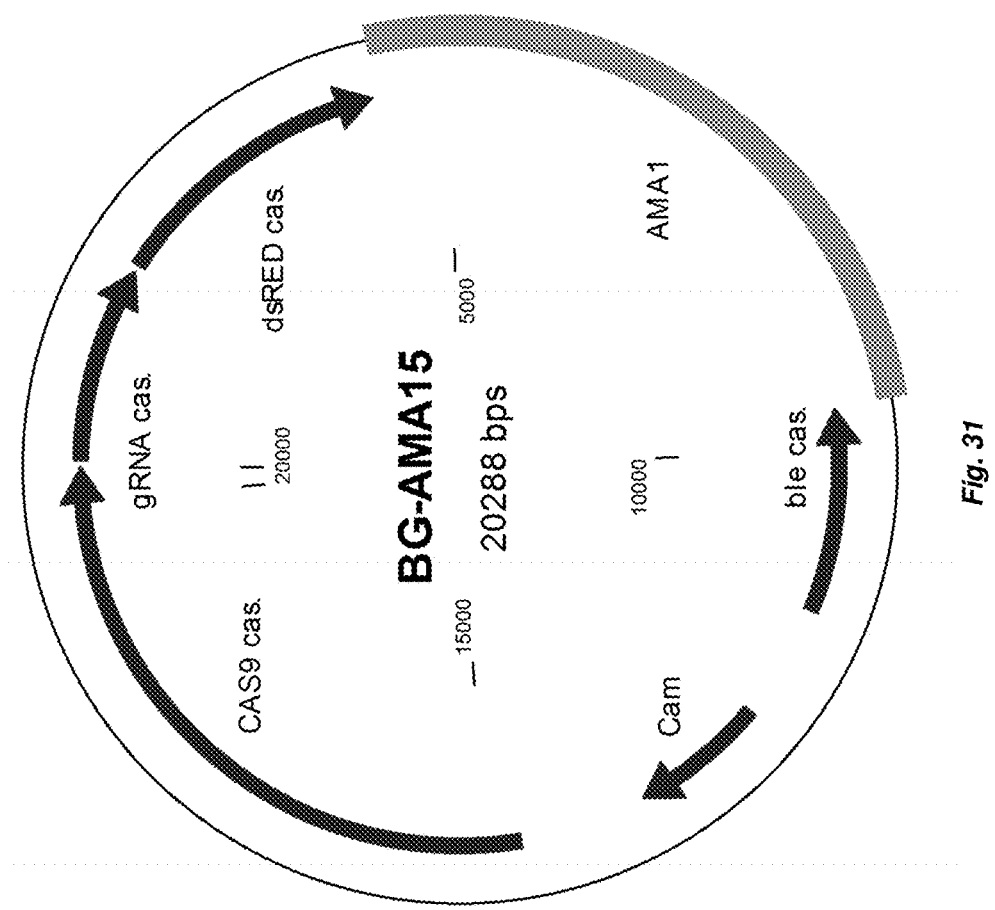
FIG. 31 depicts a map of vector BG-AMA15 that can be used to express CAS9 with the Anid_tef promoter and guide RNA with the Pc_tef promoter.

The three separate DNA fragments were used to obtain the promoter-, the self-processing ribozyme- and the terminator fragment, which subsequently were cloned using a Golden Gate reaction into the receiving backbone vector BG-AMA14 (SEQ ID NO: 179). The Gibson recombination was done with the Gibson Assembly kit of New England Biolabs according to manufacturer's instructions. This resulted in the vector named BG-AMA15 (SEQ ID NO: 180). A plasmid map of BG-AMA15 is depicted in FIG. 31. The BG-AMA15 vector was checked by *E. coli* colony PCR to check the size of the cloned gRSR amdS cassette. The PCR was performed using Phusion polymerase (New England Biolabs) according to standard PCR protocols using forward primer as set out in SEQ ID NO: 117 and reverse primer as set out in SEQ ID NO: 118.

Plasmid Isolation Cas9 AMA-Plasmids with or without gRNA

The BG-AMA5 (SEQ ID NO: 126 described in Example 11), BG-AMA13 (SEQ ID NO: 176), BG-AMA14 (SEQ ID NO: 179) and BG-AMA15 (SEQ ID NO: 180) vectors were isolated from the *E. coli* culture using the Nucleobond Xtra midi kit of Macherey Nagel according to manufacturer's instructions. DNA concentrations were measured using the NanoDrop (ND-1000 Spectrophotometer, Thermo Scientific).

Transformation to *R. emersonii*

Table 27 shows an overview of the used AMA-plasmids in the transformation.

Table 28 shows the specific amounts of DNA transformed to *R. emersonii* strain TEC-210 (WO2011/000949) in each separate transformation.

Protoplast transformation, use of markers and selective media can be found in WO2011/054899.

The following were media and solutions were specifically used in this example:

Potato dextrose agar, PDA (Fluka, Cat. No. 70139): per liter: Potato extract 4 g; Dextrose 20 g; Bacto agar 15 g; pH 5.4; Sterilize 20 min at 120° C.

*Rasamsonia* agar medium: per liter: Salt fraction no. 3 15 g; Cellulose 30 g; Bacto peptone 7.5 g; Grain flour 15 g; KH2PO4 5 g; CaCl2.2 aq 1 g; Bacto agar 20 g; pH 6.0; Sterilize 20 min at 120° C.

Salt fraction composition: The "salt fraction no. 3" was fitting the disclosure of WO98/37179, Table 1. Deviations from the composition of this table were CaCl2.2 aq 1.0 g/l, KCl 1.8 g/L, citric acid 1 aq 0.45 g/L (chelating agent).

TABLE 27

Overview of used AMA-plasmids in the transformations to *R. emersonii*.

| AMA-plasmid | Description |
|---|---|
| BG-AMA5 | Pc.FP017.pro-Cas9-Pc.FT029.ter/no guide RNA cassette |
| BG-AMA13 | Pc.FP017.pro-Cas9-Pc.FT029.ter/Pc.TEF.pro-gRSR amdS_v1-Pc.Pc20g04380 |
| BG-AMA14 | Anid_tef.pro-Cas9-Pc.FT029.ter/no guide RNA cassette |
| BG-AMA15 | Anid_tef.pro-Cas9-Pc.FT029.ter/Pc.TEF.pro-gRSR amdS_v1-Pc.Pc20g04380 |

TABLE 28

Overview of performed transformations. In all transformations *R. emersonii* strain TEC- 210 was used. Two different CAS9 expression cassettes were used: version 1: Pc.FP017.pro-Cas9-Pc.FT029.ter and version 2: Anid_tef.pro-Cas9-Pc.FT029.ter.

| Transformation | AMA plasmid | CAS9 cassette | Guide RNA present | Donor DNA |
|---|---|---|---|---|
| 1 | 4 µg BG-AMA5 | Version 1 | No | 0 µg |
| 2 | 4 µg BG-AMA5 | Version 1 | No | 4 µg TOPO_amdS_deletion-vector |
| 3 | 4 µg BG-AMA5 | Version 1 | No | 4 µg TOPO_amdS_stop-vector |

TABLE 28-continued

Overview of performed transformations. In all transformations
R. emersonii strain TEC- 210 was used. Two different CAS9
expression cassettes were used: version 1: Pc.FP017.pro-Cas9-
Pc.FT029.ter and version 2: Anid_tef.pro-Cas9-Pc.FT029.ter.

| Trans-<br>forma-<br>tion | AMA<br>plasmid | CAS9<br>cassette | Guide<br>RNA<br>present | Donor DNA |
|---|---|---|---|---|
| 4 | 4 µg BG-AMA13 | Version 1 | Yes | 0 µg |
| 5 | 4 µg BG-AMA13 | Version 1 | Yes | 4 µg TOPO_amdS_deletion-vector |
| 6 | 4 µg BG-AMA13 | Version 1 | Yes | 4 µg TOPO_amdS_stop-vector |
| 7 | 4 µg BG-AMA14 | Version 2 | No | 0 µg |
| 8 | 4 µg BG-AMA14 | Version 2 | No | 4 µg TOPO_amdS_deletion-vector |
| 9 | 4 µg BG-AMA14 | Version 2 | No | 4 µg TOPO_amdS_stop-vector |
| 10 | 4 µg BG-AMA15 | Version 2 | Yes | 0 µg |
| 11 | 4 µg BG-AMA15 | Version 2 | Yes | 4 µg TOPO_amdS_deletion-vector |
| 12 | 4 µg BG-AMA15 | Version 2 | Yes | 4 µg TOPO_amdS_stop-vector |

After transformation the protoplasts were plated on regeneration media plates containing 100 µg/ml Phleomycin and the plates were incubated at 42° C. for 6-7 days.

An overview of the transformation can be found in table 29. In all transformations, more than 250 individual transformants were found on the plates.

TABLE 29

Results of the transformations. In all transformations R. emersonii
strain TEC-210 was used. Two different CAS9 expression cassettes
were used: version 1: Pc.FP017.pro-Cas9- Pc.FT029.ter and version
2: Anid tef.pro-Cas9-Pc.FT029.ter.

| Trans-<br>forma-<br>tion | AMA<br>plasmid | CAS9<br>cassette | Guide<br>RNA<br>present | Donor DNA |
|---|---|---|---|---|
| 1 | 4 µg BG-AMA5 | Version 1 | No | 0 µg |
| 2 | 4 µg BG-AMA5 | Version 1 | No | 4 µg TOPO_amdS_deletion-vector |
| 3 | 4 µg BG-AMA5 | Version 1 | No | 4 µg TOPO_amdS_stop-vector |
| 4 | 4 µg BG-AMA13 | Version 1 | Yes | 0 µg |
| 5 | 4 µg BG-AMA13 | Version 1 | Yes | 4 µg TOPO_amdS_deletion-vector |
| 6 | 4 µg BG-AMA13 | Version 1 | Yes | 4 µg TOPO_amdS_stop-vector |
| 7 | 4 µg BG-AMA14 | Version 2 | No | 0 µg |
| 8 | 4 µg BG-AMA14 | Version 2 | No | 4 µg TOPO_amdS_deletion-vector |
| 9 | 4 µg BG-AMA14 | Version 2 | No | 4 µg TOPO_amdS_stop-vector |
| 10 | 4 µg BG-AMA15 | Version 2 | Yes | 0 µg |
| 11 | 4 µg BG-AMA15 | Version 2 | Yes | 4 µg TOPO_amdS_deletion-vector |
| 12 | 4 µg BG-AMA15 | Version 2 | Yes | 4 µg TOPO_amdS_stop-vector |

No clear effect was found in the amount of obtained transformants with or without the presence of donor DNA (plasmid based) or with or without the presence of gRNA.

Colony PCR to Obtain a DNA Fragment Used for Sequencing or to Check for amdS Locus Deletion Spores were plated on *Rasamsonia* agar medium and incubated for 6-7 days at 42° C. in an incubator. A piece of a colony was taken with an inoculation loop and put in 50 µl Glucanex™ solution (50 mg/ml Glucanex™ dissolved in KC buffer (60 g/l KCl, 2 g/l Citric acid, adjusted with KOH/HCl to pH 6.2)) in an Eppendorf tube. The mixture was incubated for 1 hour at 37° C. After this step, 300 µl DNA dilution buffer (0.58 g/l NaCl, 0.29 g/l EDTA, 1.58 g/l Tris/HCl pH 7.5) was added and the mix was boiled for 5 minutes in a water bath or PCR apparatus with heated lid. Subsequently, 5 µl template (without mixing) was pipetted from the top of the solution and was added in the PCR mix. The PCR was performed according to standard PCR protocols using Phusion DNA polymerase (New England Biolabs), using genomic DNA isolated from different transformants and a non-transformed strain as controls as template DNA, to obtain two different PCR fragments: PCR fragment 1 was obtained using forward primer as set out in SEQ ID NO: 181 and reverse primer as set out in SEQ ID NO: 182, and PCR fragment 1 was used to determine introduction of a stop codon at the amdS locus (donor_amds_Stop) by sequencing. PCR fragment 2 was obtained using forward primer as set out in SEQ ID NO: 183 and reverse primer as set out in SEQ ID NO: 184, and PCR fragment 2 was used to confirm deletion of the amdS locus by loading the samples on a 0.8% agarose gel. In addition, PCR fragment 2 was sequenced as described below. Prior to the sequencing reaction, PCR fragments 1 and 2 were purified with the PCR purification kit from Macherey Nagel according to manufacturer's instructions.

PCR for sequencing was done with BigDye Terminator v3.1 Cycle Sequencing kit of Applied Biosystems according to the manual using the forward primer as set out in SEQ ID NO: 185 and amdS sequence fragment (PCR fragment 1 or PCR fragment 2) as template. The sequencing PCR product was cleaned by ethanol/EDTA precipitation according to supplier manual. The amdS sequence PCR fragment was pelleted in 10 µl HiDi Formamide of Applied Biosystems and the suspension was used for sequence analysis with the 3500 Genetic Analyzer of Applied Biosystems (Sanger sequencer).

For each transformation, a maximum of 15 transformants were sequenced. The percentage of transformants that contained the designed TAA mutation or locus deletion of the total number of transformants that were checked are shown in table 30.

TABLE 30

Results of the sequencing. In all transformations R. emersonii strain TEC-210 was used. Two different CAS9 expression cassettes were used, version 1: Pc.FP017.pro-Cas9-Pc.FT029.ter and version 2: Anid_tef.pro-Cas9-Pc.FT029.ter.

| Transformation | AMAplasmid | CAS9 cassette | Guide RNA present | Donor DNA | % T insertion at −3/−4 position of PAM sequence |
|---|---|---|---|---|---|
| 1 | 4 µg BG-AMA5 | Version 1 | No | 0 µg | 0 |
| 2 | 4 µg BG-AMA5 | Version 1 | No | 4 µg TOPO_amdS_deletion-vector | 0 |
| 3 | 4 µg BG-AMA5 | Version 1 | No | 4 µg TOPO_amdS_stop-vector | 0 |
| 4 | 4 µg BG-AMA13 | Version 1 | Yes | 0 µg | 25 |
| 5 | 4 µg BG-AMA13 | Version 1 | Yes | 4 µg TOPO_amdS_deletion-vector | 0 |
| 6 | 4 µg BG-AMA13 | Version 1 | Yes | 4 µg TOPO_amdS_stop-vector | 15 |
| 7 | 4 µg BG-AMA14 | Version 2 | No | 0 µg | 0 |
| 8 | 4 µg BG-AMA14 | Version 2 | No | 4 µg TOPO_amdS_deletion-vector | 0 |
| 9 | 4 µg BG-AMA14 | Version 2 | No | 4 µg TOPO_amdS_stop-vector | 0 |
| 10 | 4 µg BG-AMA15 | Version 2 | Yes | 0 µg | 8 |
| 11 | 4 µg BG-AMA15 | Version 2 | Yes | 4 µg TOPO_amdS_deletion-vector | n.a. |
| 12 | 4 µg BG-AMA15 | Version 2 | Yes | 4 µg TOPO_amdS_stop-vector | 11 |

N.a. not data available, sequencing reactions were not performed.

No transformants with the designed TAA mutation (introduction of a stop codon in the amdS gene) or deletion of the amdS gene were found, indicating that no donor DNA was introduced into genomic DNA of R. emersonii strain TEC-210. However, the sequencing result showed that some transformants contained a thymine (T) nucleotide insertion between the third and fourth position upstream to the PAM sequence. Notably, the T insertion was only found in those transformants in which the guide RNA expression cassette was transformed (Table 30). Previous work has shown that CAS9 cleaves DNA and makes a double stranded break at a position three base pairs upstream of the PAM sequence (Jinek et al., 2012). It is known at the site of the double stranded break mutations might arise from imprecise non-homologous end joining (NHEJ)-mediated repair that can produce insertion and/or deletion mutations of variable length (Sander and Joung, 2014). From the observation that a T insertion at a position three base pairs upstream of the PAM sequence was found in some of the transformants to which a vector containing a CAS9 expression cassette and the guide RNA expression cassette was transformed, it can be concluded that CAS9 and the guide RNA can be functionally expressed in R. emersonii and that the CRISPR/CAS9 system is active in R. emersonii.

Example 24: Integration of Donor DNA Using the CRISPR-Cas System in Rasamsonia emersonii This example describes the functionality of CRISPR/CAS9 in R. emersonii using CAS9 in combination with a guide RNA self-processing ribozyme fragment (gRSR fragment) that targets amdS when using a donor DNA PCR-fragment. The amdS sequence of R. emersonii is described in Uniprot (A0A0F4Z505) or NCBI Genbank (www.ncbi.nlm.nih.gov/nuccore/802095377?itemid=8&sat=37&sat_key=269418918).

Donor DNA was used to introduce a stop codon mutation into the amdS or a deletion of the amdS gene which is involved in acetamide degradation. Strains with the mutation are able to grow on fluoroacetamide as described in EP06035574.

Donor DNA

GBlock fragments were synthesized at IDT (gBlocks® Gene Fragments, Integrated DNA Technologies, Inc, Leuven, Belgium) that contained the donor DNA for the desired mutation, i.e. introduction of a TAA stop codon, (SEQ ID NO: 170) or deletion (SEQ ID NO: 171) of the amdS gene. This gBlock based DNA was cloned into a TOPO Zero Blunt vector using the Zero Blunt TOPO PCR Cloning Kit of Invitrogen. A plasmid map of the resulting vector called "TOPO donor DNA amdS_stop" (SEQ ID NO: 172) is depicted in FIG. 26 and "TOPO donor DNA amdS_deletion" (SEQ ID NO: 173) is depicted in FIG. 27. FIG. 28 depicts an alignment of the donor DNA sequences with the genomic sequence of the amdS gene. PCR amplification of the amdS_stop donor DNA from the TOPO-vector was done with Phusion polymerase (New England Biolabs) using the forward primer as set out in SEQ ID NO: 186 and the reverse primer as set out in SEQ ID NO: 187 according to standard PCR protocols. PCR amplification of the amdS_deletion donor DNA from the TOPO-vector was done with Phusion polymerase (New England Biolabs) using the forward primer as set out in SEQ ID NO: 188 and the reverse primer as set out in SEQ ID NO: 189 according to standard PCR protocols. The PCR fragments were purified with the PCR purification kit from Macherey Nagel according to manufacturer's instructions. DNA concentrations were measured using the NanoDrop (ND-1000 Spectrophotometer, Thermo Scientific).

Construction of BG-AMA13

The CAS9 expression cassette was constructed as described in Example 23.

Construction of BG-AMA15

The CAS9 expression cassette was constructed as described in Example 23.

Plasmid Isolation Cas9 AMA-Plasmids with or without gRNA

The BG-AMA5 (SEQ ID NO: 126 described in Example 11), BG-AMA13 (SEQ ID NO: 176), BG-AMA14 (SEQ ID NO: 179) and BG-AMA15 (SEQ ID NO: 180) vectors were isolated from the *E. coli* culture using the Nucleobond Xtra midi kit of Macherey Nagel according to manufacturer's instructions. DNA concentrations were measured using the NanoDrop (ND-1000 Spectrophotometer, Thermo Scientific).

Transformation to *R. emersonii*

Table 27 in Example 23 shows an overview of the used AMA-plasmids in the transformation. The ku80 gene (required in the non-homologous end joining (NHEJ) pathway of DNA repair) of *Rasamsonia emersonii* was deleted as described in WO2013135732A1. This resulted in a *Rasamsonia emersonii* TEC-210 Δku80 strain.

Table 28 shows the specific amounts of DNA transformed to a *Rasamsonia emersonii* TEC-210 Δku80 strain in each separate transformation.

Protoplast transformation, use of markers and selective media can be found in WO2011/054899 and are also shown in Example 23

TABLE 31

Overview of performed transformations. In all transformations a *Rasamsonia emersonii* TEC-210 Δku80 strain was used. Two different CAS9 expression cassettes were used: version 1: Pc.FP017.pro-Cas9-Pc.FT029.ter and version 2: Anid_tef.pro-Cas9-Pc.FT029.ter.

| Trans-forma-tion | AMA plasmid | CAS9 cassette | Guide RNA present | Donor DNA |
|---|---|---|---|---|
| 1 | 4 µg BG-AMA5 | Version 1 | No | 0 µg |
| 2 | 4 µg BG-AMA5 | Version 1 | No | 4 µg TOPO_amdS_deletion |
| 3 | 4 µg BG-AMA5 | Version 1 | No | 4 µg TOPO_amdS_stop |
| 4 | 4 µg BG-AMA13 | Version 1 | Yes | 0 µg |
| 5 | 4 µg BG-AMA13 | Version 1 | Yes | 4 µg TOPO_amdS_deletion |
| 6 | 4 µg BG-AMA13 | Version 1 | Yes | 4 µg TOPO_amdS_stop |
| 7 | 4 µg BG-AMA14 | Version 2 | No | 0 µg |
| 8 | 4 µg BG-AMA14 | Version 2 | No | 4 µg TOPO_amdS_deletion |
| 9 | 4 µg BG-AMA14 | Version 2 | No | 4 µg TOPO_amdS_stop |
| 10 | 4 µg BG-AMA15 | Version 2 | Yes | 0 µg |
| 11 | 4 µg BG-AMA15 | Version 2 | Yes | 4 µg TOPO_amdS_deletion |
| 12 | 4 µg BG-AMA15 | Version 2 | Yes | 4 µg TOPO_amdS_stop |

After transformation the protoplasts were plated on regeneration media plates containing 100 µg/ml Phleomycin and the plates were incubated at 42° C. for 6-7 days.

An overview of the transformation results can be found in table 32. Transformations without donor DNA seemed to result in more transformants. No clear effect was found in the amount of obtained transformants with or without the presence of gRNA.

TABLE 32

Results of the transformations. In all transformations a *Rasamsonia emersonii* TEC-210 Δku80 was used. Two different CAS9 expression cassettes were used: version 1: Pc.FP017.pro-Cas9-Pc.FT029.ter and version 2: Anid_tef.pro-Cas9-Pc.FT029.ter.

| Trans-forma-tion | AMA plasmid | CAS9 cassette | Guide RNA present | Donor DNA | # transfor-mants |
|---|---|---|---|---|---|
| 1 | 4 µg BG-AMA5 | Version 1 | No | 0 µg | 289 |
| 2 | 4 µg BG-AMA5 | Version 1 | No | 4 µg amdS_deletion | 24 |
| 3 | 4 µg BG-AMA5 | Version 1 | No | 4 µg amdS_stop | 48 |
| 4 | 4 µg BG-AMA13 | Version 1 | Yes | 0 µg | 301 |
| 5 | 4 µg BG-AMA13 | Version 1 | Yes | 4 µg amdS_deletion | 72 |
| 6 | 4 µg BG-AMA13 | Version 1 | Yes | 4 µg amdS_stop | 52 |
| 7 | 4 µg BG-AMA14 | Version 2 | No | 0 µg | 173 |
| 8 | 4 µg BG-AMA14 | Version 2 | No | 4 µg amdS_deletion | 28 |
| 9 | 4 µg BG-AMA14 | Version 2 | No | 4 µg amdS_stop | 16 |
| 10 | 4 µg BG-AMA15 | Version 2 | Yes | 0 µg | 120 |
| 11 | 4 µg BG-AMA15 | Version 2 | Yes | 4 µg amdS_deletion | 38 |
| 12 | 4 µg BG-AMA15 | Version 2 | Yes | 4 µg amdS_stop | 50 |

Figure 32:
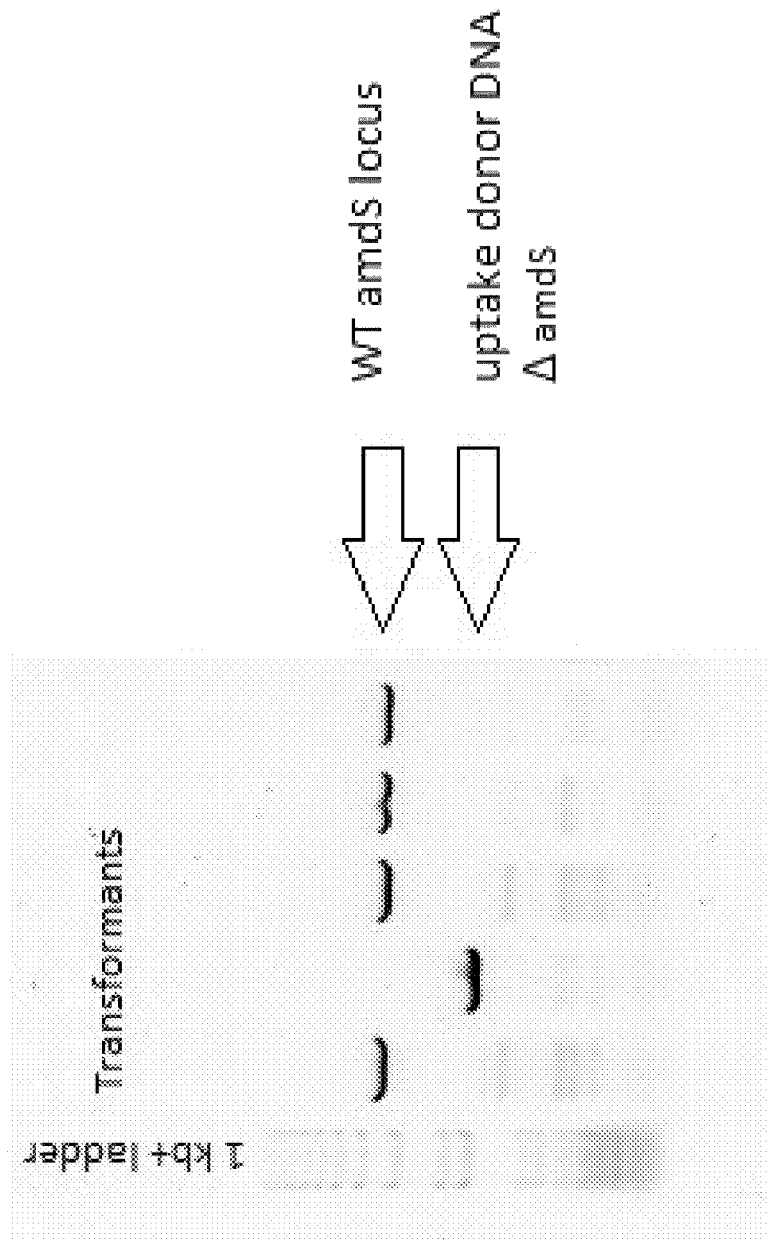
FIG. 32 depicts a gel picture of a PCR performed showing introduction of amdS_deletion donor DNA within genomic DNA at the amdS locus. The lower band indicates that the amdS locus was deleted in genomic DNA.

Colony PCR to Obtain DNA Fragment Used for Sequencing or to Check for amdS Locus Deletion Spores were plated on *Rasamsonia* agar medium and incubated for 6-7 days at 42° C. in an incubator. A piece of a colony was taken with an inoculation loop and put in 50 µl Glucanex™ solution (50 mg/ml Glucanex™ dissolved in KC buffer (60 g/l KCl, 2 g/l Citric acid, adjusted with KOH/HCl to pH 6.2)) in an Eppendorf tube. The mixture was incubated for 1 hour at 37° C. After this step, 300 µl DNA dilution buffer (0.58 g/l NaCl, 0.29 g/l EDTA, 1.58 g/l Tris/HCl pH 7.5) was added and the mix was boiled for 5 minutes in a water bath or PCR apparatus with heated lid. Subsequently, 5 µl template (without mixing) was pipetted from the top of the solution and was added in the PCR mix. The PCR was performed according to standard PCR protocols using Phusion DNA polymerase (New England Biolabs), using genomic DNA isolated from different transformants and a non-transformed strain as controls as template DNA, to obtain two different PCR fragments: PCR fragment 1 was obtained using forward primer as set out in SEQ ID NO: 181 and reverse primer as set out in SEQ ID NO: 182, and PCR fragment 1 was used to determine introduction of a stop codon at the amdS locus (donor_amds_Stop) by sequencing. Prior to the sequencing reaction, PCR fragment 1 was purified with the PCR purification kit from Macherey Nagel according to manufacturer's instructions. PCR fragment 2 was obtained using forward primer as set out in SEQ ID NO: 183 and reverse primer as set out in SEQ ID NO: 184, and PCR fragment 2 was used to confirm deletion of the amdS locus by loading the samples on a 0.8% agarose gel (see FIG. 32 for an example). Approximately 6% of the transformants which were transformed with the amdS_deletion donor DNA contained the amdS locus deletion (Table 33, transformation 5).

Sequencing of the Target Site in amdS to Check for the Genomic Mutation by Integration of Donor DNA (Stop Codon)

PCR for sequencing was done with BigDye Terminator v3.1 Cycle Sequencing kit of Applied Biosystems according to the manual using the forward primer as set out in SEQ ID NO: 185 and amdS sequence fragment (PCR fragment 1) as template. Sequencing PCR product was cleaned by ethanol/EDTA precipitation according to supplier manual. The amdS sequence PCR fragment was pelleted in 10 μl HiDi Formamide of Applied Biosystems and suspension was used for sequence analysis with the 3500 Genetic Analyzer of Applied Biosystems (Sanger sequencer).

The percentage of transformants that contained the designed TAA mutation of the total number of transformants that were checked are shown in table 33.

TABLE 33

Results of the sequencing. In all transformations a *Rasamsonia emersonii* TEC-210 Δku80 strain was used. Two different CAS9 expression cassettes were used: version 1: Pc.FP017.pro-Cas9-Pc.FT029.ter and version 2: Anid_tef.pro-Cas9-Pc.FT029.ter.

| Transformation | AMA plasmid | CAS9 cassette | Guide RNA present | Donor DNA | % transformants containing TAA mutation or amdS locus deletion |
|---|---|---|---|---|---|
| 1 | 4 μg BG-AMA5 | Version 1 | No | 0 μg | 0 |
| 2 | 4 μg BG-AMA5 | Version 1 | No | 4 μg amdS_deletion | 0 |
| 3 | 4 μg BG-AMA5 | Version 1 | No | 4 μg amdS_stop | 0 |
| 4 | 4 μg BG-AMA13 | Version 1 | Yes | 0 μg | 0 |
| 5 | 4 μg BG-AMA13 | Version 1 | Yes | 4 μg amdS_deletion | 5.6 |
| 6 | 4 μg BG-AMA13 | Version 1 | Yes | 4 μg amdS_stop | 3.8 |
| 7 | 4 μg BG-AMA14 | Version 2 | No | 0 μg | 0 |
| 8 | 4 μg BG-AMA14 | Version 2 | No | 4 μg amdS_deletion | 0 |
| 9 | 4 μg BG-AMA14 | Version 2 | No | 4 μg amdS_stop | 0 |
| 10 | 4 μg BG-AMA15 | Version 2 | Yes | 0 μg | 0 |
| 11 | 4 μg BG-AMA15 | Version 2 | Yes | 4 μg amdS_deletion | 0 |
| 12 | 4 μg BG-AMA15 | Version 2 | Yes | 4 μg amdS_stop | 0 |

No intended mutations, meaning introduction of a stop codon or deletion of the amdS locus, were found in the control transformants (no addition of donor DNA) and no intended mutations were found when Cas9 expression cassette version 2 was used. Approximately 4% of the transformants transformed with amdS_stop donor DNA showed the intended TAA mutation, when using CAS9 expressed from a Pc.FP017 promoter in the presence of a guide RNA expression cassette (Table 33, transformation 6). The results show that the CRISPR-Cas system is functional in the strains and can be used to introduce point mutations or deletion of parts of genomic DNA, without the need of introduction of a marker cassette into genomic DNA.

Further *Penicillium chrysogenum* Examples

Media Used in the Examples

R agar contained 0.52% v/v glycerol, 0.75% v/v beet molasses, 0.5% yeast extract, 300 mM NaCl, 0.2 m MgSO$_4$.7H$_2$O, 0.44 mM KH$_2$PO$_4$, 3.3 μM NH$_4$Fe(SO$_4$)$_2$.12H$_2$O, 0.4 μM CuSO$_4$.5H$_2$O, 1.45 mM CaSO$_4$.2H$_2$O and 2% agar. When required, NaNO$_3$ was added to a final concentration of 0.1%.

Strains

*P. chrysogenum* DS17690, (deposited on 15 Apr. 2008 at the Centraalbureau voor Schimmelcultures, Utrecht, The Netherlands with deposition number CBS122850), is a high penicillin producing strain.

*P. chrysogenum* DS54465, a derivative of DS17690 wherein the *P. chrysogenum* KU70 homologue has been deleted (Snoek et al. (2009) Fungal Genetics and Biology 46, 418-426).

*P. chrysogenum* DS68530, a derivative of DS54465 comprising a deletion of the gene encoding for the amdS marker. This strain was constructed by using the "MARKER-GENE FREE" approach as described in EP 0 635 574 B1.

Example 25: Pks17 Phenotype

Figure 33:
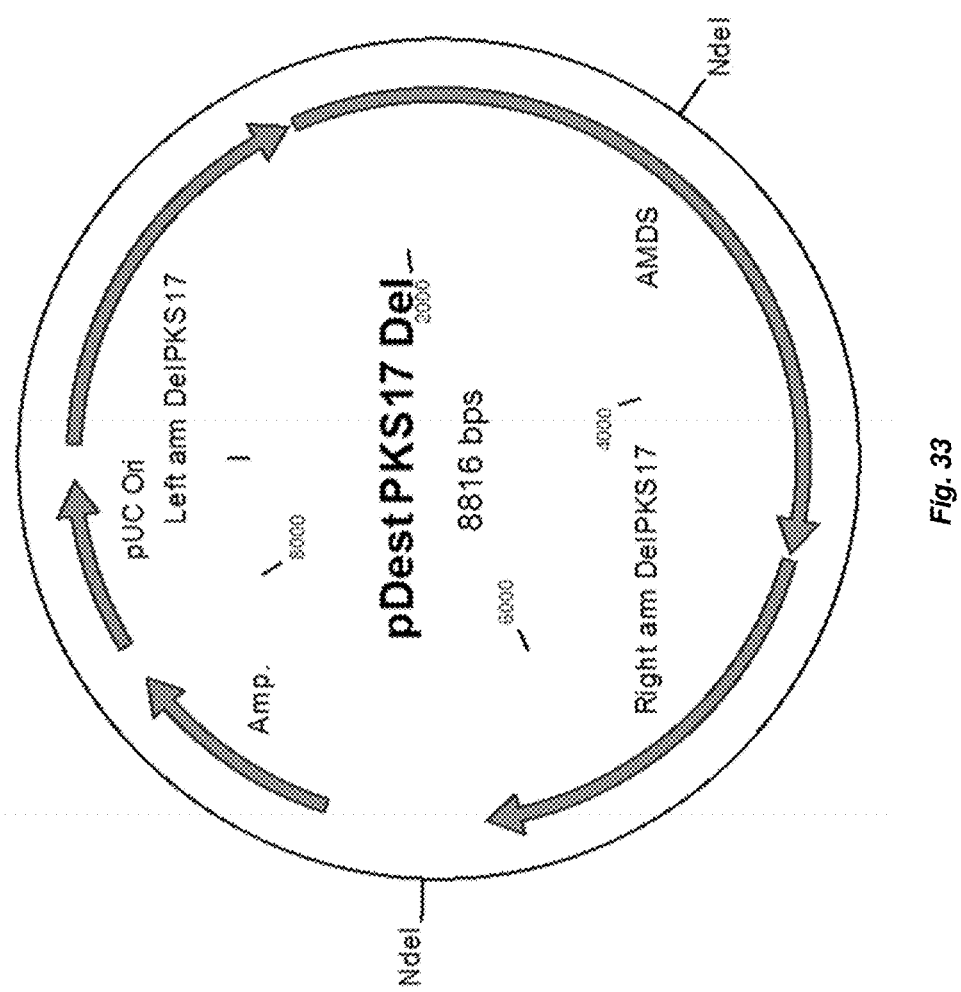
FIG. 33 depicts a plasmid map of vector pDest PKS17 Del
Figure 34:
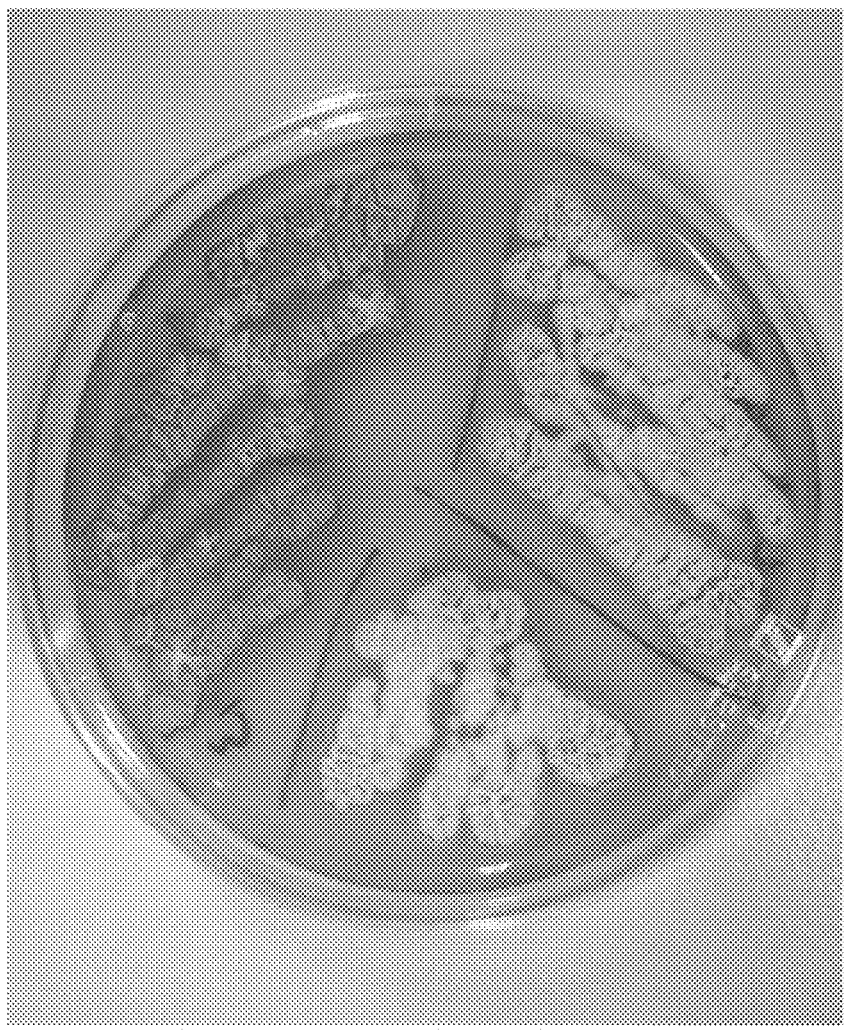
FIG. 34 depicts a phenotypic screening: a petri dish wherein two streaked colonies on the bottom show the pKS17 knock-out phenotype (white spores), as opposed to the top colony wherein the pKS17 knock-out phenotype is not present (dark spores).

To determine if Pks17 is involved in conidial pigment biosynthesis, the Pks17 gene was deleted. For deletion of Pks17, the plasmid pDEST-PKS17 (SEQ ID NO: 190) depicted in FIG. 33 was used. The deletion cassette contains the pGpdA promoter, the amdS selection marker and AT-terminator flanked by approximately 2.2 kb of upstream and downstream flank of the Pks17 open reading frame. Experiments were performed by amplifying the deletion cassette from the vector with forward primer 184 (SEQ ID NO: 191) and reverse primer 189 (SEQ ID NO: 192). Three μg of the PCR-amplified deletion cassette with 1.0 kb flanks was used in a transformation to *P. chrysogenum* DS68530. The selection of transformants was done on acetamide-medium and after 1 round of purification on acetamide agar, single colonies were put to YGG agar for sporulation. The colonies with a successful KO displayed white spores after sporulation as shown in FIG. 34. No other phenotypic changes were observed. Knock-out of this gene can be applied as a good phenotype-based screen and was therefore used to evaluate the CRISPR-Cas9 system.

Example 26: Selection of gRNA

The target gRNA sequence >846r (SEQ ID NO: 193) was selected for PKS17.

The gRNA tail (SEQ ID NO: 194) was added in-silico and the final gRNA molecule was ordered as complementary forward (SEQ ID NO: 195) and reverse oligo (SEQ ID NO: 196).

Example 27: Constructing the *P. chrysogenum* CAS9 Expression Cassette

Figure 35:
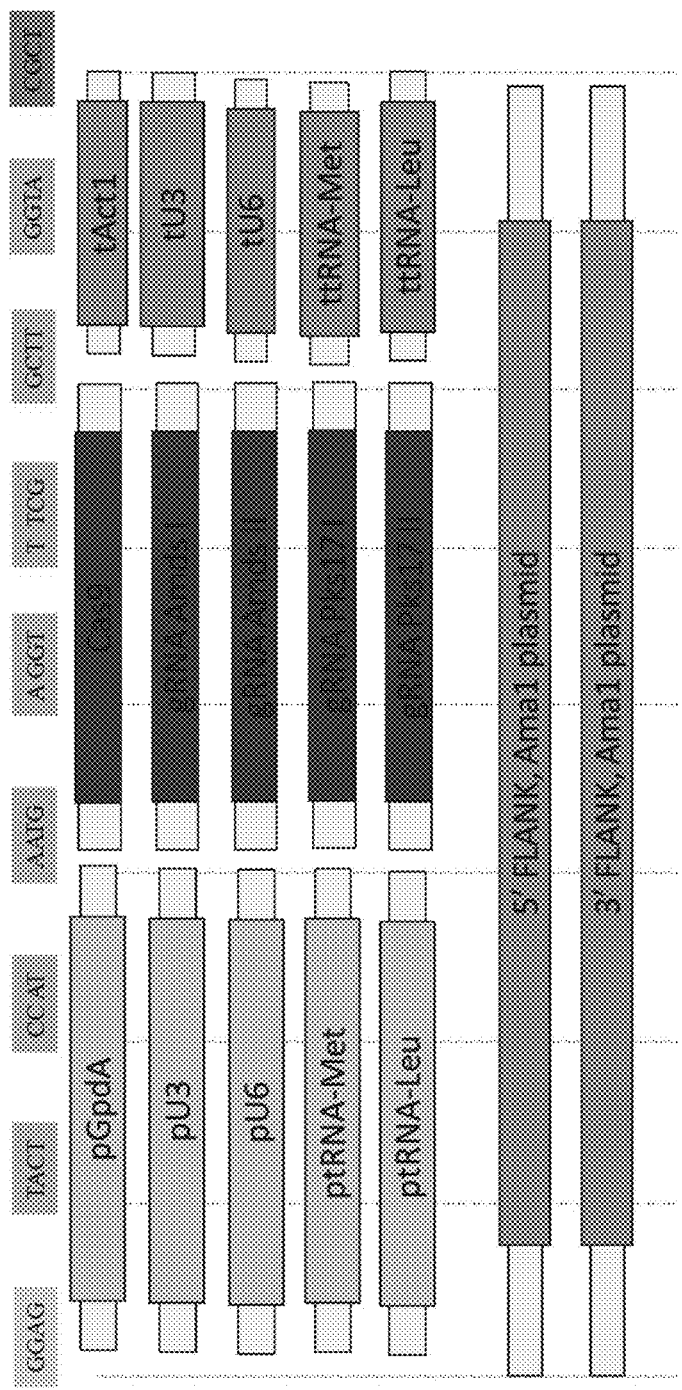
FIG. 35 depicts the MOCLO modular cloning set-up for CRISPR-CAS9

The expression cassette for CAS9 was constructed using the MOCLO cloning method (Weber et al., 2011). FIG. 35 depicts the exact 4 bp overhangs used to ligate each smaller fragment in the "level 0" MOCLO destination vector. The CAS9 expression cassette contains a pGpdA promoter, the CAS9 open reading frame and an Act1 terminator. After the MOCLO cloning step the combined elements form the CAS9 expression cassette (SEQ ID NO:197). The expression cassette in the "level 0" standard destination vector was checked with restriction enzyme analysis and sequencing to verify the exact sequence. The created vector is now called a "level 1" vector, according to the MOCLO cloning method, and used for further cloning in the following examples.

Example 28: Constructing the *P. chrysogenum* gRNA Expression Cassettes Targeting Pks17 in the *P. chrysogenum* Genome Four gRNA expression cassettes were constructed using the MOCLO cloning method (Weber et al., 2011). FIG. 35 depicts the exact 4 bp overhangs used to ligate each smaller fragment in the "level 0" MOCLO destination vector.

One gRNA expression cassette contains the polymerase III promoter U6, the gRNA 846r sequence targeting Pks17 and a U6 terminator fragment. After the cloning step these combined elements form the gRNA expression cassette "U6" (SEQ ID NO:198).

The second gRNA expression cassette contains a polymerase III promoter U3, the gRNA sequence targeting Pks17 and a U3 terminator fragment. After the cloning step these combined elements form the gRNA expression cassette "U3" (SEQ ID NO:199).

The third gRNA expression cassette contains a polymerase 11 tRNA-Met promoter, the gRNA sequence targeting Pks17 and a tRNA-Met terminator fragment. After the cloning step these combined elements form the gRNA expression cassette "tRNA-Met" (SEQ ID NO:200).

The fourth gRNA expression cassette contains a polymerase III tRNA-Leu promoter, the gRNA sequence targeting Pks17 and a tRNA-Leu terminator fragment. After the cloning step these combined elements form the gRNA expression cassette "tRNA-Leu" (SEQ ID NO:201).

All gRNA expression cassettes in the "level 0" standard destination vector were checked with restriction enzyme analysis and sequencing to verify their exact sequence. The created vectors are now called "level 1" vectors, according to the MOCLO cloning method and used in the following described cloning steps.

Example 29: Cloning of the 5' and 3' AMA1 Homologous Flanks

Both homologous flanks needed for the homologous recombination with the AMA1 vector in *P. chrysogenum* were constructed using the MOCLO cloning method (Weber et al., 2011). FIG. 35 depicts the exact 4 bp overhangs used to ligate each smaller fragment in the "level 0" MOCLO destination vector. After the MOCLO cloning step the combined elements form the 5' AMA1 homologous flank (SEQ ID NO:202) and the 3' AMA1 homologous flank (SEQ ID NO:203). Both flanks in the "level 0" destination vector were checked with restriction enzyme analysis and sequencing to verify the exact sequences.

The created vectors are now called "level 1" vectors, according to the MOCLO cloning method and used in the following described cloning steps.

Example 30: Cloning of "Level 1" Parts into the "Level 2" Vector

Figure 36A:
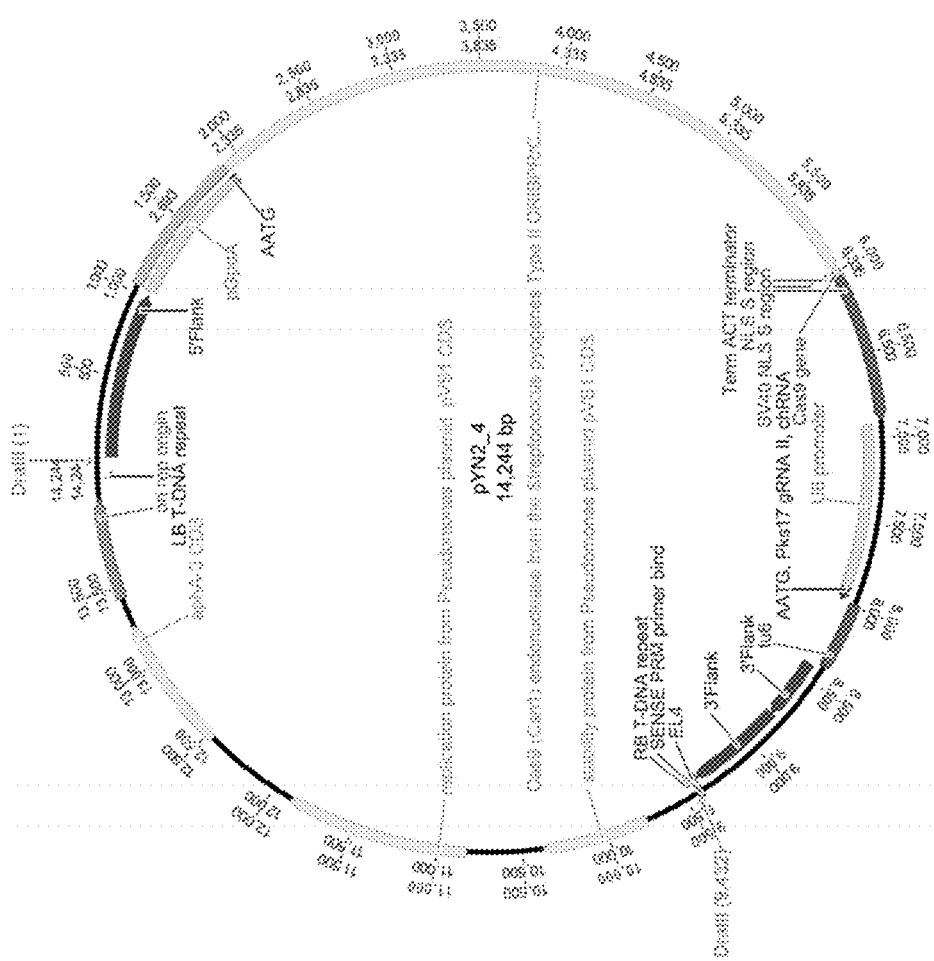
FIG. 36 depicts a plasmid map of vector pYN2-4 in two representations (A and B)
Figure 36B:
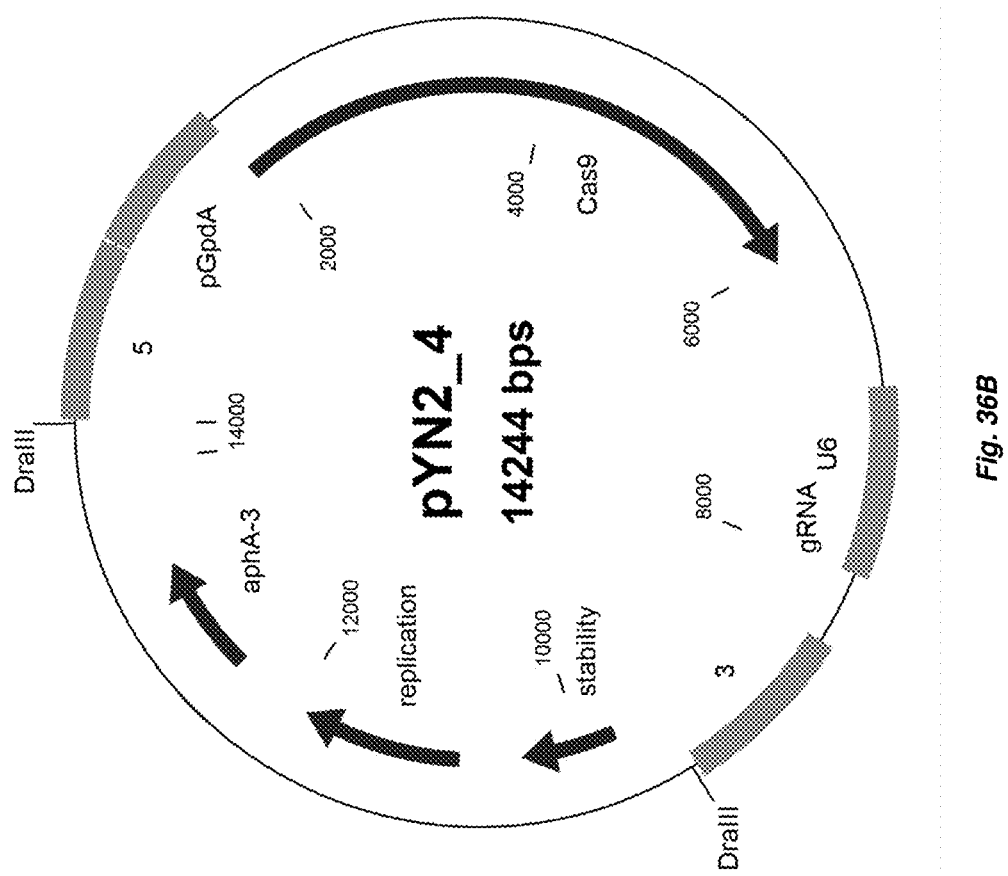

The in the previous examples created "level 1" vectors were used in the next MOCLO cloning step. The fragments were cloned in the one step reaction in the following order into the "level 2" vector, first the 5' flank, then the CAS9 expression cassette followed by one of the gRNA expression cassettes and finally the 3' flank. In this way 4 vectors were created, one for each different gRNA expression cassette. The 5' flank-CAS9-U6-3' flank combination, the 5' flank-CAS9-U3-3' flank combination, 5' flank-CAS9-tRNA-Met-3' flank combination and the 5' flank-CAS9-tRNA-Leu-3' flank combination. The resulting vectors were checked using restriction enzyme analysis. A correct clone for the 5' flank-CAS9-U6-3' flank combination was named pYN2_4 (SEQ ID NO:204) and used in example 30. A plasmid map of pYN2_4 can be found in FIG. 36A-B, in two representations (A and B).

Example 31: Transformations to *P. chrysogenum*

Figure 37:
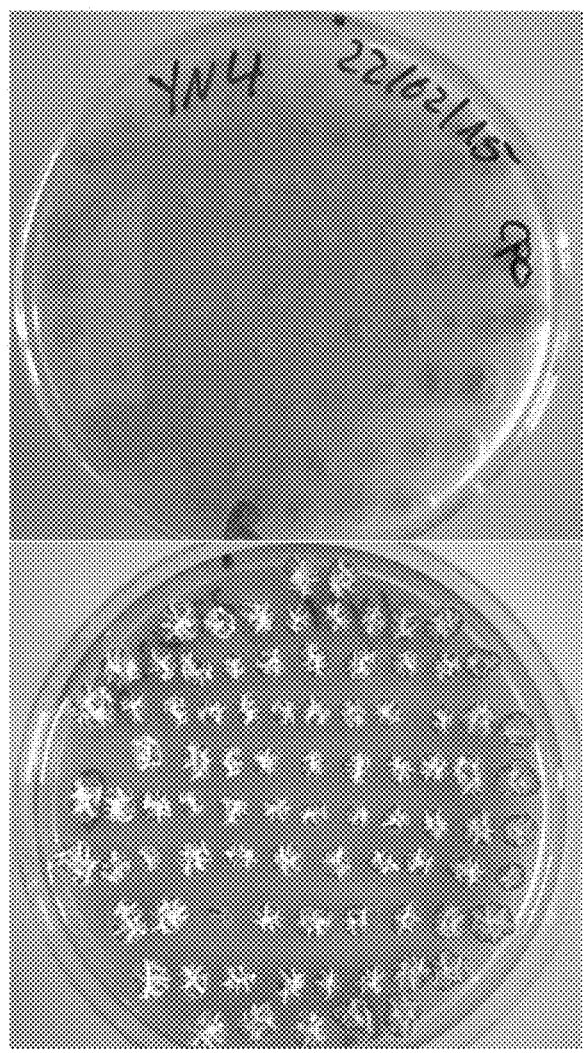
FIG. 37 depicts screening for the white spore phenotype characteristic of the Pks17 mutation. A number of transformants showed the white spore phenotype: two petri dishes comprising colonies after transfer to R-Agar. Circles indicate white colonies

For the transformation to *P. chrysogenum* DS68530 two linearized vectors were used, the previously described pYN2_4 and the vector pDSM-JAK-109 (construction described in WO/2012/123429, which is herein incorporated by reference). The pYN2_4 vector was linearized by a restriction digestion using DraIII and pDSMJAK109 was linearized by a restriction digestion using KpnI prior to transformation. Transformation of the fragments to *P. chrysogenum* will result in the in vivo homologous recombination of both fragments and formation of a circular plasmid able to survive in the cell due to the AMA1 sequences and the Phleomycin resistance marker located on the pDSM-JAK-109 fragment. Preparation of *P. chrysogenum* protoplasts and their transformation were performed in accordance with established protocols (Cantoral et al., 1987 Bio/Technol. 5, 494-497). After transformation, the protoplasts were plated on regeneration media plates containing 15 μg/ml Phleomycin and incubated at 25° C. for 4-6 days. After the first incubation, colonies were transferred from the regeneration plate to a R-agar plate where sporulation can take place. After 4-7 days growth at 25° C. the transformants were scored for the white spore phenotype characteristic of the Pks17 mutation. A number of transformants showed the white spore phenotype. FIG. 37 depicts the transformants with the white (circled) and green colonies on the plates. The control transformation resulted in a plate with over 100 colonies with only the wt phenotype, meaning no white colonies (data not shown). The results show that the CRISPR-Cas system is functional in the transformation and increased the efficiency of introducing mutations in Pks17 and make it non-functional.

Further growth of dark colonies showed for several colonies heterogeneity appearing, showing that the CRISPR-Cas system is active during further growth, resulting in further Pks17 deletion mutants (data not shown).

Example 32: Transformations to *P. chrysogenum* with Donor DNA Targeting Pks17

For this example the target gRNA sequence >235r (SEQ ID NO: 205) is selected for PKS17. The gRNA tail (SEQ ID NO: 194) is added in-silico and the final gRNA molecule is ordered as complementary forward (SEQ ID NO: 206) and reverse oligo (SEQ ID NO: 207).

the second gRNA target is cloned in the same manner as previously described in example 27 using the U6 promoter and terminator resulting in the gRNA expression cassette gRNA expression cassette "U6 pKS17-235" (SEQ ID NO: 208). In this experiment, donor DNA is used. The donor DNA is a 120 bp DNA molecule (SEQ ID NO: 209). Its sequence is identical to bp 181 to bp 300 of the ORF of gene Pc21g16000-PKS17, except the following changes: A217T, G220T and C235T. A217T, G220T to introduce two stop codons and C235T is used for destruction of the NGG-PAM. The donor DNA's are ordered as single-stranded complementary oligos which are annealed by gradually cooling to room temperature after boiling. Donor DNA is purified using the Zymoprep DNA Clean & Concentrator Kit.

For the transformation to *P. chrysogenum* (DS68530) two linearized vectors are used, the previously described pYN2_4 and the vector pDSM-JAK-109 (construction described in WO/2012/123429, which is herein incorporated by reference) and the 120 bp donor DNA fragment. The pYN2_4 vector is linearized by a restriction digestion using DraIII and pDSMJAK109 is linearized by a restriction digestion using KpnI prior to transformation. Transformation of the fragments to *P. chrysogenum* will result in the in vivo homologous recombination of both fragments and formation of a circular plasmid able to survive in the cell due to the AMA1 sequences and the Phleomycin resistance marker located on the pDSM-JAK-109 fragment. Preparation of *P. chrysogenum* protoplasts and their transformation were performed in accordance with established protocols (Cantoral et al., 1987 Bio/Technol. 5, 494-497). After transformation the protoplasts are plated on regeneration media plates containing 15 µg/ml Phleomycin and incubated at 25° C. for 4-6 days. After the transformation colonies are transferred from the regeneration plate to R-agar plates containing for sporulation. After 4-7 days growth at 25° C. the transformants are scored for the white spore phenotype characteristic of the Pks17 mutation. A number of transformants show the white spore phenotype. The control transformation results in a plate with over 100 colonies with only the wt phenotype, meaning no white colonies. The results will show that the CRISPR-Cas system is functional in the transformation and increased the efficiency of introducing the intended mutation in Pks17. Several colonies are picked and via colony-PCR and subsequent SANGER sequencing of a 200 bp fragment including the designed modified target it can be shown that the intended mutations are introduced in a targeted way.

Example 33: Construction of a Second Series of gRNA Expression Cassettes Targeting Pks17

The gRNA target >235r was chosen for this experiment and combined with a longer gRNA tail (SEQ ID NO: 210). The tail was added in-silico and the fragment used in the MOCLO cloning of the gRNA >235r molecule was ordered as complementary forward oligo (SEQ ID NO: 211) and reverse oligo (SEQ ID NO: 212). The resulting gRNA >235r with the longer tail will be referred to as gRNA >235r long. The gRNA >235r long constructs were ordered as oligos that were annealed before assembly to level 0 vectors. The oligonucleotides (all oligos purchased from Sigma Aldrich, UK) were annealed by mixing equal amounts of forward and reverse oligos in ligase buffer (ThermoScientific, USA). The mixture was incubated at 100° C. for 5 min followed cooling to 25° C. by a gradual decrease of 1° C. for 30 s in 75 cycles.

In this example, 4 different promoter and terminator combinations for in vivo transcription of the gRNA >235r long in *P. chrysogenum* were cloned. The cloning was performed as previously described in example 27, using the RNA polymerase III U6 promoter (SEQ ID NO: 213) and U6 terminator (SEQ ID NO: 214) resulting in the gRNA expression cassette "U6 pKS17>235 long" (SEQ ID NO: 215), the tRNA-Met promoter (SEQ ID NO: 27) and the RNA polymerase III tRNA-Met terminator (SEQ ID NO: 216) resulting in the "tRNA-Met pKS17>235 long" (SEQ ID NO: 217), the RNA polymerase III tRNA-Leu promoter (SEQ ID NO: 219) and tRNA-Leu terminator (SEQ ID NO: 220) resulting in the "tRNA-Leu pKS17>235 long" (SEQ ID NO: 221) and the RNA polymerase II utp25 promoter (SEQ ID NO: 222) and utp25 terminator (SEQ ID NO: 223) resulting in the "utp25 pKS17>235 long" (SEQ ID NO:224). The created vectors are now called a "level 1" vector, according to the MOCLO cloning method.

Example 34: Constructing the Donor DNA Used for Deleting the pKS17 ORF

The donor DNA used in the example was a 2049 bp marker free DNA fragment. Its sequence being identical to flanking regions of about 1 kb on the 5' flank and 1 kb on the 3' flank of the ORF of pKS17. The donor DNA fragment was constructed using the MOCLO modular cloning system. The fragments were PCR-amplified from genomic DNA (gDNA) of *P. chrysogenum* DS68530 using the forward primer pks17_5'_Bpil_F (SEQ ID NO: 225) and reverse primer pks17_5'_Bpil_R (SEQ ID NO: 226) for the 5' flanking region and the forward primer pks17_3'_Bpil_F (SEQ ID NO: 227) and reverse primer pks17_3'_Bpil_R (SEQ ID NO: 228) for the 3' flanking region. After combining the two fragments in a standard cloning vector, the final donor DNA fragment for transformation to *P. chrysogenum* was made by PCR-amplification using the forward primer pks17_1 kb_F (SEQ ID NO: 229) and the reverse primer pks17_1 kb_R (SEQ ID NO: 230). The final donor DNA (SEQ ID NO: 231) amplified by PCR was purified with the PCR clean-up Kit (Sigma Aldrich, UK) prior to addition to the transformation mixture.

Example 35: Constructing the *P. chrysogenum* xlnA Promoter CAS9 Expression Cassette The expression cassette "xlnA-CAS9" was constructed using the MOCLO cloning method (Weber et al., 2011). FIG. 35 depicts the exact 4 bp overhangs used to ligate each smaller fragment in the "level 0" MOCLO destination vector. The xylose inducible promoter and its terminator from xlnA of *A. nidulans* were amplified from gBlocks (IDT, USA). The Cas9 open reading frame from *Staphylococcus pyogenes* was PCR-amplified from a construct obtained via Addgene. After the MOCLO cloning step, the combined elements form the xlnA-CAS9 expression cassette (SEQ ID NO:232). The expression cassette in the standard destination vector was checked with restriction enzyme analysis and sequencing to verify the exact sequence. The created vector is now called a "level 1" vector, according to the MOCLO cloning method.

Example 36: Constructing the pDSM-YN2 AMA1 Plasmid

In vector pDSM-JAK-109, which was used as starting vector, the dsRED fluorescent marker was switched to mKate under the control of the *A. nidulans* 40S promoter using the restriction enzymes NotI and NsiI and standard cloning procedures. This resulted in the "pDSM-YN2" vector (SEQ ID NO: 233), which was checked and verified using restriction enzyme analysis. The pDSM-YN2 vector was linearized with SnaBI and AgeI and purified with the PCR clean-up Kit (Sigma Aldrich, UK) prior to addition to the transformation mixture.

Example 37: Constructing Flanking Regions for Homologous Recombination with pDSM-YN2 AMA1 Vector To create homology to the pDSM-YN2 AMA1 vector for in vivo homologous recombination during transformation to *P. chrysogenum* a 5' and a 3' flanking region of 1 kb were cloned as separate level 1 modules. These will be attached to the gRNA and CAS9 expression cassettes and finally used for incorporation to the pDSM-YN2 AMA1 vector during transformation to *P. chrysogenum* via in vivo homologous recombination. Both flanks were PCR amplified with the primers called 5'_F (SEQ ID NO: 234) and 5'_R (SEQ ID NO: 235) for the 5' flanking region (SEQ ID NO: 236), 3'_F (SEQ ID NO: 237) and 3'_R(SEQ ID NO: 238) for the 3' flanking region (SEQ ID NO: 239). The amplified fragments were cloned into the MOCLO "level 0" standard destination vector and checked with restriction enzyme analysis and sequencing to verify the constructs. The created vectors are called "level 1" vectors, according to the MOCLO cloning method.

Example 38: Creation of Final CAS9, gRNA Vectors for Transformation

The MOCLO scheme allows for construction of multi-gene constructs using the Golden Gate technology. MOCLO cloning was used to create the final vectors from previously constructed level 1 vectors. For each of the 4 gRNA expression cassette variants, described in example 32, two separate vectors were made. One contains the 5' homology flanking to the pDSM-YN2, the xlnA-CAS9 expression cassette and one of the gRNA expression cassette variants with pKS17 as target. The letter "A" is added to the name of these vectors. The second one contains the gRNA expression cassette variant with pKS17 as target, a gpd-amdS marker cassette and the 3' flanking region to the pDSM-YN2 AMA1 vector. The letter "B" is added to the name of these vectors. After construction according to MOCLO methods in total 8 vectors were created.

The vectors are listed below with their respective reference to their sequence ID.

"A" vectors
pYN2_18_A_5'-XInA-Cas9-Utp25_Pks17 (SEQ ID NO: 232)
pYN2_19_A_5'XInA-Cas9-U6_Pks17 (SEQ ID NO: 233)
pYN2_20_A_5'-XInA-Cas9-tRNA-Leu_Pks17 (SEQ ID NO: 234)
pYN2_21_A_5'-XInA-Cas9-tRNA-Met_Pks17 (SEQ ID NO: 235)
"B" vectors
pYN2_22_B_Utp25_Pks17-amdS-3' (SEQ ID NO: 236)
pYN2_23_B_U6_Pks17-amdS-3' (SEQ ID NO: 237)
pYN2_24_B_tRNA_Leu_Pks17-amdS-3' (SEQ ID NO: 238)
pYN2_25_B_tRNA_Met_Pks17-amdS-3' (SEQ ID NO: 239)

The vectors were linearized with MreI which cuts twice in the backbone and purified after digestion with the PCR clean-up Kit (Sigma Aldrich, UK) prior to addition to the transformation mixture.

Example 39: Marker Free Deletion of PKS17 in *P. chrysogenum* Using CRISPR-Cas

The *P. chrysogenum* DS68530 strain was used for transformation. The DS68530 (ΔhdfA) strain is deficient in NHEJ and thus in presence of donor DNA, HR will be the preferred means for these cells to repair a DSB.

The following fragments were transformed:
linearized AMA1 vector, pDSM-YN2 (see example 35)
linearized fragment from A vectors (see example 37)
corresponding linearized fragment from B vector (see example 37)
2 kb donor DNA fragment (see example 33)

Figure 38:
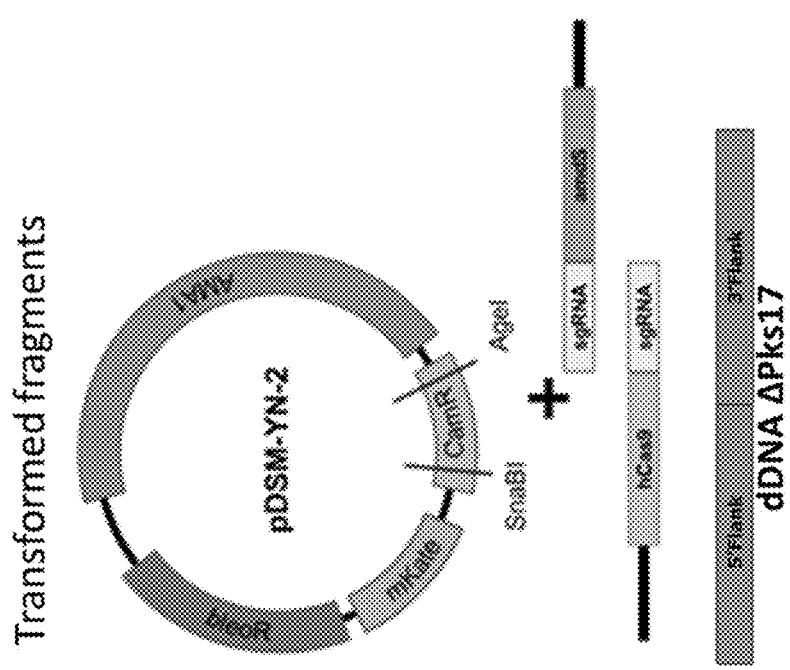
FIG. 38 depicts a set-up of the fragments to be transformed to P. chrysogenum. The pDSM-YN-2, the hCas9 (Cas9 expression cassette)-sgRNA (single gRNA expression cassette) and the sgRNA-amdS fragment will recombine in vivo via homologous recombination. This results in expression of the Cas9 protein and the guide RNA followed by the cut in the genome by the CRISPR-Cas system in the Pks17 open reading frame, integration of the donor DNA and consequently the deletion of the Pks17 gene.

For each fragment 1 ug of DNA was used in the transformation mixture. Four different mixtures were prepared and transformed, one for the utp25 gRNA expression cassette, one for the U6 expression cassette, one for tRNA_Leu and one for tRNA-Met. See FIG. 38 for a graphical display of the transformation.

Preparation of *P. chrysogenum* protoplasts and their transformations were performed in accordance with established protocols (Cantoral et al., 1987 Bio/Technol. 5, 494-497). After transformation the protoplasts were plated on regeneration media plates containing acetamide as sole nitrogen source, followed by incubation at 25° C. for 4-6 days.

Figure 39:
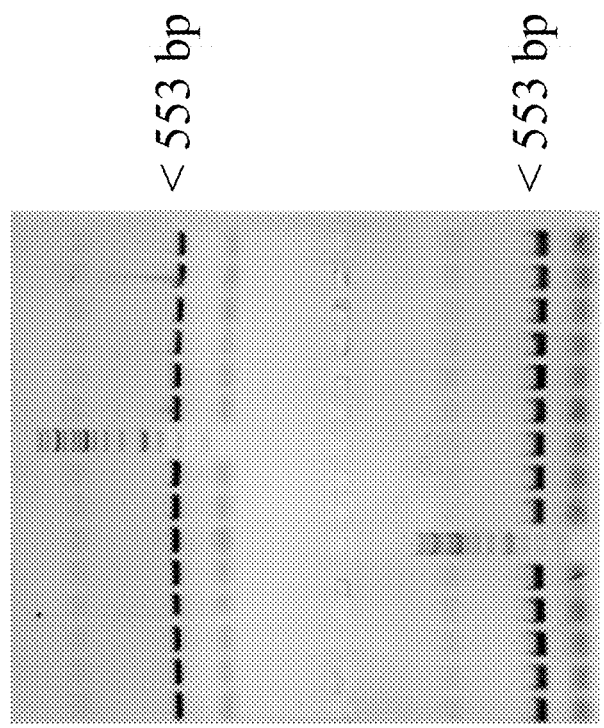
FIG. 39 depicts as agarose gel electrophoresis of the colony PCR for 28 out of the 45 colonies. The results confirm the integration of the donor DNA in the genome of the host cell of all colonies analysed.

Transformation of the fragments to *P. chrysogenum* resulted in the in vivo homologous recombination of the pDSM-YN2 fragment, the linearized fragment from the "A" vector and the linearized fragment from the corresponding "B" vector. A circular plasmid was formed able to survive in the cell due to the AMA1 sequences and the selection for the amdS marker. Due to the homologous recombination the vector also incorporated the CAS9 expression cassette and the gRNA expression cassette targeting Pks17. The resulting plasmid expresses the CAS9 and the gRNA. This led to an active CRISPR-CASsystem according to the invention able to cut specifically at the Pks17 locus on the genome. The donor DNA fragment is able to integrate via homologous recombination at the CAS9 mediated double stranded break and with that repairing the break and deleting the Pks17 ORF. After transformation, protoplasts were incubated at 25° C. and increased humidity for 5-6 days on recovery plates containing 1M sucrose and 0.1% acetamide as sole nitrogen source. Colonies from the transformation plates were transferred to R-agar. The obtained colonies showed the characteristic white colored spores belonging to phenotype of the Pks17 deletion with some remaining wild type background green spores which resulted in light white/green colonies. To confirm the integration of the donor DNA in the genome, colony PCR was performed using forward oligo pks17_0.25 kb_F (SEQ ID NO: 148) and reverse oligo pks17_0.25 kb_R (SEQ ID NO: 249) and the Phire Plant Direct PCR Kit (ThermoScientific, USA). Colony PCR showed that out of the 45 colonies analyzed, all colonies were repaired by the donor DNA, resulting in removal of the complete Pks17 ORF, as visualized by a band of 553 bp (see FIG. 39 for analysis of the PCR results on agarose gel for about half of the colonies). The results showed that the CRISPR-Cas system in combination with donorDNA was functional for each of the promoter gRNA combinations used in the transformation and enabled efficient marker free deletion of the Pks17 ORF.

Example 40: In Vitro gRNA Synthesis

The gRNA-templates were constructed as DNA oligos by fusing the 20 bp protospacer (>235r) to a T7-promoter sequence and a 77 bp gRNA tail. The final 120 bp sequence (SEQ ID NO: 250) was used as template for in vitro gRNA synthesis. The gRNA was synthesized using the Ambion MegaScript RNA synthesis Kit (ThermoFisher, USA), with 0.75 μg of gRNA-template and 0.25 μl SUPERase In RNase Inhibitor (20 U/µL, ThermoFisher) added to the 10 µl gRNA synthesis reaction, that was incubated at 37° C. for a minimum of 6 h. For synthesis control, 0.5 µl of gRNA synthesis mix was analyzed by electrophoresis on 2% agarose gels and the gRNA was directly used for transformation experiments without any further purification.

Example 41: Marker Free Deletion of pKS17 in *P. chrysogenum* Using CRISPR-Cas and In Vitro Synthesized gRNA The *P. chrysogenum* DS68530 strain was used for transformation. DS68530 (ΔhdfA) is deficient in NHEJ and thus HR is the preferred means for these cells to repair a DSB.

The following fragments were transformed:
linearized AMA1 vector, pDSM-YN2 (see example 35)
MreI linearized vector pYN2_28_Xyl-Cas9_AMDS_3 (SEQ ID NO 251)
in vitro transcribed gRNA (see example 40)
2 kb donor DNA fragment (see example 33)

For each DNA fragment 1 µg was used in the transformation mixture, for the in vitro synthesized gRNA 0.75 µg was used.

Preparation of *P. chrysogenum* protoplasts and their transformations were performed in accordance with established protocols (Cantoral et al., 1987 Bio/Technol. 5, 494-497). After transformation the protoplasts were plated on regeneration media plates containing acetamide as sole nitrogen source and incubated at 25° C. for 4-6 days.

Transformation of the fragments to *P. chrysogenum* resulted in the in vivo homologous recombination of the pDSM-YN2 fragment and the linearized fragment containing the xlnA-CAS9 expression cassette and amdS. A circular plasmid was formed able to survive in the cell due to the AMA1 sequences and the selection for the amdS marker. The marker-free donor DNA cassette with 1 kb homology to the 3'- and 5'-flanking regions of pks17 and in vitro synthesized sgRNA targeting pks17 were simultaneously added to the protoplasts and the expression of Cas9 was induced by plating the protoplasts on acetamide selection medium containing 20 g/l D-xylose, in which the xlnA promoter was shown to lead to high expression (data not shown). In total 20 out of the 88 colonies (23%) of the DS17690 strain clearly showed a white phenotype. Many of the green colonies were clearly mixed populations, and presumably contained also the white mutant. Indeed, all white colonies incorporated the marker-free donor DNA confirmed by colony PCR. The results showed that the CRISPR-Cas system in combination with donor DNA was also functional enabling marker free deletion of the Pks17 ORF when in vitro transcribed and produced gRNA was used.

REFERENCES

Aleksenko and Clutterbuck. Fungal Genet. Biol. 1997 21: 373-397. Autonomous plasmid replication in *Aspergillus nidulans*: AMA1 and MATE elements.
Barnes et al., siRNA as a molecular tool for use in *Aspergillus niger* (2008) Biotechnology Letters 30 (5): 885-890.
Becker and Guarente, In Abelson, J. N. and Simon, M. I., editors, Guide to Yeast Genetics and Molecular Biology, Methods in Enzymology, Volume 194, 182-187, Academic Press, Inc., New York.
Beetham P R, Kipp P B, Sawycky X L, Arntzen C J and May G D. PNAS 1999, 96, 8774-8778. A tool for functional plant genomics: Chimeric RNA/DNA oligonucleotides cause in vivo gene-specific mutations.
Cantoral et al., 1987 Bio/Technol. 5, 494-497 Christianson T W, Sikorski R S, Dante M, Shero J H, Hieter P. Gene. 1992 Jan. 2; 110(1):119-22. Multifunctional yeast high-copy-number shuttle vectors.
Crook N C, Schmitz A C, Alper H S. ACS Synth Biol. 2014 16; 3(5):307-13. Optimization of a yeast RNA interference system for controlling gene expression and enabling rapid metabolic engineering.
DiCarlo J E, Norville J E, Mali P, Rios X, Aach J, Church G M. Nucleic Acids Res. 2013 April; 41(7):4336-43. Genome engineering in *Saccharomyces cerevisiae* using CRISPR-Cas systems.
Dong C, Beetham P, Vincent K and Sharp P. 2006 Plant Cell Rep 25: 457-465. Oligonucleotide-directed gene repair in wheat using a transient plasmid repair assay system.
Durai S, Mani M, Kandavelou K, Wu J, Porteus M, Chandrasegaran S. Nucleic Acids Res 2005 33 (18): 5978-90. Zinc finger nucleases: custom-designed molecular scissors for genome engineering of plant and mammalian cells.
Gaj T, Gersbach, C and Barbas C. Trends in Biotechnology, 2013, Vol. 31, No. 7 397-405. ZFN, TALEN, and CRISPR/Cas-based methods for genome engineering.
Gao Y and Zhao Y. J Integr Plant Biol. 2014 April; 56(4): 343-9. Self-processing of ribozyme-flanked RNAs into guide RNAs in vitro and in vivo for CRISPR-mediated genome editing.
Gietz R D, Woods R A. Methods Enzymol. 2002; 350:87-96. Transformation of yeast by lithium acetate/single-stranded carrier DNA/polyethylene glycol method.
Goldstein, A. L., and McCusker, J. H. Yeast 1999. 15, 1541-15. Three new dominant drug resistance cassettes for gene disruption in *Saccharomyces cerevisiae*.
Guilinger J P, Thompson D B, Liu D R. Nat Biotechnol. 2014 577-582. Fusion of catalytically inactive Cas9 to FokI nuclease improves the specificity of genome modification.
Güldener, U., Heck, S., Fiedler, T., Beinhauer, J., and Hegemann, J. H. *Nucleic Acids Research* 1996. 24, 2519-2524. A new efficient gene disruption cassette for repeated use in budding yeast.
Hsu P D, Lander E S, Zhang F. Cell. 2014 Jun. 5; 157(6): 1262-78. Development and applications of CRISPR-Cas9 for genome engineering.
Ito et al., 1983, Journal of Bacteriology 153: 163.
Jacobs J Z, Ciccaglione K M, Tournier V, Zaratiegui M. Nat Commun. 2014 Oct. 29; 5:5344. Implementation of the CRISPR-Cas9 system in fission yeast.
Jinek M, Chylinski K, Fonfara I, Hauer M, Doudna J A, Charpentier E. Science. A programmable dual-RNA-guided DNA endonuclease in adaptive bacterial immunity. 2012 Aug. 17; 337(6096):816-21
Jorgensen T R, Park J, Arentshorst M, van Welzen A M, Lamers G, Vankuyk P A, Damveld R A, van den Hondel C A, Nielsen K F, Frisvad J C, Ram A F. Fungal Genet Biol. 2011 May; 48(5):544-53. The molecular and genetic basis of conidial pigmentation in *Aspergillus niger*.
Kornberg R. Trends in Cell Biology 1999 9 (12): M46 Eukaryotic transcriptional control.
Kuijpers et al. Microbial Cell Factories 2013, 12:47. A versatile, efficient strategy for assembly of multi-fragment expression vectors in *Saccharomyces cerevisiae* using 60 bp synthetic recombination sequences.
Larson, M. H.; Gilbert, L. A.; Wang, X; Lim, W. A.; Weissman, J. S.; Qi, L. S. Nature Protocols 2013 8 (11)

2180-96. CRISPR interference (CRISPRi) for sequence-specific control of gene expression.

Lööke M, Kristjuhan K, Kristjuhan A. Biotechniques. 2011 May; 50(5):325-8. Extraction of genomic DNA from yeasts for PCR-based applications.

Mali P, Yang L, Esvelt K M, Aach J, Guell M, DiCarlo J E, Norville J E, Church G M. Science. 2013 Feb. 15; 339(6121):823-6. RNA-guided human genome engineering via Cas9.

Marck C, Kachouri-Lafond R, Lafontaine I, Westhof E, Dujon B, Grosjean H. Nucleic Acids Res. 2006 Apr. 5; 34(6):1816-35. The RNA polymerase Iii-dependent family of genes in hemiascomycetes: comparative RNomics, decoding strategies, transcription and evolutionary implications.

Mouyna I, Henry C, Doering T L, Latge J P. FEMS Microbiol Lett. 2004 Aug. 15; 237(2):317-24. Gene silencing with RNA interference in the human pathogenic fungus *Aspergillus fumigatus*.

Nakamura, Y., et al. Nucl. Acids Res. 2000 28:292. Codon usage tabulated from the international DNA sequence databases: status for the year 2000.

Oliveira et al., Efficient cloning system for construction of gene silencing vectors in *Aspergillus niger* (2008) Appl. Microbiol. and Biotechnol. 80 (5): 917-924.

Ran F A, Hsu P D, Lin C Y, Gootenberg J S, Konermann S, Trevino A E, Scott D A, Inoue A, Matoba S, Zhang Y, Zhang F. Cell 2013 154, 1380-1389. Double nicking by RNA-guided CRISPR Cas9 for enhanced genome editing specificity.

Sander J D, Joung J K. Nat Biotechnol. 2014 April; 32(4): 347-55. doi: 10.1038/nbt.2842. Epub 2014 Mar. 2. CRISPR-Cas systems for editing, regulating and targeting genomes.

Sikorski R S, Hieter P. Genetics. 1989 May; 122(1):19-27. A system of shuttle vectors and yeast host strains designed for efficient manipulation of DNA in *Saccharomyces cerevisiae*.

Snoek et al. (2009) Fungal Genetics and Biology 46, 418-426

Ryan O W, Skerker J M, Maurer M J, Li X, Tsai J C, Poddar S, Lee M E, DeLoache W, Dueber J E, Arkin A P, Cate J H. Elife. 2014. 19; 3. 03703.

Tsai S Q, Wyvekens N, Khayter C, et al. Nat Biotechnol. 2014 32(6):569-576. Dimeric CRISPR RNA-guided FokI nucleases for highly specific genome editing.

Verdoes, J. C. et al. Characterization of an efficient gene cloning strategy for *Aspergillus niger* based on an autonomously replicating plasmid: cloning of the nicBgene of *A. niger*. Gene 1994, 146:159-165

Wah, D. A.; J. Bitinaite, Schildkraut, I., Aggarwal, A. K. Proc Natl Acad Sci USA 1998 95 (18): 10564-9. Structure of FokI has implications for DNA cleavage.

Weber et al. (2011) A Modular Cloning System for Standardized Assembly of Multigene Constructs. www.plosone.org 1 Feb. 2011|Volume 6|Issue 2|e16765

Zhang G, Kong I I, Kim H, Liu J, Cate J H, Jin Y S. Appl Environ Microbiol. 2014 Dec. 15; 80(24):7694-701. doi: 10.1128/AEM.02310-14. Epub 2014 Oct. 3. Construction of a quadruple auxotrophic mutant of an industrial polyploidy *Saccharomyces cerevisiae* using RNA-guided Cas9 nuclease.

Zhao et al, webpage info 2013-2014: Web page: labs.biology.ucsd.edu/zhao/CRISPR_web/RGR_design_home_frame_set.html

SEQUENCE LISTING (251 sequences)

SEQ ID NO: 1 - DNA, 34023457 bp, Aspergillus niger CBS 513.88 (residues 1-2,126,467 of 34,023,457)
  misc_feature (44288)..(44288): n is a, c, g, or t
  misc_feature (155272)..(155272): n is a, c, g, or t
  misc_feature (204666)..(204666): n is a, c, g, or t
  misc_feature (204692)..(204692): n is a, c, g, or t
  misc_feature (204710)..(204710): n is a, c, g, or t
  misc_feature (204969)..(204969): n is a, c, g, or t
  misc_feature (272073)..(272073): n is a, c, g, or t
  misc_feature (353582)..(353582): n is a, c, g, or t
  misc_feature (353617)..(353617): n is a, c, g, or t
  misc_feature (353648)..(353648): n is a, c, g, or t
  misc_feature (492428)..(492428): n is a, c, g, or t
  misc_feature (536235)..(536235): n is a, c, g, or t
  misc_feature (545939)..(545939): n is a, c, g, or t
  misc_feature (576552)..(576552): n is a, c, g, or t
  misc_feature (897515)..(897515): n is a, c, g, or t
  misc_feature (1474394)..(1474394): n is a, c, g, or t
  misc_feature (1474413)..(1474413): n is a, c, g, or t
  misc_feature (2211250)..(2211250): n is a, c, g, or t
  misc_feature (2211257)..(2211257): n is a, c, g, or t
  misc_feature (2211262)..(2211262): n is a, c, g, or t
  misc_feature (2211273)..(2211273): n is a, c, g, or t
  misc_feature (2211340)..(2211340): n is a, c, g, or t
  misc_feature (2211351)..(2211351): n is a, c, g, or t
  misc_feature (2211362)..(2211362): n is a, c, g, or t
  misc_feature (2211366)..(2211366): n is a, c, g, or t
  misc_feature (2240253)..(2240253): n is a, c, g, or t
  misc_feature (3211430)..(3211430): n is a, c, g, or t
  misc_feature (3236949)..(3236949): n is a, c, g, or t
  misc_feature (3236971)..(3236971): n is a, c, g, or t
  misc_feature (3236974)..(3236974): n is a, c, g, or t
  misc_feature (3279330)..(3279330): n is a, c, g, or t
  misc_feature (3281470)..(3281470): n is a, c, g, or t
  misc_feature (3392636)..(3392636): n is a, c, g, or t
  misc_feature (3732237)..(3732237): n is a, c, g, or t
  misc_feature (5041781)..(5041781): n is a, c, g, or t
  misc_feature (5341902)..(5341902): n is a, c, g, or t
  misc_feature (5341936)..(5341936): n is a, c, g, or t
  misc_feature (5342071)..(5342071): n is a, c, g, or t
  misc_feature (5351253)..(5351253): n is a, c, g, or t
  misc_feature (5353905)..(5353905): n is a, c, g, or t
  misc_feature (5353957)..(5353957): n is a, c, g, or t
  misc_feature (5353992)..(5353992): n is a, c, g, or t
  misc_feature (5358550)..(5358550): n is a, c, g, or t
  misc_feature (5362032)..(5362032): n is a, c, g, or t
  misc_feature (5365780)..(5365780): n is a, c, g, or t
  misc_feature (5365950)..(5365950): n is a, c, g, or t
  misc_feature (5761519)..(5761519): n is a, c, g, or t
  misc_feature (5985404)..(5985404): n is a, c, g, or t
  misc_feature (6012602)..(6012602): n is a, c, g, or t
  misc_feature (6014761)..(6014761): n is a, c, g, or t
  misc_feature (6406250)..(6406250): n is a, c, g, or t
  misc_feature (6442329)..(6442329): n is a, c, g, or t
  misc_feature (6565980)..(6565980): n is a, c, g, or t
  misc_feature (6565998)..(6565998): n is a, c, g, or t
  misc_feature (6644910)..(6644910): n is a, c, g, or t
  misc_feature (6645360)..(6645360): n is a, c, g, or t
  misc_feature (6648073)..(6648073): n is a, c, g, or t
  misc_feature (6660134)..(6660134): n is a, c, g, or t
  misc_feature (6673420)..(6673420): n is a, c, g, or t
  misc_feature (6693683)..(6693683): n is a, c, g, or t
  misc_feature (7245096)..(7245096): n is a, c, g, or t
  misc_feature (7245209)..(7245209): n is a, c, g, or t
  misc_feature (7390252)..(7390252): n is a, c, g, or t
  misc_feature (7564123)..(7564123): n is a, c, g, or t
  misc_feature (7791179)..(7791179): n is a, c, g, or t
  misc_feature (7791329)..(7791329): n is a, c, g, or t
  misc_feature (7928208)..(7928208): n is a, c, g, or t
  misc_feature (8076596)..(8076596): n is a, c, g, or t
  misc_feature (8157973)..(8157973): n is a, c, g, or t
  misc_feature (8740123)..(8740123): n is a, c, g, or t
  misc_feature (8740163)..(8740163): n is a, c, g, or t
  misc_feature (8772652)..(8772652): n is a, c, g, or t
  misc_feature (9507873)..(9507873): n is a, c, g, or t
  misc_feature (11055132)..(11055132): n is a, c, g, or t
  misc_feature (11071349)..(11071349): n is a, c, g, or t
  misc_feature (11121800)..(11121800): n is a, c, g, or t
  misc_feature (11404221)..(11404221): n is a, c, g, or t
  misc_feature (11568789)..(11568789): n is a, c, g, or t
  misc_feature (11863540)..(11863540): n is a, c, g, or t
  misc_feature (11877402)..(11877402): n is a, c, g, or t
  misc_feature (11911481)..(11911481): n is a, c, g, or t
  misc_feature (11912752)..(11912752): n is a, c, g, or t
  misc_feature (11968951)..(11968951): n is a, c, g, or t
  misc_feature (12367370)..(12367370): n is a, c, g, or t
  misc_feature (12372065)..(12372065): n is a, c, g, or t
  misc_feature (12372965)..(12372965): n is a, c, g, or t
  misc_feature (12375656)..(12375656): n is a, c, g, or t
  misc_feature (12375703)..(12375703): n is a, c, g, or t
  misc_feature (12377954)..(12377954): n is a, c, g, or t
  misc_feature (12626090)..(12626090): n is a, c, g, or t
  misc_feature (13041044)..(13041044): n is a, c, g, or t
  misc_feature (13104777)..(13104777): n is a, c, g, or t
  misc_feature (13149455)..(13149455): n is a, c, g, or t
  misc_feature (13149505)..(13149505): n is a, c, g, or t
  misc_feature (13149655)..(13149655): n is a, c, g, or t
  misc_feature (13149817)..(13149817): n is a, c, g, or t
  misc_feature (13150087)..(13150087): n is a, c, g, or t
  misc_feature (13150168)..(13150168): n is a, c, g, or t
  misc_feature (13150579)..(13150579): n is a, c, g, or t
  misc_feature (13150589)..(13150589): n is a, c, g, or t
  misc_feature (13243052)..(13243052): n is a, c, g, or t
  misc_feature (13504900)..(13504900): n is a, c, g, or t
  misc_feature (14125556)..(14125556): n is a, c, g, or t
  misc_feature (14538858)..(14538858): n is a, c, g, or t
  misc_feature (14580213)..(14580213): n is a, c, g, or t
  misc_feature (14617561)..(14617561): n is a, c, g, or t
  misc_feature (15135229)..(15135229): n is a, c, g, or t
  misc_feature (15673700)..(15673700): n is a, c, g, or t
  misc_feature (15680214)..(15680214): n is a, c, g, or t
  misc_feature (15680253)..(15680253): n is a, c, g, or t
  misc_feature (15706397)..(15706397): n is a, c, g, or t
  misc_feature (15925206)..(15925206): n is a, c, g, or t
  misc_feature (16029110)..(16029110): n is a, c, g, or t
  misc_feature (16071114)..(16071114): n is a, c, g, or t
  misc_feature (16136527)..(16136527): n is a, c, g, or t
  misc_feature (16136560)..(16136560): n is a, c, g, or t
  misc_feature (16181131)..(16181131): n is a, c, g, or t
  misc_feature (16181211)..(16181211): n is a, c, g, or t
  misc_feature (16181216)..(16181216): n is a, c, g, or t
  misc_feature (16181254)..(16181254): n is a, c, g, or t
  misc_feature (16181526)..(16181526): n is a, c, g, or t
  misc_feature (17068554)..(17068554): n is a, c, g, or t
  misc_feature (17068589)..(17068589): n is a, c, g, or t
  misc_feature (17068613)..(17068613): n is a, c, g, or t
  misc_feature (17068629)..(17068629): n is a, c, g, or t
  misc_feature (17068675)..(17068675): n is a, c, g, or t
  misc_feature (17590013)..(17590013): n is a, c, g, or t
  misc_feature (17974213)..(17974213): n is a, c, g, or t
  misc_feature (17978856)..(17978856): n is a, c, g, or t
  misc_feature (18643930)..(18643930): n is a, c, g, or t
  misc_feature (19027505)..(19027505): n is a, c, g, or t
  misc_feature (19147250)..(19147250): n is a, c, g, or t
  misc_feature (19179931)..(19179931): n is a, c, g, or t
  misc_feature (19349554)..(19349554): n is a, c, g, or t
  misc_feature (19655816)..(19655816): n is a, c, g, or t
  misc_feature (20110664)..(20110731): n is a, c, g, or t
  misc_feature (20110737)..(20110737): n is a, c, g, or t
  misc_feature (20110739)..(20110739): n is a, c, g, or t
  misc_feature (20110808)..(20110808): n is a, c, g, or t
  misc_feature (20299836)..(20299836): n is a, c, g, or t
  misc_feature (20320503)..(20320503): n is a, c, g, or t
  misc_feature (20320539)..(20320539): n is a, c, g, or t
  misc_feature (20339923)..(20339923): n is a, c, g, or t
  misc_feature (20588046)..(20588046): n is a, c, g, or t
  misc_feature (20948568)..(20948568): n is a, c, g, or t
  misc_feature (20948647)..(20948647): n is a, c, g, or t
  misc_feature (21058040)..(21058040): n is a, c, g, or t
  misc_feature (22258653)..(22258654): n is a, c, g, or t
  misc_feature (22415976)..(22415976): n is a, c, g, or t
  misc_feature (22640314)..(22640314): n is a, c, g, or t
  misc_feature (23378009)..(23378009): n is a, c, g, or t
  misc_feature (23433651)..(23433651): n is a, c, g, or t
  misc_feature (23436512)..(23436512): n is a, c, g, or t
  misc_feature (23437393)..(23437393): n is a, c, g, or t
  misc_feature (23437633)..(23437633): n is a, c, g, or t
  misc_feature (23449914)..(23449914): n is a, c, g, or t
  misc_feature (23462439)..(23462439): n is a, c, g, or t
  misc_feature (23463544)..(23463544): n is a, c, g, or t
  misc_feature (23465687)..(23465687): n is a, c, g, or t
  misc_feature (23465828)..(23465828): n is a, c, g, or t
  misc_feature (23465841)..(23465841): n is a, c, g, or t
  misc_feature (23469523)..(23469523): n is a, c, g, or t
  misc_feature (23504436)..(23504436): n is a, c, g, or t
  misc_feature (23504463)..(23504463): n is a, c, g, or t
  misc_feature (23867695)..(23867695): n is a, c, g, or t
  misc_feature (23867705)..(23867705): n is a, c, g, or t
  misc_feature (23867737)..(23867737): n is a, c, g, or t
  misc_feature (23867760)..(23867760): n is a, c, g, or t
  misc_feature (23867855)..(23867855): n is a, c, g, or t
  misc_feature (24835306)..(24835306): n is a, c, g, or t
  misc_feature (25027966)..(25027966): n is a, c, g, or t
  misc_feature (25330363)..(25330363): n is a, c, g, or t
  misc_feature (25817596)..(25817596): n is a, c, g, or t
  misc_feature (26235308)..(26235308): n is a, c, g, or t
  misc_feature (26235623)..(26235623): n is a, c, g, or t
  misc_feature (26296953)..(26296953): n is a, c, g, or t
  misc_feature (26315317)..(26315317): n is a, c, g, or t
  misc_feature (26315331)..(26315331): n is a, c, g, or t
  misc_feature (26603609)..(26603609): n is a, c, g, or t
  misc_feature (26608927)..(26608927): n is a, c, g, or t
  misc_feature (27099287)..(27099287): n is a, c, g, or t
  misc_feature (27101717)..(27101717): n is a, c, g, or t
  misc_feature (27129691)..(27129691): n is a, c, g, or t
  misc_feature (27130274)..(27130274): n is a, c, g, or t
  misc_feature (27147663)..(27147663): n is a, c, g, or t
  misc_feature (27172978)..(27172978): n is a, c, g, or t
  misc_feature (27172997)..(27172997): n is a, c, g, or t
  misc_feature (27173006)..(27173006): n is a, c, g, or t
  misc_feature (27173639)..(27173639): n is a, c, g, or t
  misc_feature (27491488)..(27491488): n is a, c, g, or t
  misc_feature (27527882)..(27527882): n is a, c, g, or t
  misc_feature (27595100)..(27595100): n is a, c, g, or t
  misc_feature (27620372)..(27620372): n is a, c, g, or t
  misc_feature (29653195)..(29653195): n is a, c, g, or t
  misc_feature (29653379)..(29653379): n is a, c, g, or t
  misc_feature (29681499)..(29681499): n is a, c, g, or t
  misc_feature (29708368)..(29708368): n is a, c, g, or t
  misc_feature (29723415)..(29723415): n is a, c, g, or t
  misc_feature (29761631)..(29761632): n is a, c, g, or t
  misc_feature (29761708)..(29761708): n is a, c, g, or t
  misc_feature (30422934)..(30422934): n is a, c, g, or t
  misc_feature (30914321)..(30914321): n is a, c, g, or t
  misc_feature (31202086)..(31202086): n is a, c, g, or t
  misc_feature (31452777)..(31452777): n is a, c, g, or t
  misc_feature (31487666)..(31487666): n is a, c, g, or t
  misc_feature (31487741)..(31487741): n is a, c, g, or t
  misc_feature (31533626)..(31533626): n is a, c, g, or t
  misc_feature (31543898)..(31543898): n is a, c, g, or t
  misc_feature (31546005)..(31546005): n is a, c, g, or t
  misc_feature (31548816)..(31548816): n is a, c, g, or t
  misc_feature (31787390)..(31787390): n is a, c, g, or t
  misc_feature (32267261)..(32267261): n is a, c, g, or t
  misc_feature (32709153)..(32709153): n is a, c, g, or t
  misc_feature (32871693)..(32871693): n is a, c, g, or t
  misc_feature (33981746)..(33981746): n is a, c, g, or t
  misc_feature (33981774)..(33981774): n is a, c, g, or t
  misc_feature (33981781)..(33981781): n is a, c, g, or t
gatcatacaaatcatccccttggcctctgttagccttctgcgatctatcgtgctcggagcagctgcaagccccgccaagtgacaatccgaaacggactcaataagatttggcgttgtcgacttcatttcagttccgccgaccttccagctgcagctatcgactgtcgaagccgaccctccacgagtcaaacagattggaaacgataataaaccgatctcccgagataagaatggcgctttggtcaaacatgaaggcgtgagtgaacactctgctgacttcatgtaagtgaggagaatatcgctaaatgtgatacggacatgacattagacttgcaacagaaagaataatacatgcaggtccgagatgaacaacgagacaaaccttgtgtggtgctcaacatagtttgctaatagaaacgtgattgaccgtcacatggctccttgactgtctagatacatccggctgatcatactttgttctagtgtatccatgacggagaaaagtgcatttatgatttttatgatcgatctgttgaatgccaataggcacttgcggctggccggcggaattggaaaggagcaggtagcactcaacatcagaggtgtaacaaccagcgaacccattcaacgttggagtcatttattgtttatctccgctctagtttcagtttcctctcgcgacttgcttgtttgtatctgagtaagcacccgataataaagtagttgtcatcactggcttgaaaaatcaaacaattactcgcatctcgcgagaaagaacagactgctcgtaacaagcaagcaaacgccaagctcttattcagataacattactggatccccttctgctatctgatttatttagtgactggtcccgggcccgaagccgccaccctgtgccacctcattttaagcgggaggtcgtaacgctcgggctcaattctctgttcaagaacgcccctaaggccaatcgacagccgccaaacagtgcagcctggatggcggtctgaccagggacactgagtataaatgaatcctggagccgtctatgtaggccacgtcacaagccttataaccacctcaagttggactggatatcaatgatccggatccagtcctttgctcaacacccttagaacaaatttatagttgtcaagcagtgttgcctgggtggcagtcccatcgggggcattgggtgatgaatacttcgtaaaacccatcatactgctacaccacgagcttgtcagacctgtggccttccaatgttcacgaaatgccataccaccatcatagcaatatgcagcagtattccgaggctttgctcgcttccttaccagaaggtggtaatgagcaagtccctgttaacgctgctggtttaggttgggaggaagttcgtcaagaagctagccggggaaacatcagttaactgcgttcggtggccggcaacagagtctggatcaccgccgacagatactgcactgtcggggatggagtggacagcctgaaaggatacttgcacggcatttggcatgtatactaccaggcaggtaggtacctgtcgcatgagagtcctgggcatgatgcgattgtcctggacatcctccgcattcagggcaaaggcccgctatccaggccagtaagaggggcacttggtgttggtgtggcaagggaccgaaatgtctaatttagaaaggcctccccttttccgtgttggacatggtggaattctggatcaacgggttcgtgacaatgtctgggacccagcggcttaatttgtcctccttcgctaaagtggcctcaactcgcgactacatggatggactctgccagattgccccctttctgttccgcgctactttggagaatgaaaatagagatctccgctccgttaatgagtccgacgccgaagacccaatacgcgcgatgaaccggctttcaatggtggatgttctggctgaagcagctccatgagatcaaagaagcaaaacagggaggagacaataaacttgcagaggatgtcgcagacgctattgataggatgatgtatcatgcggaggagctaaactcgcatgtgttgagagtgtatgagtctggtggaccggctctgcatgaagatagacatctgttgtgcctgaagaagttgttgaggtcacaaggggacgacgacgtggaagaggaacaggggaggaaggcgaagagaaggctgacatcaatgagaaggtggacagagagagtacggtgggtaaggactctgttcaggattgctccctcctatgttgtattgattctcccttccaactctgccgtgccttgatgccgtcacagcttcctggagggtcaatagtacatgatatgtgcgtcttctcctgagtcagcatgcgcaattatgccaaactcgataatatatcttgcggccctagagttctcagtccttgattgatcaagtggtgacaaaagggttgacttctgtctctgtgacaaccatatacgtttggatacatcgcggggcgcgcaactcggaagagaggggtcaccgcctagtattaaaaagccctcatttcaatcacaaaccttgtcttacaccgtgggtttgttttactgtaactcagtagtctgtcctgatacttatacataggcgcttcacataaatggagtactctaagccagattcgacaggaggaacttagtatggctggatggatacccaatcgagtgggcggtaccgaagtcctgagaaagttgatccccaccagccggcggggaaaagaagacgaagaaaaggaaaagaatgcacgtattacatgatatcagcattgtgcgaattgtcgcctctttcacctctttcctcaacctgaaatcaagaaccccttaacatgccgacagagctagaagaggtaggtagaaccacgcttttgactgtaagaaagtcttgggtcctcgattcggagactgatgtatttgcatcaaccagcttgttgaattcctccaccatggaaacacaccgatcagacagattggtaagctgcagattgcttagacttttgctgctaaaccgcatgtttctgctatcttcatctcccgcattctgccgagacatacatcagcgttattctaacctctggtcttttcagcatgcgaaaatctagtcggcttttcggtctcacagccggaactcttcaaacgccaccagcttctaccagtccgtgacttgaagcttttggtccgcgactacacagtcagtaacccaagtccttcaattgtgccgttaaacattgacggaggcattcgctgaccatcttcccataccgaaagcctatcgccaaaaatgcgataacaatacttatcaacctttcagccgatgaggaagtcttagcggctcttgccgaagacgatgcttttgtcgaaactcttttagtcaaactggcggtgagttgctgaattgatgttaatgtctgcatacctgcctaacatccaacttcgcagaatgtcaaggagccgaatgcggatgatgtcgccatgttgtttgccaaccttgcgaaatcagaaaagatgaagaaattgttcacgctgaaacggaaggttccagagggggtatccagttctgctaatgcgatcgatcagctgatggactgttttgttaaaggagccgagggcgcacttaacaaacacgccaatttcgactatctgtcatatttgtttgctgatctctcgaaatatgaggaagggcgggcctacttcactacaaaacaagagtacgatgatgttgtaccagtgacgaaactaaccgtgttcacggaacatacgagtgggatccggagaaaaggtgtcgcgtcaactatcaagaacgttgcatttgacctacctttccatcccaaactcctgtccgaagatgaggctgatattcttccctatatcttgttgcctatcatgggccctgaggaatatgatgaggaagaatctatggatatgctgccagatctccagctgctgccgcccgacaaacaaagagacagcgacactagtatcattgtgacacaccttgagactctgctgctgcttaccacgacgcgtgaaggacgggataagatgagggccatcaaagtatatcctataatccgagaatgtcacctccatgttgatgacgacgctgttcgggaagcctgcgataggctagttcaagttttgatgcgggatgaagagggcgaagaaaagccgcatccgcctatcgacagaaatgcatatgatgacgaccaaaaggttgaggagctattttaagattctgcatcgcgaaaggtgcgaatgtgtcgtgaggcatttaggagcccataccatagaccagcctaggggcctttatacaaaattctaaagacgttttcaaaattgagcttttcaattcgtctcggtaatgaagtaaattcggtgcttgggcaggcacgaattctattctcagtggcgcttttaccagactgaaatctagtcaaaaagttatttactggttagacagatgcatttgtttgcgtcgttaccaaagctatatgactcaccttttatgaccagcctgtttgccccaagcatttttttgacccacagaatatgtcagaccgaaaactttaccatagccttcatagataatgctgtccgctttgtattcagtacttcaattgtatgtgagtactagtacaatcctgcagagagaagcctacctcaaataatcagaataaatacaagataagtcttctactgtgatctcagctcttccattgatctatctaccagacatagtgatggtgtgaaggatggctgaaataattctttaatctgtcctggcctgggtagaaggtaattcagatagtaataataagaactcattgacactatgaaggcccacaacttgagttaatttccgtaaaaatacaacgtagcccacaatatggcattctgtgagcagtggtaacaccagacggagtatgccgttgtgcctttgtcacgccgccacctttgtcaacgaagtagttgatcacttacataatcacgttcacttcacttcagtcatctcgcgtccgcccggcttcacttcagtactcaacgcctgagtagttatctactcttgctcaaaatcctaatcttccacctgatacaacgcatgtattcgaccctggcctcaagcgcaacacttgcagccttttagccactttgtctggaagatttgctaagggcttctccgacctcgacgagtaacacaaaacgttatcatgaccacacctactaatgatcagactctcaagaccccgacggggtcgaacggtcctccaccagtgcggattcgccggccaaaagtggcggatcccctcgtgcgaccaaagaggagaccggcaataagacccccagctcctacctcggcagcaaacggcgcatcaaggatgcctaactcaagaccagtcacttcaagccagctaccaggggctcgcgtcgagaaaagcctgaacccgaagaatgatttttcggcaaacggattcagcggcccgttgttgtctgagaattacgttgattaccccatcgtgactacaagacgagcattgcgcgaaggcttgaagcaccatatcgccaggttcacctcgaaaaagtccgtcgatcctcgcgatgaaagtcagtttactcgccctgttaggctccagcgccgagatccacgagcacggccgaatgaagcacacgttgagagaggccagctcaattcgaaacccggctccgaacaaagcacccagatggacgaacttgaacgcgaggagttggaggctaggaaagcagctcgtgaaaaggagcgcgcagagaacatggcccaaatagctccttccgtcggatcagcgccgaaaaggcataatgcccccaaacagaaaactcagcaagtgactaaaacagacatgaccccagaggagatagccaggactcggatcaagtatgaggaggcccttccatggcacttggaggattttgacaacaaaaatatatgggtaggaaattatgaagccgcgttgtcagagacccacgcagtctttgtgcttgagaatacagggaagatgagaatgataccggttgagaagtggtatcgcttcagtgcgaagaatacattcaaggctttgaccatagaagaagccgagagacttatggctaagaagatcaaagatccgcggtggtttatggagaaacaacaagaacaagctcaacgaaaggaactggaacaatttgccaggcaacaaaaagtgtacgctggtaaacagggaaccccaggcggtgtcgaagggttagaagcggatgagatggacttcgaagaggataggtttgccgatgatgaggagcatgatgatctttttaacgaggatgaggaagccaaggccgctgaaaagcgaatcaagcaagaccaactgaaagccaatgtgttcgatctgaagaacgaaaaggactacgaagaggaggaacttagagaaaaaagagagaaagaagctcgccgagtgcttggaaagaaagtacgcaaggctcttcagaagagggaaaagaactatgactatagtagcggttcagatgtgaacccttattcagatgaggaggtaatttcttcctcctttccccgtatcctatgtgcatttgtacgatatttgggacgatctgacatttttgacagagctcggacgaaagtgaagctgaacggcagaaggaggaagagggcaaagttgaggaggataagagcaagaaagaaccctcaaaaggcaaccttactccatcaggtcgcttacgacacgccgatccggccaaaaaaggctctgccgcagcacctaggaagcggctagggtctccgtctgatgcaagtggtacagatacgtcccgcaagaaggggaagagtaaacatccgtcttcccaacccacacgacatcccgactggaagcgagatgaacctgcataggcacctcgtccttgcgctggaaggtgttttcgaaatcaagataggctccacggtacaagaattgactggtgacgtgcatgataggctgaccatctctttcaattgtaccgcagacttcaaccatcttgccggattcctggttaatgacagcgttgatttgagcagtagtatccagaacatccccgaccttgagaggctgagctccagggaccatcttgaaaccattcgaaagatgaaccagcttcagaagatcaccatcaatggtgcgtgggaagataggcttagtgattgcctgccaaccagcaacaatagcaaagtccatgggagcatagacctctttaccgggacggtcgacaaaggcttcgccagtgttaccgactgcatgaacgaaatcagcaacggcttgggacgtaatagtggtacgcccgccgctgaaagtggccgtggtgggcgtatcaaatggaacatccttgttgccaaaccacacgcggtagtagaactccttgatgcggtcattgcggccgtccatgacctcacggatgggagcgtagcctgcgtcgggatgatatgtgaacaagaaagtcaacggcacaacaccggcctcggcagttcgtccttcatacatagtaaagctgatttggctctgctcgttcatcttcacctcgactgtcttgacaagcttgccggactgatatggttctctcaagatgatagttgtcttggaaggatcatccgggaaagaaacttcaacatacatacccggaacgggcgcgacaatccgtttcatcgggttagtctggaaacgatggccttggacgaaaacatcggctaagaacatggcatgccgccaggaatatgacggaccagcaaggagacgcaaccaacggtccaagtccggcaggtcagcggtaggtgaggaggacaagcggtagctgaccttgttagcgtcttctgagatggtgagaccgtcaatgtccgaatcatcaacttcctgctggaaacggcccccgaagtattcgataacaggcactccgctattatcgccgccgtagacatccttgatcaggctttcaatatgaccttgatgaatcccattcaggatgtccgcaactggctcgtcaataatgttcgagaacttggcagccatcgggccctgcaggatacaggttctaccaacatcctgaccaacaaccgcctcaaggtcttcgctctgccacagggaatccttcttgaaccagtactcgaagttttcatccagagaggggacgaatggcactggtttttgaccgcgccgctggcagagcaagaggaagtgctgtacatcttgagcgttgatcaactgagatgccgcttctggataggaagccaggatgttgtcaatggctgggtacggtgtgttgagctccgagtagttttgaagcagagacggttggccctcagtagtggtgaatctttcttcaactcgacggataaaatcgccggtcagcttcttcaaagattcatcaatccatctactctcatgtttgacatacatgaggtcaaccatgcggtgaaccacttcagtgtaagtcatgtcttccaggtcgactgtctctccggcagcgttgcgaccgaaccaaaccttctggaaatcgtcgttgagcttttggatgatgtagttccgaagcttcttgagctcggggacacgctttgccttgtcaagcttgaagatcttctggtccatttcatgccagaacagaacacctcgagtggccaacttgtgaataggctcacccatctccgaaagtacagtgacaacaccacctgccgagcccttgtaagtcttttcccagtccttgtcgtcaagacccggagcctcggcgatggccttcttagcgttcttggatgtatgcgcttctttggaaatcatcatccgactaccgaaaaggcatccatcaaaaggcataggcgggtaaccaaagccagaagaccaggtaccggacaggtaaggataggtatcctccgagccgccgaaaccgctgccagcaaccagaacgatattctcgcagcgcctgatgcggctatacatctgcaagattggctggtggaaatcttcaaaggagtggtgtccaccaccacgtccaccggtccactgcaggatgataggaaacttcgggttagcctttgcgatattgatgacttgctgaattgcatcgacggagcccggcttgaaggcgatgtgcttgatacccagtgtttcaatgtactcgttggccacttcgatagacggcacaccggcaccgatggtcaatccttcaattggcacgccctcagccctcagcctgccaatcagaggaatctgccaagccatagcccgggggttaacataaatcaggttgattgtaataccacgaccagggggaatcgccttttcaatcttgttgacggcctcggtcattgatttggcattgtaataaccaccaccagcaagctcaatatgatagcctgcgttcatggtcgcagcaacaaaatcccatggaacagtggttggagtcattccggcaaccatgatgggagggatgcctaacagtcgactcatcttggtatcaacgaaggtttgccccactgcgttcttcacgagacgtggtccatattccttaacccagtcaatggcatactgaacggattgctcatcgcggtcgaagagctcaggcttgtagccaacttcggcgttggtgccatccatagcaccagcaagcaccacgcggacacctgtaccatccttgttgcggtttgtaagaactccaagaccggagatgccaccaggtccaaagtcaacaatatgcgtggcccctgagaagacagttgcctgctcccaattaacagcgtcgtgagtgatcattcgaaccagggcggggacgacattagcttcaccggacttgctcagatcactgccagatttcgtatcgaaaaccggaattgcgagggactcagcagggatctcaatgtcttcaaggtcttccagaatccgatcatatgccgggtataagtactggctgtggaatggagcggtgataggaaggaaccggttaacgaagcgaactttacgttgggtgtagggcacccggttttggtccagacctgtcagcgccttgaccttgcgcaagcgcaagttgagaccgtaaagagagagaggcggtccagtgacaacgaaattccgagcactgttaacaagcgaaatggaaatatggcgatcctccggcagatgctggttcgtagtgtcaatgtgttcctgaacggcggatcttgggaggtctcggatggataacataggcgtaggcgtgccttccccgttttcgatcgaatcctgaaggacagacggggcaatggaagtgcgaggataggcctgttgactgcggagaccaatccagaaaagcatcgtcaaggcattcttggcggccttgtcgaaactctcccaagtagaggcagatgcaattgctgcagctgttacaacgccctgagaatggccagtggttccactgaacctttccagaagctcgccgggtgttttacccaggaccttgcaggtcacaacaaagtgcgccagctgaaccaatccgatcaacggcaagctcaccggggccgacacaaggtagtcggtgtcgggctgagagtcacgatcctgaagccattgcatgatatccaatcccttggaataaagtttgctggcttccggctcatgggagagactctgcagcaattccgcagatgaagtaataagatcgtcgacaaaagaagggtaggtggtgtagatttccctcagttcatcaaagtactcttcaatattcccctgtcctccgaaaaccgagtagatgctcgccttctcttccgaggcagctcggaacaatgcagagtcgtagggcttaagggggcgaccaactgctgttctcccagcgtaataagcctgaacaaccgtaaccttcttggcggtaatgccgggtaggctggcagcaacagcgtggacgtcattgcctctcataaaggcgcgttcaaactcgttcagagccagcttcagaacgtccacataagttccactcgcatcatcctcgccttcttcaacttcatgtgcaacatgtccgatgtatctggccaccagttccggaactgaggaaggctcatcgtcctgagcaagctcgtccgtcggctgtggtaaagaagctgtaaaggtatccttcaattgcgacgcatggaaatgaagagaggtcggcacaaggaaggaaaattcgagcgacccatgtgtgagaataaggggcctcaatgactgtgacgagcgaggggtattaatgcccgtctgggggccagtggatgttccatacatctcgtggtctcgtgtatgtctctattggtttggtctggggtaacgcaattggaaagccaagaaatggcgaaggtattatcaacaaggatatatcgagagactctgttatggataagcgttatgcaagatcctagtaaatttcgagcgagaaataaaattgcaatggcaaggctctgattgatgggagaggaaaggcacttgcggggaaggaatccggaacgcgaccacttttttctttcagggaggggagtgcaaaagtagagtgaaggttatgaaaattagaacaactgttcccggggatcctacctaattctatcacaaatgggtctttttttcgaacaatacttgatcaagcctggccgagtgtcatcggctggtccaccgtccaccgatgaaaagatagcggtgtaatggagttataggcaggttttagaggggggggaagtattacaatatggaaaaaatggtaaaatagatctgaagaacaaaatgaagaaggatcacaatagaagggaaaaaagggagagaaggaaggtggactggtacagactggagtggacggggtgaaccagaccttaattggcaaaaaaaaaagctgttcaccacatccaggcgatattttattattacacgtgcagagataggtgtggcactcacacacgctgcccacacaaccagcaccacaaccacaacacactctgttgaaccggccgagcggaggcagaattccgccggcttgggctggttgaatgggaactgaccggattaggtatggtgggcaagaggatctccccaaaggtccaaaatggttgggctggcccgtagggttggatatgacaatacctgaccaccaatgtaccctcccactctacccgggttcgtcaagtaagtactctgataaatacgtatctatctatatattatgcatcatatctccaacgcctgcctgcagcaacgaagtgtgtggtatgtaggtagtatataatgatgtcgaaatagtagcgattgtagtggttgtagtagcattaaggtagcgtatctacctgcattacatgtataccttgcattctgaaagggaaagaaaaataatcatagtagagctctcaaagacccagctactacatagacgtttcgaggcctacatccatggccatataggcacaccgtagtctacataaagatatataatatgctaagacgaaagtattgcttccttcataacgcatacttgaagtgtatctagcccgttcctagcctgaacggagtctcttgtgctgctctcatctttattacttatgcaaggacgtctactgggaaatggggacccaggatcggtttaactgtaatgggccaatcaatactgctcaaatgctatcttagtactcacaaaccttgacgagtggcatatatagtaaagtagttggtcaatgaagtacttccgtggtacactgttgtaaatgatcgctaagctgtcactggttgagggtttccgtttcatacttgtgaagccaagatgtagttagtgctgctacgcatttcccaaccattaccatctaatcaactccaagaattcctaaacaaaggttgatttccagacttgagataatatggaaagccagaaaatgctgctgattgactataacaaaggcacctacatgtaacatgctttggatatacctagaattttagagactatactttgtatacgtggagatcaggtatcagctaagtcatttattacgcgtgggtaagaagaaaaaaaacttacagagccaggttagctcaacttatgatttggtttatcaccaacttccatatttccgtttatcatagttattattattattatcatgagctcccattggaggggagaagacgttctaccctgttccattccaatttcaatggctgtttccatgagtgttccccaaaacgtccctactggagtgcatccatactccgtactccgtaccgcacgaaagtaatctcccgccccaacactcaccaaaagcttctagtccaaaatcccatccacccataactgtaagccctcttctgtcggtgcatagatacctagtttcttccaatctcccttttcgtctaatagaattcattattttactactttattttttttattgagtttttttgtcctctatcccatccacttttctttgggacatctcgggcccagggcatcggcgaattctccccaccgccagtggctccaggctggggtgagtactcttaattcccacctctaacaactttttttcccttccgttccagcatcttttttccgctggctggttgtatgtgcggttcaaccaggagccaggaaaccacctcttctttcaagtaattattcttctctattttgctgactgattcttgttcaattagaactgaaactgttcagccatcatcaacttatattatcagtttaattatattctatttctcctcttaccctaaacctcatcactcgatttccctaccgccgctgttcttcctggattatctctcgagccggtttttcaagtcgtatcttccccaccaaatctgtcgcaattcctgatactgcgaccgctattctcgaaccgcaccggggctcttttctatactcttgccatcctattgccttgtctccttcaacatgcggcccgaaatcgagcaggagctggctcacactttgctggttgaacttctggcctatcagtttgcttcaccagtgagatggattgagacccaggatgttatactcgcagagaagaggacagagcgaattgtggaaatcggtcccgcagacacgttgggtggcatggcgagacggaccctcgcatcaaaatatgaggcatacgatgctgctacttccgtgcagcgtcaaatactttgctacaacaaggatgcaaaggagatctattatgatgtcgatcccgtagaggaggaagaagcgcaaccatcggcagaggctgcggccagtgcccctgctgctgcccctgctggtgctcctgccgtcgcagctgctcccgcagctgctcctccacctagtgccggccctgcagcagcaatcgaggacgcaccggttacggctgtggatgtgctgaggactctggtcgcgcagaagttgaagaagagcttgtccgatgtgcccttgagtaaagccatcaaagatctggttggcggtatgtatttgccatctcatctgcctctacatcattgcaaatggatattgatttgtttctctttcgctaccaggtaaatccactctgcagaacgagattctaggagatctcggaaaggaattcggttcgacacccgagaaaccggaagacacacctctagacgagctaggcgcatctatgcaggcgacattcaatggacaacttggcaagcagtcttcatcccttattgctcgtctggtctcgtcgaagatgcccggtggcttcaacattaccgcagttcgcaaataccttgagacgagatggggtttgggatctggtcgtcaagatggcgtccttctccttgctctcaccatggagccaccctcccgtattggctctgaggctgaggccaagtcgtacctcgatgatgttgccaacaaatacgctgccagcgcgggcatcagcctctcggcaccggcagctggtggtgatagcggggcaggtggtggcggcatgctcatggatccggctgcgattgatgccttgaccaaggaccagcgggcattgttcaagcagcagctggagataattgcgcgttacttgaagatggacctacgcgctggtcaaaaggcttacatcacttcccaggagtctcagaaaacattgcaagcacagctggacctttggcaagctgagcatggcgatttctatgcctctggtatcgagccggctttcgatgccctgaaagcacgcgtgtatgattcttcctggaattgggcacgccaggatgctttgagcatgtactacgacattattttcggcagactcaaagttgtggatcgtgaaattgtgagccagtgtattcgtattatgaaccgttcaaacccactgcttcttgagttcatgcagtaccacattgacaactgccctaccgataggggcgagacatatcagttggccaaggaacttggtgagcagcttatcgaaaactgcaaggaagtcttgggtgtcgcccctgtgtacaaggatgtcgccgtgcctaccggaccccagactactgtcgatgccagaggaaacatcgggtacaaggaggttccccgggctagcgctcgcaagttggaacactacgtgaagcaaatggcggagggtggccccatctctgagtacagcaaccgcacgaaggttcagaatgatcttcgcagcgtctacaagttgatccgcagacagcatcgcttgtccaagtcgtcgcaacttcagttcaatgctctctacaaggaagttattcgtgctctcagcatgaatgagaaccagatcatgccccaagagaatgggtctggcaagaagaccggcaggaatggtgtcaagcgcaacggtagcccccgcgcaggcaaagtggagaccatccccttcttgcatctcaagaagaagtccgaacacggttgggattacaacaagaaactcaccggtatttacctggacgtactggaatctgctgcacggtcaggtctcaccttccaaggcaagaacgtcttgatgactggcgcaggcgcaggttccattggagcggaagtgctgcagggcctgattagtggtggtgccaaggtggttgtcacgacaagccgatactctcgtgaggtcactgagtactaccaggccatgtatgcccgctatggtggccgtggctcacagcttgttgtggtgcctttcaaccaaggtagcaagcaagatgtggaagcacttgtcgactatatttacgactcaaagaagggtctcggctgggacttggacttcgttgttccatttgccgccattcctgagaatggacgtgaaatcgactccattgactcgaagtctgaactggctcaccgcatcatgttgacaaacctcttgcgacttttgggttgtatcaagacgcagaagcagagcaacggttttgaaacccgtcccgctcaagtcatcctccccttgtctcctaaccatggtacattcggaaacgatggtctttactctgagtctaagctggctttggaaacactcttcaaccgctggtattctgagaactggaacaactatctgaccatttgtggtgccgtaattgggtggacccggggtacaggtctcatgagcggcaacaacatggttgctgaaggtgttgagaagctcggtgtccggacattttcccagcaagagatggctttcaacttgcttggtctcatggcgcctgcgattgtcaatttgtgtcagcttgaccctgtctgggccgaccttaatggcggtctccaattcatccctgatctgaaagacctcatgacgaagcttcgcacggaaatcatggagacaagcgatgttcgccaggcagtcatcaaagagactgcaatcgaaaacaaggtcgtcaatggagaggatagtgaagtcctctataaacgagtgattgctgagcctcgtgccaacatcaagttccagttccctaatctgcctaactgggaggaagatgtgaagccgctcaacgacaacctgaaaggcatggtcaacctggacaaggtcgttgtcgtcaccggattttcggaggtcggaccctggggtaactctcgcacgcgctgggagatggaggcttatggcaagttctcccttgaaggatgtgtcgagatggcttggatcatgggccttatcaagcaccacaacggtccattgaagggtaaggcctactcaggatgggtcgacgcgaagtctggggagcctgtggatgataaggatgtgaagccgaagtacgagaagttcatccttgaacattccggtatccggcttattgagccggaattgttcaagggctatgaccctaagaagaagcagctgcttcaggaaattgtcatccaggaagacttggatccgtttgaagcttcgaaggagacagcagaggaattcaagcgtgagcatggcgaaaaggtggagatctttgaattgccggagtctggcgagtacactgtgcgtctgaagaagggagccactctcttgatcccgaaggcccttcagttcgaccgccttgttgctggtcagatccctactggctgggatgctaagagatacggtattcctgacgatatcatcgaacaagttgatccagtcacgttgttcgtccttgtctgcactgctgagtctttgctttcagctggtattaccgatccgtatgagttctacaagtacgttcacttgtctgaggtcggaaactgcattggctcgggtatcggtggtacccacgcgttgcggggaatgtacaaggaccgctacctggacaagcctcttcagaaggacattctgcaggaatccttcatcaacacgatgagtgcctgggtcaacatgcttctcttgtcctccactggcccgatcaagactccagttggtgcatgcgccactgcagtcgaatctgttgacattggttacgagacgattgtggaaggaaaggctcgcgtctgctttgttggaggattcgatgatttccaagaagaagggtcttatgaattcgccaacatgaaggcgaccagcaatgccgaagatgagtttgcccatggtcgcaccccgcaagaaatgtcgcggcccaccactaccactcgtgctggatttatggagtctcagggttgcggtatgcaactcattatgagtgcccagcttgctctggacatgggtgtgccgatctatggtattattgctctgacaaccacggctactgacaagatcggtcgctctgttcccgctcccggtcaaggagttcttaccaccgctcgcgagaaccctggcaagttcccatctcctttgctggacatcaagtaccgtcgccgtcagcttgatctgcgtaagaagcagatcaaggaatggcaagaatccgagttgctgtacctccaagaagaagccgaggctatgaaagcccaggcctctgatgattctttcgacgtctccggttacctccaggagcgcgctcaacacattgaacgcgaagcaatccgccaggagaaggatgcccaatacagccttggaaacaacttctggaagcaggattcccgtatcgctcctctccgtggtgctctcgccacctggggtctgactgttgatgatatcggcgttgcctccttccacggtacttctactgtcgctaatgacaagaatgaatcggacgtcatttgccagcagatgaagcacctgggtcggaagaagggcaacgcccttttgggtatcttccagaaatatctcaccggacatcccaagggtgctgctggtgcctggatgttcaacggctgtctacaggttcttgaaagtggtctggttcctggcaaccgcaacgctgataacgtggacaaggtgatggagaaatttgactacatcgtttacccgagccgcagcatccagactgacggtatcaatgccttctccgtcacttcattcggtttcggccagaagggtgcacaggttatcggtattcaccccaagtacctctacgcaaccctggatcgggcacagtaccagacctacaaggccaaggtcgaggcgagacagaagaaggcataccgcttcttccacaacgggctgatcaacaacagcatcttcgtcgctaaggacaaggctccttacgaagatgcccagcaaagcaaggttttcctcaaccctgattaccgtgtggctgccgacaagaagacttcgcaactcaagttccctgctcagcccccaaaggctaatgacaaaggacttgagagcacaaagactatgatcgagtcgctggcaaaggccaatgcttctgaagactcgaaggtcggtgtggacgtggagaacatcgaaagtttcaacatcgaaaatgaaaccttcattgaacggaatttcaccgcaagcgagcaagaatactgccaaaaggcagcgtctcctcgatcatcctttgcaggccggtggagtgccaaggaggctgttttcaaggccttgggtgtcagcagcaagggcgcaggtgccccccttaaggacattgagatctcaagtgattcaaccggggcgcccgtcgtcaacgtaagtactaccttgtaaatgccccgcttataggaatttccgactaacttgagattcagcttcacggtgctgcagctgaagctgccaagcaggctggcgtcaaacaggtcagcgtcagcattagccacagtgatacccaggcagtcgcggtcgcggtctccaaattttaatgcgctgatgaggaataatggcctgaatttatgtcatgtaccttgagtgtaatctatcatgtctcttccctagcctcgttagacagtattagattgtcaatacataacgtgtctggttccaatacttgtccaataattcacttatcaacctctcttcatgtttgttgcactgattcatttaagaagttcgatggtgggttgctgacctcagcgaacgcctcaactcccaactcggcggtttagaggaatgtattgattttaatttataagtatttcaaaaaatttacactgatagacttcaaacctttctaaactgatatcaggagacgaaataacaacgaagtgcagttatggcggatgataagtatctacaatcacactcaataaatgcgcagttcagtatttcaacatagattaatccgtataattgaacttaatatctacttgcctccggatgctcggctcagaggaccccagttctcacgaggattaatttgataccgcaccagtcgcttcttggccgtctccctacccaaggcctcatcgaatacaacctccagcgtgctagggtgcggtctgcctgcaccattggggctacggggaggctttgtgtcctggagatccttctgcgttgttcccggctgttcacgcggaggatcagattcccttctcttcctccccaacgcttgacgggcaccggagcgatacaaggcagcttcaattttggtaatcatatctttgacatcttttgcttcctctgtgactgcttgaagctcggtcttgagaagcgccagagacgggtcttccccctcacggccttgaatgttctccctgctcttggacataatgacagcgccgggacttccgggctttagggcgccttctctgatgggagacttctgtctcacccattccctcatgatctcccagatcacctcccaaggagcatcggtacgaatcgtattcggtctggcgtggctgcgggttgatcgatagccaaggtgtcgaatagccccacgcatggcatcaatggaaattgtggatgtatgcaagactttggataaggcgctaagactgaagtagaaggggtattcttcccgggcggcgggatcgagccgcgggatgattgcagagtattcgttctcggagatatccccaccaactgtgccagtaggtgtctggtttgcttcgtcactagaaattcctagattcagatcttcttccattgccgtagtcagcattccctcaatccggtcaatcgtgtgatacacgttcctatctgcctgggggagcatatcaaggattctgcggataaattgtgcattgtgaagagggccagcccacataggaccgctgaggtgagtcctagagccacaatggccacaacgactatctgctaccggaccctgagcgaagccgaagtggtagaacggatttcctttcttgtccagcttctgtttcgtctgggtgataggctgagttgaccacgcgccacagccagcatcgcaattatagaccatcatcatgtttccagagatatacttgacttcggccggagagcggtggacacggacgaagactcgggcataaaagtcgatcgatagggagagaagtggctcaatcgcgagaccatatttcgcagcggaggctgcaagcccgtgcaggatgagacgcaggccaccttcatggcaatgcggtcctttgactgggattccgccgtatagggcgaacgacttctcgggatacccgtacgaggcccagacacctgcatcggtacaggtaacacaaagaagaccgccatccttgactccctgaaccgcagcgtccataaaaggtgcagcagagccgtaagggtccagatcaatcacgtcgaattttcctaggtggctctcggcagttggggtattggcttgttggtttagaagactgtacatgtaagagcgcgcatccccggtgttgggacggattttttcgccgagactgttgtatttgatgttcgtcttcatggattcaatggccgagggcgacaggtcgtttgcgacgacgcaagaagtgaaaggtatctccgaagcatatcgcagggcacgcagacccgtagccgagagggcgtctagaatcgtaaaagatggcgccgtgtcctgctctgcctgctgtgctgcagtctgatccccttggccttgattctgatcctgcgtttgttccttgccatcgacctcttctctcttgcgtttcttgcccttcgcggagtcgttcgccgcagccttttgcttcttcttctcggccttctgtttcttcaaggccagcaaatgctccccatatgcgcgaatggcaaggacactaaggtcccggttgaattgttgaatagggttgtagaagactgattgcgattgctcgtcagctttgcgatcccttttcgtaccgggagcctgagccggggggttcagaatgtacgccaatccttccttcactgctctgtactcagtgccgtcatactgtatcaattgttcagccatctccgcagccgatgagcgggtagagtagaatcggcggagtggcgggcgttgttggattcctagggcggtgcagcgggcaattgcgcgatcactgcggaatctgaaactgattgagagagcacgataaaggacaccaaggtgtgggctcatggacccggactctgtaatcgacctgttggtgacttggttctgggctaggcaatgaatgaaccgcgagtcctttcgtcttttttggcttgtcggaaactttttttttgacttccgcccgccaactttccgatcagtcaagcacggaccactccctactatctaccacataattagttaactataaactcatttcattccgtcttcccattcgatcggcgctgtcattaacattaagtcttgcttcttgcttactatacaatcatatcggccgttactcccgtgtcaaaagaattatctttgtccaatgaattgggtcagagccaggacccaataacggggacctggctgtagatctcattccatcccttggcctcccagccataaccctgccccgtacgcccgatgattcccagggcacctgcaagccatatggatgctcccaccgcggcaatgccgttgaccgtccaccacatcttcctctgtcggcggagtcgttgctcactttccgaggctcccagataaccctctagggagcctttctttcggtcacgttccttccggaccgttgtcactctccagcccatccatgcagcccagccgccgacgaagtgccacaccccaacggcgacgaataacaaatagtacagattccagagtgcgggggcccgtgcaaagccgtgggccacataacccagcccgactcccgagcttcccccatcaaccatcaacggagtgatgcggttgacgagcacatggacgccgagtaacggaactaaggaatatcctaaccgagcttggaggctcatccgaggccaaaacgtcaaggagtgtctctgtgaccttgtctcggcgccatagagtcgagcccgccgtgcggagcggatgttgcgcaaagcaattccagacgcaatatgaatcagaacaggcgcggtcagaacgagatgttcgaggcccggagattgatagacgggtctggtgagaagcaggaagctctcgctgtcgggcacagatcgagtagccagagggatgagagaggtattggcccaatgcaatgcaaagaatagggtcggtggatacgtcgagtatcgttggaacgcagatactggagaatttgaggccactgttagcttctaggaaaagagtaaattcttgctattatcacaatagcttgcatatacttagccatacaccaggaatcccaactatgtccgcgaaggcctaacttgagcgacgagaaccgaccacccccggcgatgggctcgcgtgccgatggcggacttggttctctggggaagtagtcaccagattcaaggtctggaaactcatcttgtactggtgatgggtctaactcttgcattgaaaatatggagcgcgtttcgatatcctctggtttggatggcatgctttctttcgaggcagccatggctcaaaaaaaaacagcacccggctaccaggtgctatgttatgtatgtccgcgccaggagccagaactagggctggtcgaatattgcgatcaaaccggttgcgatgggattatctggactcaaagcatggtcgttgaacaacaattcctcgctgtaatttgggaaagcagatttccttggaacttgatcccatcgacactttcttggtaaagaactgctaggcgatgatctgccgtattagaggcctcatgattggcccgctatggtcgacctccgtagtcacggtattgcaccggtattgacggtatcttatcgaacaccggttcaagctccctctcccgcgggcggtggttttctttcggcagaaagtatcaacctcgatgcgaagtcgccgatatacaacaactacaggctcaaaccatcattgctcagcgagcaagcagcaaacccccagacccgtacacacgctttttcgctgtttgcggcaaacgtttcaaagcgattctgcgtactcctcatagaacgatggcgcctgcaagtgcccagattccgaacatcccccctattaaagatgctatatatttccatagcaacaagttcccatatcttgcaaggctgaccaatgcgtctctatatacagcgaggctttaccaatcccactcccaaggtgcgattcagggcttagattaatgagtttcagagatatgaagactcgtgcttccaggctaactaaggaccaccgcatctcaaactagaccgaatctgcgcgttccgctctgagctccttcacctgcacgctctgcaacaagtcctattctcgccatccagaatatgaggctcatatttcttcatatgaccatcaacaccgcaagcgtcttcaagacctcaaacaattatctcgggaccccaatgccgccgagaaggccagaagagccgaacggaaggctgacgccgaggccgggttaagggtcctcgacacccccaaagctgcctcattatcgactacgggaactggatctggagtagggagcagtacgggaggtgggggagggttcaaaaagggggggttcaaaagttcctttaccactgtcaaaggacctgtggctcctgctgctcccacgaagaaaaacgtcctaggcggtgacgatgaagacagtgaacttccagaagcagatgatgagagtctgcggcgcgctcggagccaatcgtcaaagcgcgaaaacatgcaggttgatcaggcggagagcgatacagatgaagaatacgaccggaatagaggcatgaatggggggtattacaatcctcgaaatcccaccggttgttcccctgcatgcgctggtgctaggaacgttcccttagagacatcctttatctgaaggagcaccacgcggagcacagtacggatatggcgatcacaacgactatgtgctgtgacgtcaaatggccgatcactatccctgtttcctttcctcaagacttgatgagaccattacgtatgtggagaatgctatccagaagcaagacattacaggcatggaggtagctttcaaccgtctttctcctatgccgaggtcgatcacctgggaatagcaactgcaccggaggagcaagcccaaattcactgcgggctcgttcgtggtggcatacgccaaacatgagcaaagccagatgcgattttaagatgttacgaaagaatacaaccatgcccgagcacattagcttctctaagaatgcagaataacgttgattgtgttgtatagtcgtacaagatcaggaaagtgggagaacgaggtaatatgaggaaataggagaaatggctgtaacaatgatagggtactagacacatgattttattaattcagattttcttcaccgtcggttcatacacaacggctcatcctttacaggcgcaacagcttggcagcctggctgacaatggtgtcctcctgggggaagctcatgttctcgagaccaacggcatagggggtggggacctcggcgccagtgacacggacggcaggagcagtcaggtagtcgaaaccgtactccatggagagagcgaggatctcagaggagacaccgaacatggggaaaccggactcgacgcacatgatgcgaccagtcttcttgagcgactggatgatggtctcaacgtcgaggggcttgacggaacgaaggttgatgacctcagcgtcaacaccgtacttctgcttgagctgggcagcagcgttgagcgagtgtccaacgcagcgggagagggtgacaatggtcaagtcctttccggggcgctcaattttggccttgccaataggaagaacaaagtcatccttctgagcggcctcgctcatagggaaagcctgaccgtacagcagcctatgcaattattgtcaggttcaaaaacattccacaaatactccgatacttccacgggggccacgtactcgttctcaagaacaacgacggggttaggatcgcgaatggcagccttcaacagacccttggcatcctccgagctccagggagcgacaaccttcagaccagggatactgccgtaccaagcggagtagtcctgggagtgctgggcggcaacaccagcggcgaaaccgttcggtccacggaaggtgatgttgcagggctggataccaccagacatgtagtgggtcttggcagcagagttgatgacatgatcgatagcctgcatggcgaagttgaaggtcatgaactcgcactaaatatcgacagcaagtcttagtatactgtgcactttgcatctgatgaaccttaaatatccaaagggatatacaaaggtcacaaatcggggaactcacaatggggtgcagtccagcaagagcagcaccgacggcgagaccacagaaaccggcttccgtgatgggggtgtcaataacccgcttgggaccgaagcggtccaacagacccctcgttaccttgtaactataggagagcgaattcagatatgcgatccatggactgcagccaattcacacgggggacagggtgccatacgctccgttgtactgcgcaacctcctctccaagaatgaaagtcttcttgttgctctccagctcctcggcgagcgcctcgttcagagcatcacggacagtgacctccttggttccagattccgtagcatatccccggaagcgaagaattgagggcgcgcatgcggtctgagggcgaaggggagccgaagtaaggcgcgaagaaagcagacgagctgctgggcggaaaagtcggggagcagccatggccggactgtgagatatataatataagaagaagaagggggagaagaaaaagcaagagtaaaggaaaggagaattacttcgcggaaataccggtctgttagacaattggtatcaaaggaagaaagaacagccgatggggaggctcgtcactttttttcgggggttcggggaatctttttcgtcgacgaggtttcggcggaaggttggtttttggtgagaagcttcgaagggacttgttgggcttagcgctgactaagccgtgttgcggttttgctctttcctgacggtctcaccggtcgcctccttccgtagcctccgttctgtctctccctggcgtctcgtcgggatctttccctccgataagcacttctgggtcctccttcctatctatctagtatctaaactatcccgtctactccggacttagtgcctattcgtgaagcttggtgtcggtgcgtaaaccatcaaggtacttacttattcatctaccaccacggttgttgcctggctaactgatataactctctttccatccttctcgtatttagagagagagagagagagagtccacttgcgcgtgtcattcgttacgttactgctcgttgtcaatcagtactactgcttcgtatttagatattcaatccactatatctgctactatttccgtcaataacgtccccgacggagcatgagcatgagcatgtccagcaactactatctgctcttctctgcatccgtgaccttccttcttttctttctgtcccccttcgtccgtgctgtacaaccgaccgcgcccgagcctatcgaggctcctttgcgtgacctgaaatggggccagctcaattttcttcacaccacagatactcatggctggctagctggtcatttacaagagtatggcgctgaagtcttcttcggagccatttccaggccttactgatttccaatcccttatagaccctcgtactccgctgactggggtgactatatctcctttgctacccgcatgcgcgagaaagcagagtctatgggtgtggatctactagtcattgataccggcgatagagtagaaggaaatggactttacgactcatcggatcccaaaggcatctacatctctaaaattctgcgagagcagcatatcgacctgatgtcatcgggcaatcatgagttgtataaggaatccacagcttcagccgagttctttaccactacactcaatttcgccggacattatcttgcatcaaacatcgacttctatgacccacggacaaacgcattcaggccattggcacctcgcttcacgaagatcgtcaccaagcaattgggcatccgcatagtggcctttggatttctcttcgatttcaaaggaaatgctaacaacaccgtcgtgcggcctgtgggtgagacaatcaaggaggcgtggtttcaggaagctatcagggaccacgaggtggacctctttttggtaatcggccatgcccccgtacactcggaagagtattgggacatatggcgagaaatcaggtcgcttcgctggagtacacccatccaattctttggcggccattaccacatccgtgattacgcaaagtatgatcgtatgtcctacggcttggccagcggtcgcttcatggaaacgatcggttttatgtccattagtggcctctctacccaccgtcagcccggacagtccgccttagcgtcttccctttggccatgggaccgtttccatttcaatcggaaatatatcgataacaacttattgtcattctatcatcacactggcctgaatgagaccacattccccacggaacatggacaaaacgtatcccgactcattcaagaatcccgaagcgctcttcagctggatgaagtgtacgggtgtgccccacacgatctctttatgtcccgagcaaaatatccaggtgagggtaatatttatacctggctggagacagaagtgctacccctatccgtgagagatgtatctcgtgctgggaagccagcagttgttatagtcaacaccggtgccatccgcttcgacatctttaagggcccttttacaaaggataatacatatatcgtctccccattcacaagcggcttccgttatgtgaaagatatcccttactcccgagcctactatctcgccgatgtgctaaataggggaccgggaatcttgactgagggcccccaattagacaagttgacttggcagcttgctcccccggagcaatcagcgtatacccgtggtgtatttggcaacagtggtggccgatcaagcgctggcttccttaccaaccaagtcccgttcctgagtagtggatatgctgagcctgacttaattcccgggtacactacccatgatgatggaggcaatgatggtgatgacaccattcactcgccgatcgacttcttccgggtgccgaatgttatcaggggaacacctcgttgggatgcatctgaacccccggaaacagtagacctggtctatattgatttcattgagtctaacgtggctgcagtggccccattcgcgggaattaatgcagatttttctcgcgacagcgacgtctatatgccaaacacaacattgactggcttgataatggactggataaaaggcaactggccctgcgaggaggtatgagcgttcaccgcgaatcgcctttaagttggtggctggcgtatacatgcaaattgtgctagacgaccaatgggctactattctcttagatgtgttcttactattgagcgcacaagcaatgaaactagctgagttctagatagagaatactagttggtatgttggggtttcccacttgactggcagaaatagccatggataaaatatagtagctatccatcaaccgaagtcgttcgacagccaagaaagcgtactgtacagattcagattaaccggaactcccgagtttgaagattagctttcacctagttcattcctgttcctcgtacctgagcaagcccttgccgctgcggtaaccgctgagggtttcctgcacgcctgctacgagctcggagccctccgtgtcccacttccatttgaactcctcaactggaatatccttaaatctaccagcccgtgtcagctgcaatacatcattgatggtattttccttcagctgtggattcttgtcaccccatttgctgacccagaagccatcgaaaacgaggttcttgaagatcaacaatcccgacggcagagaaactggctgcttcgacatggccccataggtgaccagatgcgaacctggtgcgagtgtttttgccagtgcggtggcactctttccacccacacagttcaaagcgaggcggatgggctcctgccccttgcgcgtgagctcatgtacaacgttcctgaattcgcctgaaagcaattcggcctctgtgactaccgcagtcgcaccgagatctgtaagttctttcttcagagcctctgtctcctctggagtcttccgttcccggacgacgttgagggtcttgataccccactctcgcgcaagttgaatagcagcgcgtccaacaccgctgtttgccccgttctggatcaaccagtgttctccagcacgcatccagtcccagtcgcagaagtctttgatcatgcggtaagctgtcactgggttgacgctaacagtactgatctgaagtggggtcaagccgtccttgttttcaatcttgattaactgcgattcatccagctgagcgtgagtgcgccaggtgccctgtccagtctgtttcatgacaacccagtcacccttgctgagggttttcactccagagccggtggacaagacctcgaatgcgccctcatttccagcgacagccgccggctcctgtgtaccgagtgtcgattggaacggtggcttgctcgggtatacaccctggatctgattcacgtcggcaggattcagcggcgcagcaagcaggcgaaggttgacttgagtaccatgaggcgcggagatggagtgtttgtgaagcctggatggctgtcagatgcctcgttcccaagtgcaatagccgggtcaccgaaatacagcattggacgcggtgcgaagacttactgcagaacgtccttcggctctccgtagcgcgagtagatgagagccttcgattgcgtatacccgtagactgaaatccatcttctatccccaacctgagtatcagggtataatccccgcaattggcgcttgctcactgaggctaattgcgatgcagctccgattctgatggagcacgcagtgtggcttccggaagccctcacggcagaccgaatcatacctccagaaatcattgtaaccacgatatactggtatagtcaaatgaacctggtgaaatgagggagaagatgaggtttttacaacgatgcagtcgcaaggaaattcctgatgacgtcgtccctacagccctcgggccgacggaggtgaagacgccgattcgggtattcattttggccctctggactgagttctgtcaccggatgtttacgggcaatgatatagtcagatgcaagagatcttgctagaaagctgatcgcatgcaatcttgactgtgcggtactgatcttggtccttgtctactatgtcaagtccctactcagctggagctggagcttctcgagaagctcctgagcactggtatggtatcgtacagtatgatactacgacgagagaacactcaccgccctgtgttgctcaccgcccgtggggatgtccgcagcatacaattaattgatctcagtttctagaaggcttccattgcctgggtggaacccttttgtatactgctacaaaacccaatgtcgctcctgcgggaagccgagaagtgcttggctaatcagggctctcatgcggctctaaatgcgctaattaccaccctacatcagtcaggacaatggttggaacgtgtgagagatgcggatgcgcggcgcacccggggtgagtatgaaggctgcattgaaaccaatcctcgctttattcagagctgaccaactcgcttcgccaaatagggacgcctaaatctgagatagatggccggttggttgccgtcaaggacaatatgtgcacacgcgaccttccaacaacatgcgcttcaaacgctctggacaaattcgtcagtccgtttaacgcgacagtcgttcaacaattggaggatgcaggcgctgtcgtggccgggaaagctaatctcgacgaatttggaatgggctcccactctattcattcaaactttggccctgtcagaagctcgcgccgtggccaggatgcagaatacctctcagccggtggtagttcgggtggaagtgcggttgctgttgcgacagcccaatgttacgcgtatgtaactctccagattagccttgaatcatacgacgagtaacggtttggcttaacattgctggaacatttacagagcgttgggaactgatacaggcggctccgtgcgattacccgcagcatatacgggaacagtcggcttcaagccttcttatgggctggtctctcgctggggagtggttgcgtacgctaattcactggatacagtcggtgtactgggaagggacgtggccagcgttcgccatgtcttcggtatgtcttgattatgtcggaatttctctcgtctctttgcgtctcgactcactaactcgtgttcgaaacataggcgtcgtgaaccagcatgattcacgcgatcccactaacctttctccctccagtcggtcacggatagactcacatcttaaaatgtctgctttggcatctcggacaagttctcctcttaggataggagtccctctcgagtacaacatatcagagttgtctccatctgcgcgacatgcgtggtctcgctctctggcctatttgcaacgacagggccatagcatccaaacggtgtcccttccaacgaccaaactcgccttatcggcatattacgtactcgcgcctgctgaggcatcctcaaacctggccaagtatgatggcgtcaggtacggaagccgccccgaagcaccagacggaaatgcatcatcagaaaggtatctatatgcgaaaacacgaggtgatgggttcggctccgaagtcaaaagacgaattttgctcggggcatttagcctaagcgctgacgctatggataactacttcattcaagcacagcgggttcgccgccttgtccaacatgacttcaacgccgcgtttagggcatgccagccattgatttcctcgcaacttggatcaaagtcgggttctgcagacaccggtgtagatgttctcatttgcccgacagcgccatcatcaccaccacgcatttcaagccttataggacctgatgcgacaacttcgcctttggaggcatatacgaatgatgtatttactgtgcctgctagtttggcaggtcttccggctatatctgtgccggtcactacagaaaatgctgatggcgccgaggatggagatctggctggaatccaagtaattggccaatacggtgatgatgagcttgtgttaaaggttgccgagctgctcgagggcaggcacctatgaaaatttttggttcccataaacgcggataccccagaccccgattatagatgtctatatgtatacagttcaaaataaataaaatagagagattgtgcgccattatcgccaagaggtgtcgctgtagttcgtataaaaaccttgcaattttgagcagggctcaggattcggagcgcaaaagaggggactattgcagactagcacattatgtatatttgtgcagagttcgaagtcgtaatatactgtctactagccccgtaatgtgcctttgtcacgagtagatcattccaacaccaaccaccctgaggcaaggccggtgtagtagactggcttaggaatcctaggcctaatcacgaaaccagaggccgaggcgttgacggtatggcgttcaagacatttcaacatcgccatccccagttgacgtgtcgggaatcgtattctggggtgcttctggaaccggggcatcggcgcgcgtggcgtcctcaagcgcggcctggcctggatctaggtccatgacgcttcccgcttcgttgccattgccagcgggattagcagcagactcactctggccgtccgcaactggaggaatagcagactcataagccgcactaacaccacctttcaacacctcggagccaccaactgccccagttccagagccatcgatctttgcattgttgacaacgttgccgtctactccgccccagacgcacattgcctcaacctcgtccacgatatcggcaactatatcctcaactatttgttcgttgaagcgttcgccgatgccccggactggctcgccgttgtccgtatgagatggtggccccacccaccatggcccgtcaaagcggcattcaaccgcccctccgccgtagcagctgacagcaggataataaccgatcattccgtcatctgcattctcgcgctcgccgatgcccaagttgtttgtgccattggcgagtcggctggccggtggtaagaaagcatacagttcttcaaaaggagtgcccatctttacaccgttcttgaatattgtgatgcttgaaccgggtaacgttcgcaaagatgcatcctcggcattgaacggagatggaggcccaaacgtaggggtttctttgagattgaatgcgtagtcgcgtagctgttttgttggaaacacgttcgactgttgccaacaaaagtctgatttgtagtggaaaggaatgcggtcacgaactatattcgtgactgacggggcttctgagcttggtgatgagacctcgccatctgcacttgactcataagttccctctacaactttcttgtggagagagagtggcggaagggtgattagaaggccgacaacgtcgccctcacgaatagattcgccttttggaaaaaagtattcacaccgcatccgattgacgacctcaccattcacatcacggataccgtagccataacagtcaacaccaacgttggcatcgaggtctccctcccttcgtgcaaaaccaagacgcacatgccccctggacggtaagcctccattgctattagaagagggagcaggcgaattattcacaacaccactgataatgcgcgcttcgtagtaataggatccctcgcgcgcgcagacattggctcgtgccgtatgccaaggctcattagaagtaactgcgagagcgtccttactgaagagtatggcagctggagagtcttcgaaactaaatcgggcgtgatagggctggacatcagtctgacggtatttgatatgcggaaagcttggatcagctatggcgtagctataacgaaacccattcttattggtgagcttatcgacaatctcaaaaaagtcccagctctgaccgataacgtctgatgtttttcggttgacaaagttcagctgccggggttgtgggggtaacagatcggatgagcgaggctctgccaacaggagaggccttagtatgctgagatccgagctgggaagtgcagtgttttggacagcaactgctcgcttcttcggtggcatgctttcctgatccagacccttggcctcacgctttttgcggctatcacgtttggtgcgtttcgatttcgatccatcagcttgcgcaggggcgttactagtaggtatgggagaagatctcgcattagaatcgggaaaggaaccggtgaagaatggtgttcctccaggaggcaagatcggagagttcaggttagacgagggtgcagaggacccagccggttgtgtggaagccattgttattttgacccaactagggcaatgctcagtgtgagagcgtataatccggagtgatatcagatatgatagaagtcaatgtggaatacttgtttgtgggagcccaacacggtgtaatttgcgcatatgattcggtatcagcaacgacagggaaagccagctggatatactgcaaccacagctttttcgtattgaatgtacaggcctcggagtgaagcaactctatcaagagtactagaagccttggtatatgatgagtggaggtgatgttacagtatcaagggtaacccggggtcgcaataatgcctgtggaaaaagtcaaagaaggtcagaatcacatgtgaagctagtgaaatccagagctatctttgtattctcatctttgggttcacagctgattctccaagggatgttgaaggtaccatatgtactatgcctgaacaccatatagatagttggaaatgaggaacgcggaagtgggttcggagtgccctgggactcaccacaagggctgctggtcaacacgactttgaacgagctcgttggatgtatgaaatgggccgcaatcaatttttggacagctgtataaggtcaattagttgttggttgaactctccttgcaagcttcgcggcccctcctgcatcacatgtctgttgtttatgcgcaagttgcatgcgacgagcggaaagtaatcttgccgccgatctaaggcggtgagctacaatattgccggcaggtgtcgagggccaagtggtgccccgggataagaggggcaaaggcggtatcatgtatcatccaatgatatatagatttaacaaagcggtgagaatcgactccgctttggcgacgccaaaaaaaagagctcgacaaaaaatttgaatcacatgacctggaaatttacacacattttcgtggaggttgatacccgagagagagagacgatccacgctcgcagtgcctatcatccggtgatttggtggatttggtgctagctgggccttttggtatcatacaaatctcggactaatatatacacatccaaaggggcaccgtcaccatgcccaaggcaacatcctctcgctccgccgccggccgccggcacaatcctctagctgaggattatatgactgctggtcatctaagaactcaatcggccaaaaagtccagtcgcaagtctcgtcaggaagatgagcaagaagatggggagcgcttcgttgatgcgaagatgtcccggaagatcctgcaaatcggacaggaactggctgatgaggatgctgaagaacaaagagccacagcaggcgccgctgctgataagacgaacgcagcctttgattttgagtctcgcctggaaggcgatgaggctttttccgatgacgaaaaattccaagacgaccaatgggacgacgatgaggaaattgaggaagtcgtatgtcaccggactgcaccaaaaatctatgggaaccctttttgctgatatgccgagtaggaggttgaccccgatgaccttgatatgttcaacaagttcattcctgccggcgacgaagacccgatatttaaccccagtgggcccgaggccgaaggtcagactaggaacctagccgatctcattctggagaagatcgcggaacatgaagcgaagcagggcggagagagcggcgggcccttcattcagggtggtggattaccagaagatgctgttcaaatacccgcgaaagcggtggaggtatatgaaaagtgagtatggattgcgccgcgcagcgattcacgcaaggctaacagaaagattaaagggtcggcatgatactttctcgctacaaatctggacctcttccgaagcccttcaagatccttccttccgtgcccaactggcccacccttctcgatattacacggccggagtcttggacggccaatgctgtctatgccggtaccagaattttcatttcgtcgaagccagcagtcgcacaggagttcatctcgacagtgctccttgaccgtgtccgggaggaaattcatgaaaccaagaagctcaacgtccacacctacaatgcgttgaagaaagcgctatacaagcccgcctgtttcttcaagggcctgctcttccccttggtttcgagcggaacctgcacactacgagaagctcacattgtctcttctgtcattgcacgtgtctctatcccggtcttgcactcagctgcagcattactccgcatgtgtgatctcgctgctgaacagtcgttgcgctccctggaaagtactggtgcagtgaatatgttcattcgcgtttttctggagaagaagtatgcgcttccctacaaggtgattgacgccctcgttttccatttcctgcgcttccgtgctaccgacaatgatgccatgatgaccgatggatcccgtgaagccaacaaggtttacaagcttcctgtcctttggcaccagtccctgttggtgtttgcgcaacgctaccgcaatgatatcaccgaggatcagcgtgaggcgcttttggatttgcttttggttcgtggacacaaggatatcggacccgaggtcaggcgggaattgcttgcaggcagaggacggggtgtggttgcaccggatccggagaaccaaggtgctattgatgccggtgatgatacgatggatgtcacgttatagacgaaatgatgcgggaccgcgttgagagtataaaccgggggccgagacgaggtgcctcctggtgacttcgaaaatttgcatcttgctatggattcaatcacgactcgtgaccggcatgggcgttatctttgggctattgatttgttacatccatttcttttgtttcttaggcacatattattcccacggttacacatgagtttgatagctagctgctctcacttgatgagcacagtaaaagaaagaagataagattcaaccctactcttggataggaaaagaggagagttggaaagaaaaggttgttagtcacgtataacattgttctcataagcgcatgccataattcatacaccatccattcctacgttccgacggagtgcaacaaagcgcgaagggggcggcccccaacctgacagggctagtgcatgtatgacttctagaagcgttattaattaacgacggggatgctttttgctccctctcccacaccccctctgtctctcaatcaagtgtctatattgcgtcggagctaatattaatataacgccgaagggagaccgtcggactttaattatttagaaatcagaccatgggcctagtggtagatagtacgtattctgtcctgtgtatgcgcaataatttactccgtcgagggagacccccgtgtttctggtacattccacccgctaacccagtcggtcaaggaatgcgggaaattcaacagatagcagttccagactccaaagggaggtctcgacggccggtggcctccctgcgcccctcttgtggtctcaacttgcaatcttgcggatcatactccgtagatacttggtagatgattgccgcactttactccataccactttgtgctagtccaattccccacggtgattattcttccgatgctgcctgtgccatttttatctcccgcactgcctctccttgaacaacccccgccgatgtcttacttcgtctggcaattaaatccgtaagcttagtagtattctgtctgcattacaactttgctttctctctttttttgtgtgtataatcttactgaatagacagttccaatagtaacaaactgtttccgatcggtaaggctttgtttttttcattgatgttatcattaccattcaagtgtgaacgcgtctggactctcttattgtgcactccttttgagtgtggcatccagggctgggttgaagagtctccagggggcaaagagcgtgagtggcgtagttcattgggtgacagacaaagtgaattcgtggaattagatccaccgtggcgccattcttagactcggggaggggggttccaccttgagagcgagacttgtcgcaggtagagagggttttgagacggaaggtgtgtagatggggccagaagggggctttccactattgtggtagggggaaacacacttggggttctcccttcgcagtccctccctctcaagcatgcttactgtgtaaagttactgggaaccacggtgctcggagtaatttaccgtacggtcaattggggcgcaaaggggcatattcacccaaccggacgttgcataggggcgtaatgggtctgtaatggttaccggaacttggctgacgacgatgactccgcccccttacttgcagggaggcggcctgatctgaccacgttggccttttaaagagtcgctcactcccccagctctcacagtcgatcaggaaatcgtcctcactcccatctttttattgttctatggttcttaaggacacctgtccttcttggccctatccttcttgttgtctggtacacttgaccccaggcaccacttggccaggcctggcccccccagcttcccccgttatgacacggtggcctgtgttcctgtgacacgggcaagcagacgtcctccacaagctgtgtcgacctacatcaccgtcctcccttgcagtgcggttaagataaggctcatagtaaatcgattgatccacaattaaagatcaatcacctgtcacgcttgaaatgatggaagaagcattctctccagtcgactccctcgccggctccccgacgcctgagttgccattgttgacagtgtccccggcggacacgtcgcttgatgactcgtcagtacaggcaggggagaccaaggcggaagagaagaagcctgtgaagaagagaaagtcatggggccaggaattgccagtcccgaagactaacttgcccccaaggtaagacatctatatccataatagactatgtatgtatgtacacgatgctaattcgacataaaaggaaacgggccaagactgaagatgagaaagagcaacgtcgtatcgagcgcgttcttcgcaatcgtgcggcagcacaaacatcacgcgagcgcaagaggctcgaaatggagaagttggaaaatgagaagattcagatggaacagcaaaaccagttccttctgcaacgactatcccagatggaagctgagaacaatcgcttaaaccaacaagtcgctcaactatctgctgaggtccggggctcccgtggcaacactcccaagcccggctcccccgtctcagcttctcctaccctaactcctaccctatttaaacaagaacgcgacgaaatccctcttgaacggattcctttccccacaccctctatcaccgactactcccctaccttgaggccttccactctggctgagtcctccgacgtgacacaacatcctgcagcggtgttgtgcgacctgcagtgtccgtcgctggactcgaaggagaaggaagtgccctctctctctttgacgtcggctcaaaccctgaacctcacgctgccgatgatcttgcagctcctctttctgacgatgacttccaccgcctattcaacgttgattcacccgttgggtcagattcttcagtccttgaagacgggttcgcctttgacgttctcgacggaggagatctatcagcatttccatttgattctatggttgatttcgaccccgaatctgttggcttcgaaggcatcgagccgccccacggtcttccggatgagacttctcgccagacttctagcgtgcaacccagccttggcgcgtccacttcgcgatgcgacgggcagggcattgcagctggctgttagcgagcagtttcgccagggagatgcatcggctgtcgatggtaacggagtccaatggagctgggagtctttgttgaccttggcgtggacgatagacctactcgaacagccgggacgacgcaaacgaatcttgagcggtttgaaatcagcgaaaactggacggcgaagtaatattggcaagtctcaaaggagtacacggagttcatggagttcacgaagcacccaagaggcgttgacgtctctccttatgggcaagcatagttgaggttccggctgtaaattatcataaatccttataattttattctagatttcaatacagcagttgattgtctgctcatcatccttctttcgcttttttgaccgacagaccatgagcaggttaatttcagatcccgttggatttgcaagcagctgggttctatagtagtgtagttaccacatcggttctttaggcatcagcggtgagactttactaccattattgtcaattgtcgtcggcatgcaggttggagtggcacctccgcgcgcagcggatacggcaatcgggatgacgttgccacgcagtcccccgccctcccatctagactgtctgtccgatcggggctggatgttgcctcccgctccgtatcttttgaccccaaccttcctaactctctcatgcgcccaagcctcactttctgcttagataccctctcgcgccctctccagtttctttgtcaccatggttcggaaggatcctatctttgaagcccgcaccaatgtcaaggtaggcggtgccccattattccccctctctgcggcaacgtttcagcgtctgcccgtttacgagcgcacccttggtttgaattatcatcagttgactaacgttatcattgtcctgcatttagctacactctaatcgactgaaaaaggaggccgcccgtgctgaagcgaccttcaaatccgagaaggccaaggctgataaggccatgaaaaaccgcgaatttcagatcgcccgcattcatgccgcttctgccgtacgagagaagcgcagacaggtgaccctcaaggcggaggctgcccgagcagatgtcatcatcaacgagctcaaggctgcgcagagcactcgggacacatctcgaacactagcgttggcatcacggggcttggatgctgcttccaagagtgtaaatcttgagagcttggtttcccatgcgaacaatttcctggcgcgctctgaagatttcaagattgctagcagtgcgatcgaggatgttgcacaaggggtctctttgcaggagaatggcgcagagggtgaagccgatgtggatcgcttgatggagcaacttgctgatgacgctggggtggatctccggatggctttggagcaggatgctgctgctgctcctaaggaggaggtaaaggctcctaaacaggtcgacactgaacttgaggatgggttggatgctaggctacgcgctctcagggcaaccaactgaatttcacctacttcgtttctattgtcttctagtgtcacgttcactttggcattatctgttgatattctttcggtttcggcgaacgataggagtaactaacagcgcgttgggtatatgctgggtcgaggtctagttgctttacatgatttgttggtcctcgcaatctctttcattacatccctgtgaaaatcgcacttgctgcatacatccatagccatgcatttgaaggatatccaatggtcaatcttacaggagagacgcactttttctctgcacagacactgttcgcgtggtctatataccggcttcacctatattgtcattttggcctctctctcgaactggtacgttctcttagttacgtgctctatattctgtccatcaatgattatgggggcatggctataaagagattacatgcctgagacatatgacgtttaattcatattccatacgctcatctcgggagactatcgtcgatattaggcaagtttttctgaacgtagtgacacagacaatttgtattaatacggcatcttgtctagctgtgtagtgaagaattctcaataggcgcaacatgatacttattaccccttcgtagctgtcttaggctgatagagcttaaattaaaggccctcttcaacgagcaagcccggctagctcaatcggtagagcgtgagactcttaatctcaaggctgcgggttcgagccccgcgttgggctttctttttcttttttttcccatcgcaaagtcagtctgtcagtcaactcaccaccacccggctaacaaacataacttaatcttccttttccttctcccgcccgtcttttgctaggcctgtaccttgtgctgccgatctagtcgacctttcgtaggtatcattttacagtgctagcatagctgagacgcttttccgaagccacggccgttgccttccggatgttgttccgccgctgtctataaatgctgcgtacaatatgtttccgtgatcgtcaaccatcagccactgaaaacaacttttgatgactcggtatgtttcctaggtccagccacgaacgccgcgacagcgaaaaagatatagctgaaaaatacaaggctgcatgaactaactctcgtaacaggcaatggatagttccgctgcgttggatcccaacaaagcatctcatggtcgacaagccgcctgcttgaactgtangaaaagcaaggtccgctgcaaccgaggccaagatgatgcgtcgtgtagcagatgcaaacaggccaatgttgaatgcatcatacccagccaccatgtcggtagacagaaaggggtcaaaaagtacgcgctaaacgcattgatcttccgaggaccccaagctgacatggtgaaaaccagcaaacgcaaaggccttgaaaaagcattacatcagattgaacaggccatcaagagaccgagaagcaatgcatccgggtccgaggcggcccaaaagctcatatcagaccttcaagagatgctcagcaatacacgagaacagcagttacacagtgaggcagacgaccagtccgaggatcggtcctatacataccattcgccccgggataacaatttcggcgataatctctccctagatgatgcagagaatcctttacaactacttgcacgtgcctccgatctacagctatcgccgaatgaggctcgtgatgcacacagatggccaccttcaacatttccccaacctacaggcatgctgccgagtagcaccgagggaagcgaccctgccgcgcaatcatattttgttcccatccgggcaaatctggatgttggcccagatatagaccccattgacattggtcttgtgactccgagtgaagccgaatcgcttttctctttgtatgtccaatgttgcgtacttagattcgtggctacctggcttaccattgatgctagcttttatcagaacctcgcacatactcgatggggcctagaccctctggtacacaccgtctcgtttgtgcggacccagtctgcatttctattcacctctatcatggccgcggctgcattgttcctgccatctgctacagcactgtcgaagcggctttctcgacattgcaagtccctggcccataatgtcattgcccgacgccacagatcggttgagatcgtcttagccttcatggtaaatgttccatggatggagccaggtagttgcctgggggatgacgatacatgttcctacattgccatggctctagctgttgctttagatctctcgttgaacaagattgtgcttccatcaactagcttcgagcatagccttctcagaagactcgctaaggccgaaactatcgatgcaaagagagccctatacatggaccgatttgatggcatagaaccgaactctgcatggggccgaagacttctccgaaggcgagagagaacgtggatagcgctgtttgttctcgaaagagggtaggcatatcaccagaagctctgctattgcctgtctaacttcatcttgcagtgtatgtttagctcgcgggcgaagctatacagtcccttcaacagcccttataaactattgtgataagtggcatgtatccgattttgcagactcacgtgatgggccgatgaattcaatggctgtgctcaggaggaatttggtaagtacactggcggtctcatgcgtacggaaggacctttctgacgggagcgtacaggatggccttttcctgagagtaaaagccaactgcgacagccaccaggtcgcagatgccgggtctgaggtagcgcaatcgtacgtgtgcatcccacaagttgttgacacgcgaatactcacgctgtccctaggatcaagaatatgattgaaagcttctacgacaagtggtatgagatatgggcgcctgagattggggaaggtcactgtaagtcccttgtagaggtgcaacaggctcgcattaaccattgtacatccggctaacctacaccaagcacgctcccttccaccctatgttgaaatccttgtaacacatacgaggctatcgacatatggtggtgttatcaaccatcctacagcacctttggaagtcaagagattctttcgtgctgccggcctttcttctgcactgaacgttctgagagcagctatacaaggagagtcgcgattgaaatccatgccgaataacactgtcatcatgatatcctttgctgcatgctcagcacttagtctcagcgtgatgccagaagacagcaggtcgagtttggcgccaagtgttcataatttgatcgaggaaactgcaggtgtccttgagcgtattggagctactacccgccatagaaatggcgcctctgttctctatgggcgcttcctgagagcgcttgtcagacgcgctcctgtaagcgcaggctctcagaacctgaaggtcgaaacggggccgctacaacctccgccagacttggatgggtattgcccggtggcttccgggacacagccatcctcgataccgacctcttttatttggcctgaaccactcagattttctgctatgtctgatgaccagatcatagacgcagtgaaccgagctggcaccgcatttgggacatctgtgcccgatgttccactggatgacctaatgacttgggactggttcgatgtcggaaatgcggcagattttggcttctgaatggaggggagcagatcggtggctacgcggatcgagaaatgatctcatttctggttccgagccgaaaggtcctgggagctcggccgctcggcgactagaagtagcgccgagttccgaggggcgccgttctcagcttcccatattaaccagcctggtttcctgcttttcatggcttagtagcctctgcaacatttttcaatcgcgattaattcatcctatagccacgaggaaaatggcaaccattcgattatccgcgttggtcttgtcacgaaggttgattgttcgtccgcaatgctatcgacggtcgcaactttctccgagcctgtatgcgcctctcgctactagtatcggtagccgggccagatactcaacttctacacacgagcaagctccgcgggccccgaagattgaccgtgccgcttcaaagttgttcaaggatgcggatgcggccgtggcagatctgaagagcgggtcaatcattcttagttcaggctttggcctatgtggtgtcgcaggtaaagatattcttggtattgccagataatactaccagtttattaacccatgaatctattgcagaaacattgatctctgcgatacaccgcagaggggcagacaacttgcactccttgacggcggtttcgaacaatgctggtctcgccgggaagggcgggctgtctaccctaacgcaagcgggacaggtcaatagactgatactttcctacctgggaaacaacaaagctctggagaagaaatacttgacgggaaatattgccatcgaactgtgtccgcaaggcagtctggccgagcgactacgtgctggaggagctgggatccccgcattttatacccccacgggagttcgtgagttttagagttcttgatcgctaatggatacatgatgtatcttactgacttgttcttggcagacactctgcttcagaagggagagattccggtgcgtgtagacgaatccgggaaggtgctcgagcgtggcaagccccgcgagacaagagagtttaatggcaaaacttatatgatggagactgcgctcaatggggatgtggcgattctcagagcgtggaaggtagacgctgcaggaaattgtgttttccggtaggcaattctcgacgctcttttatgtacgttggaatgctaatgatgtgacatagttacactacgaaggcgttcggccccatcatggcgaaggcagcagcccttactattgtggaagccgagaacattgttcccgttggctcaatcgaccctaacgatgttgatctaccgggaatcttcgttgatagaatcgtccccgcaaccgatgaaaagcatatcgaaatcaagaaattgcggtctgacaagggtgacgatgcaaacaaaaaggcagaggacgctgcgactgtcctacggaaccgaatcgctaagcgggctgctcgggaactcaagcagggttactatgttaacctcggagttggtaaggtagtcccttaagtcataaatgctgctcgatattaatgacttcccaggtattcccacacttgccccctcgtttctgcccgaagatgtgaaggtttggatccaatctgagaacggtatcctgggcatggtaagccaataattcccgaaagcaatatgggaaaggaaattgacatattttcaagggcccttatccgacagaagaggaagttgatgcgtaagtgtccctatgtcactggccagttatcattgatgtcttggggcactggcttactccaatccaacagggatatcatcaatgccggcaaagagactgtcacactggtcccaggcgctgccacttttgatagcagtgagtcatttgggatgatccgcggcggacatgtagatgtttcaatcttgggagtacgtgataaaccctgttcatgatcggcaaccgggtgacggaagctgactggtcgaacaacacaggctttgcaggtcagcgcgaacggcgacctggcgaactacatgattcccggtaaggtgttcaagggaatgggaggagccatggacttgatctccaaccccgagaagaccaagattgtggttgccaccagccacaccgccaaggatggatcaccgaagattgtggaccaatgcagccttcctttgactggcgccaactgtgtcagcacgattatcaccgaactggtaagtgggaaaggtgccctagcagatgacggcaatcagtaagaattgcagaaaggaaagaatgaactaacagcaggctatagtgcgtcttccaggtcgaccggaccaagggtgagcttctcttgacggaactggctccgggtgtggaggtcgaggagattcaggacaagactggggcgaagttttcggttgcggaaaacctggagatcatggaatgagtcgaggctggatgtatatataatggacccctttttacctcttccctgtaaatttgcctctcgattttctgagtcgtcgcaggtcttcatcatcttgatctatactatatagccaggcaatgaaccacacccatgatagattgatagattaatgataacttaactctcggccgcgccggccacccctacctgaccacccaactcgagcagaaatgaagctatccaaataacaatttaatcaataaagtccgcgtgcatattattacttataatagagtttcgaatactgaatttctcttatgacaattggttgtatggcacttactgcagcaggaagatatacacgtagatgattaagattctgtcttctctacctgggcctcctctagctactgtattttgtctcttacttcctgggttaaattatctcctttaaagactagctgctgctttaattgcttcttcttttagagctactttttatgcacagcgcgtagatcccagttcttctttagtagaacactgtaccatgtcctgcaaagaagattagaagaatgctccacattgatctaataataagatctattatataaggtattccttttcattaaaaatcgatttctgagcgctatttggagtttcttgaacaaatagagtaccgcgtagttaattctatcaagtaggattgcagcatagatatcatgtttgcaatttcacttccagaagaacatttggaatcgcggtgccatttgccggcatggaataagtgaagttccagaacctaaaatcactatggaactggttagcttatggtcactgaacaggacgctggaggctctacttaatgacttggtcgctcaagctatacgagatgttcagcgtcgttgggtccatattccccgacacagtgacattcaggccgacaatgtcctgccagccagccacattcttctgggtttcaaaaggagataccaggaactgaaactgggacgccgacgtcccacgcggataggtcaggttcagatagccgggtccaacttcagcgttgagagcctcctccgtcgcatacagctgtgagatgttagccataaccttggatcagcatcggtgtcctaggtcaactcactgttatccaccctattccagctccagtatcccactgaatgacagccgggttaaactgcgatggattgatggctgggccacctacaacagactcattgaaggtctccgctccaatgctaatgccttcactcagccacgcagccacctgccgtgggaaggagtcatatggaatagagtacgcggatgtgttgaccatatgctcaccggggaaggttttcagggcttggatggccgttgacgggacaagcgaattgtgaaagtttgacaggatagcgatcagaggcgagatggagaagtcggagttgtgagacatcatatacacctgtatgtatcagttgttagcaccagaaaaacactaatgatcattctcccttctcctcaccttatcaataacaggagaagtttctttccccaccagcgaccaaatatgccccgacatgataccaaagtacttttgcatatcaaacccataagcccgatcccagggaccagcaaggtttttcaacccagcatgatacaattccccgatagtatcccaagtatcctgcaacatctccttccctttccccttcatgaccgagtcttctgcagcatacttagcccacatagtcagcgcgatcagagaaacacccgtataagtggcactgttaaactccgaaagcgtatctgcgcgatcgaagagccggatgatctccgttgcgtatgtctcgcccgaattggtcatattctgatctccaagcttgcgtcccgtccagcctgtgatgatggcacgcattaaggactgcgcagctagtcagttaactcacactcagtggtaccaagagtctgagccctcacgcaccgggttcgtatacgacggatatagattatcatcgtccaccccaccgacccgataactatccccaacagtgtcattgtaaagcgacgcatgcatcagctgcgtcatatccgcatctatcagatgtgggaactcctcaagcgcaatgatgaaggccgtcccaatgaactctctccaattcggatcccaggtatcatagataatgggtgggtaagctgaggttcccactgtaggttcttcggggaactgctggtaatcaccgtacctgtgagtgagcatagaccggtgagtcagttctgatcaaagggagggaatgtcctctccaattgtgtcaaccacccaccattgatcacttgtatccttgaactgcgcatctatcacgtttcgaatgatagtcatcgcctgagctacatcatcgccctgatcccgagccaacaaccccacagcataccacacagacgtccttgtatcgtgacgcagcgccgttgcagcactcgggtcatagacgtagcccgcggaggcatcgtatattctatcaaggtattccatggactctgtgaatagctggcatgtatctgttgaccaggatgtctggcaccagctattactattgctagtactggtactagctgatgccaccagggtggatccggcgagagcgagcacgaatgctctcagataccgcgacattttcctagcaacaacaggcgaaacacaagattgagctaattcttcacaaagtccaaacgagcagcgggaacaggggcaatcggttctttttatctaccttttatccatcacacactaactagtagtagtatctgtgtatctacatcatcgctctccatttgcgggggaaagacagcacagccggtgcccattattggtgcaagttctttccccccctctccctctctctctctgtggggttcgggtttatcgcaagttgttgtcgtgggtctttagccggactggatggactgacttttctataccgaatagtaatcgggttgggatcggccgaaatgcggggttgcaagcgagctggcatttattgatcccagtcctatctttccttctgtctatctatctatctatttatctatctttccggactatctgtggattcaccgagaggagaaggtatggatgtatgtatgcatatacccctcagttgtacaataatagatagggttattagcttgttccatgcccttttcgtcggctatgtcatttagatagtagtacaacctctgaagatgggggttttctttggagtagacagtctaagcgtccaccttagcttgcctgcagtataacgtaactcccgcccgcgccggggccacccagctgcgacggggtcagaattgagtacaacagtgtcagaacagagctggaaaaatagttcagtcagagtcagaaattctgactctgaataatctcccacaactattctttactgttatctgaagctattctcaactaacaaacatgccaccaaaccagtctaaaaggataaaagatacagcggagcaagaagacaggattctatttactatcaaggctttaaagaagcatcaaatctgtttattcgtgatgctgtatatatttttaatattctgtgttttactcttttggttcaatccggtccaatccaattcacatccttatacctgatcgagcccgctaagtaagatgcttgcaggtgcttcgctgtttgaagcaagaatatggcccagaaacgccgtcaaatccttcaaactcgcgtaaccccttgaaacaacgcaagccacgaagtaggaagtcgtcgccgtagccaaccacaaccaggtatacaataaaagcaaagcaaagcgtagtcatacacaaggtactaacgtaactcccggccgcaccggccacccagtacaccgcccaacgcgtttctacatgcaaccactcttttgttgaaaggctctgaattagcaatgagtagtacgatggttctagggcggtgtgctagggatggccggtgcggcagggagttacgttaagagtattcatcttcattccttggtgccggtcgccgctgctgcttttcctttccggcaaaactgagcagcatgccgatgtcatagacggccttcaggatacccgcgatggtgaacgaaaccccgaagactcctcgatcggccaagataccggtcaacagaggtccaaggctctgggcgcaggttttgacgacgttgatagagcccatgatagctgtgcgacggtctggcggcagcgctgcagccagaaaggcggagcgaggagccacatccatagtttgagagcaggcgcggaggatcaaaaaggttagcgccagcgggagaatcgaaggaactgggatgagtgccaggcaaatagcggagggaagatgagtgaagaccatggtctgtagtggtcagcaagggtaaggaaggaatgtatatcttggggcaaagcagaccttaacattgccaatgcgcttggcgatggatgaggccaccagcacggaagccgcagagataaggctggtagtgaagaagatggatccgagtgacccttcagggagggagaacttgcgcttgaagaagtatgtcatccaggatctaaaggacatgtcagtttcatcgaactatacggattctagggccgagttggaaagagttgccaagcctctaggtggaaacatacagagacgccagtccagaggcgaatgagtccaaaccgaacagaatcgcaagtcgcagaaacaaggagacgacctcggaatcgccgaggaaagacagaattgatttcttcttctgaggctgctgctcttggggggtggcgttgcccgtttgatcgcccagcagaggctgtctttcaccctcattagtagactgtcgcgcaggcttcttcttctcagcctccacagcggagctcagtgcaatagacaggagaaacttgagcgcgccaatagcggcataggcgaagaagatgactctacaggcgggaatatagggccatccccagataacctgaagcaggttgatggcccatccgccagtcatcatgcccagagcggttcccgcattgccaatgagcgagtaccatgcgaagatatcgctcaagatgtcattgggggccagatgggccaaagttgattcttcgacagcccggaaggggccaatttcgtttccactgttttattgagtttgtaagcgcgtatgcccagacatgtcggagatactataaatagtcggatgttttgctcggagatcggagaacttacctcggacttatgacgccaaagacggctgccgccagaaggacccagtaattgccgaccgaagcaaagaggatgccactcccgaccattaaggctgaacccagggccaggacagccctgcgacccatggcgtcggcaaacagggtgaggaggaagctgatggcgacatcgcccaccagggtcaaggtcatgaaaagaccgatgcgttcatcggagatacccaatgctgagagataggcagccagaatcagagtcgaaccaccgtaggcgaagagacgcacaaagcgctgggcgcagagaagtttgacatcgcgaggggattgccagactgaagtcaggccaagttcagcgaggatgcggtgatgcacacgcgtccctcgcgaagaagcggaggcagatgcatcggacggggccgacatgctaaggatgcgctcgagttgaaccgacaatcgaaccctcaattgtgaatatggacaagaagaggaagaggtgaagaagaaaaaaaaaaaaaaaaaaaaaaagagagagagagagaacgaagaggggaaggaagagagtagaaatagaagagatggagggacggaaaggcgggattgaagttctaaaagatcgtctcctccaggcagccaggcacccatccagcgtcccatccagaaatcatcaatcaattgactggcgccaacaccttcaattggacctgcagtcaggttttccctccattacgaacaaaattcttgcccttcctagctatcgcagtaatggtgctctgaaggaaatttctatcagagcttgctcgtaaggattacttgcattgcaacactcgaaattagcgcgggcgcaagacagccggcccagctctttaacatctcttcggctgcagacaaaggctttctccacaaccttttcgatgagtttccaagtcgagcgaggtgaggagacctcgagtgtctggccgagccagtattcttcaggaagcaatataatctgcatggttaacaataatcgaggaagcgtagaaggatgatcaacccttggtatgccgactaccttcaagccggttcctttgttcccccctactcttgcgacgctattgctgtcgctgttcgttcgagcagctgaccagtcaacagagcaaaagcgacgccgcgcttccgtgaagcacgaggaccccgaaacggacaatggtgtacctctggcgctcaatggaagaaagcttcccaaggcatcggaaacggctataggtgaaaaacctggttctgacgtgcctatcgaaagaaatctcgccgccaataagaagaagattcagcagaaggcaaagaaggaggcgaaagtggctcataaaaaagcctctccgtagactacaaaggccgcataaagcaagagacaggcgaatagcgtgaaaaaagagcccgaggacgtgaactggaggcgtgagctttttttttttttttttttttttttttttttttttttttttgggaaacagaagatgggacgagatgagagaaaggatggacgagataatgagagactctgtgtgggcacgtgtgttaaaggaagtaagagtaaaactttgcagcattcgcattctgtcaaacgtcgagtcatcgtatggatctccaagagacgtcttcgagctttttggagatagtgataggtcatgaaataagatgaaactagagacgcgcccctgcagattaccagtatttcagtagctatagacttaaaatatttttacttaccacaggtattccagtggttgtttgatctttaactgcaatttcttagagtatatatagctttatggcacaaaagccgggctcatgccttcttcaaacgaaggattgaatatgatctaggtcttaagatgattgttggctgatagtgtaagaggtggtggtcagagacgcatgaaggtagaggaggtggtggagattcaggtggtgcccggctacagtagatgtctcaacattaaatcatgttgaatattagttatgtcttttcggtcaacatggcatggcctgtcccaatccttcctcctcttcctatttcattctccttctgatttgctctcatactccgtcttcatcataaacctcatcatttccggtgcccgacacactttctacgactaattacacaacgaccctcccagtccggccatctacaattgcggtcgtggctcaccggttgtagcttcccaaaattgtctcttctatgccgaactgcaactagaaacgcccgatgctaagaccagaccctcaatgcgcaattgtcaattattcccttgtgctcgacagcccagcctaccgcggactatccggctgacatcaaactataaatacaaaagcagctgagtaatagctaccgagagtggcccacaaatagggctgacagacactcagccttacggtagattagcaatcggccattctacactttatccatctaaacaccttggaaaaacgcacatacggaatggtagtagttgatctattttctaatatcaaactagaatagctctactggttattaaacttgtgatttcttggtggattactcagttcacgacagtaatagtaatcccaagttgtgagggaaagttaagcgaaccgatagacagaaaactaaccaacccgagatgttattttgcgcttactatttttttgctttctataacaatatgatatagttcccagcatataacatcctcgatggtctaacggtcatgatttccgcttgtcaatccctattgggaacaagcgcgggagacctgggttcgactcccagtcggggagatatctttttgaaaatttcctttttgtatcatccagctctatcggggcattaaattaatcgtcgtggttgacttctttctgcaagagtacaacggtggaaaaggggagtagaagaatggtctatcatgatatggggacaatatcaacgctgatctatttacaggaacaatgcacatcaaaacactctcgacaaaggcggaaactctcatccctcactgagactctgctcatagcgacgccgtcggcagaggagattccgtcttcggcggccacttgacgcgccgttcagcacggacatacaggttattcggcctgatcagctggaacataggatcgtactcaatcgggccatcagtctcctttgtgaacctgtaccggtacaccaatttgggcagaaacaccttaacttcttgcagagcaaagttgaagccgatgcacatgcgaggaccggccgcaaagggaatgtaggaagatttgtgtcggttcttgacctcttcagtatcccatcggtcggggttgaaacgcgtcgggttgtcccagacctcgggattgttatgaaggtgatgaagtgcgccgatgacgaccgagtcttcaggcagtttgtagccgccaggcaggatcatatccaccttagctgtgcgcgcgggttgataggacgggttgtgtcggcgctgagtttctttgatgaacttgtccatgaatgtaagacggtcggtcaagtcggcagtgatctgcgtatcggcgtcgatgccgttatctacgagctcttgcaagagcctatcctgcacaccagggtagttgacaaggctgtaaattagccatgacagcagcgagctggtggtggtgaagcccgctccagttgccacaactagagcttggattaagctcgttttgggcaacttttcgcctttgttatccgtcgcccggatggcgtagtctgttcggcagttagcggctgtttgaaaggtgataacactggcttaacataccaatcatgttatgggctttgagggcggcatcctgaagtgggagatcctcaacgccaccacgactagcattctgaatggactcgtcgacaatgttccagacccgaccacggatttgttgaaggcgtttagagtccccgaagggcagcttggcataccaatcacctctggcagtgatctttttgttcagttcaagtgactcggcaatcagaagaatcaattcatgcgggggcgcattcatgttggcgaagtgttggaagtcgatgcctaagactagctttccaaccgcctgagagccaagcttcaacatgtattgatagacattccacgcttcgccttgctcgtcaaaggcatcaaacactttgaaggcatcttctaccgtttgctgcataactggcgcataatggcggacagccttcggaccgaacgcgggagggagaaatttatgggcagttctccattcaggcgtgtcggtgtcgccgaggaacacgcccgcttccttattcttgattgcatgaagcgggtgggattcgttgattttcttagtaaagaaatcactttcagagaagacgatcgcactgagttctggatcgttcgtgtggtatacggtgcggccgtagttggtggtcatgaagagaggcccgtactgctcaaacaagcgctggtgattgcccaagtgatcagggtagatctcgaaaaagtttccaataatcggaagcccctttggtcccgggacctctcacaggtttcccatcaatggcgatactaattggggtttcagaagcgatgatctcggccacactggtgaagacggcgtcttcagactgaaagccgatgcctagagaagtcagcttggaggagattctcaaagttcatacgattgagggatagggggcttggtaccattggggtcgactatcgcaaaatgcgcagcgattaggtttctaagcccatcatagtctagcgatgagtccacttcaatctctcgagcattcgcaacgggctcacccaggagatggaaaagctttgcggacatgattagagtggtggttgaaaatctctcaatgggcggatggggacactctgcctgctcagggtcatcgtagagctttatagatagtacgtactatctctaataagaccacctcgatgcgacagacaaatcagggcgaacgacccagactgacaatgaacccacattgaccggtcatggttttcactatccacatagcaagaaaaggaatggtttctggtttcagcgatagtgcacgaatagcgttcattccagagacaattatgcgcatagacgttgaaggcctcggcgcctgcctcggttgtttcgtgagtcgccgtcaccgaaaactcgaactaacaacagagaagacaacgatcgcccccccaagacccactggctacggagtttctgccagaaaaaggggaatgctatcgcaggctcaagccaagaggttggtagaatcgtcggctacgccgtgccgaccttccagtcgggccgttaagcgtcagacgtggccaatctccgatgtaaggatgccggccgagccaagcgttgcgagacttttagcaacgcaatgtgggtatctggttgataattatgtcgcgcttcattaggcgcatatcaccgttatacctcggtgtgaaaaaaaaaaagggcagttataatgccggagccctggttcgttttattccttctcaggagtacgattatcctttaccatctcaccagatcccctttaaccaataatggcccaatctgtgcccttagagtctacagcctcgatgggagctgattcccagcttaccgagtatactttggccgatattgccaagcataatcgcaaggatgacatctggattgctgtccacgggcaaggtaagggatttccagacgtccaaatgacgggatactgaactgctcccatagtttttgacatcactgagtacctgcaggatcatccaggaggcgtggatgttctcctagagactgcaggctctgacgccaccacagctttcgaggatgtcggccattccgaagactccagggagatcttgcaggagtacttgatcggtatcctcaaggacgctaaaaaatatgttcctccaaaggccgtccgtgtgatttcccagaagccagagaagactgaaaagccagcaaccaatctatcacgcctagcagtcactggggctttaggagcggtaacaacactgctctacgttctgaatcggaaagatcctggcgttttgaatatgagaagagtcctcggaagcgccataccacaagaattcagtggatacagactaccaggcggtggattcgccaatggattcctcgcagctacgctttttctcctgcgcgattggcagcgtagtggcgcgccaagcggccaaaatgatgaagatcgatcatgggtttatgcgctatcctccgcacatcaaggcccgaaaagtggtccgggcagaccctcatatggctaagggcttcctcgactcgaaggaataccaacgtctacctttagttcagaaggatctattgtcgcccaatgtgtaccgatttgtattcgctttgcctgatacgaaaggggtgattggacttcccattgggcagcatgttgccatccgcgctaatattgatgggaacaccgtgagccgatcctacacccctgtttccaacaacttggacctgggccgactcgaactggtcgtcaagtgttatcctgacggtctactgagcggtaaataccttgccaacctgactgttggggacgaggtggagttcaggggacccaagggagcgatgcgatacggccgagggctttgtgccaagattggaatggtagctggcggaacaggcatcacccccatgtatcaactcattcgggccatttgcgaggacgagcgtgacacgaccgagatcagtctgatctatgctaaccggagcgagggagacatcctgctacgcgaggagctggaagattttgctcgcaagtatcccaagaacttcaaactctggtacatgctggatacggcccccgaggggtggatgtatgggtcgggctacgtgaacgaagctgtcctccgtgaacgattgccagacccatcagcagagactaagattatgctctgtggacccccaggcatggtgaatgcgtgcaaaaagaccttgggcgtaattggattccagacgtcaggaacgatctcgaagatgagcgaccagatcttttgtttctagatttataaatttaatattagccccagataatccttcacacttcgtttttcttttcttttgtttgactaaattgtcccaagtgttggtaaataacctcctagaaattcgaaccgcataggtggggacgatgcacagcacagacgaggcccgactggctggcaaatcagaggggctagtaagaacggttattggatagggttacgactcctgacaagggtcaagagggtctgctgattcaagtcctaagataactaacggaccaagtccgggtgaatgtggtgtcacattgtgagccgttatgtgccattgtgcgcggttgagagaaaatggagcatcgcgatggagtcgtcttgccagaaaaaggcaggccgcagtggaggcaactaggccatacctgcctaaccgggactggtggctccatcctgacttttggcgctccaccttcaaacttggctgcgactttctagaattgcttctctcgcattgtacctcggcctacctttgctctgccctactgtgtgtggcttagtttgtttagtgatcttcgtctttgcttcataatttctgttccaatcaccgctgtttcaattgttgttgcataagtaattttcctctggttcataattgccccaatcttcccagcagaaaatgccagcagtgaggtaacacttctaagcagactctaataaagcagacacccaccaccacttcctgagaccggaatagatttctattccaggaaagacccgtcaacggagaatttttgaatcggtcgctgttctgaacggttctcaaggcataacacgcaatcaaatcgtggagttttatggaacggggaaatgaaactagacccagttaatgtggagtggatgcgattcagcgaaaacacggcagaaagtcgtcagcccgggaaaaggacccctttcaatggagtgaggcatgtagagtctctgaacctcggttgtttttcactcgattaatgacgaggaacgcaatctactgtagggagggcgtctctactacaattgatcaagttttctgctgggaacattcagccatttggaatgcccctaccctaccaaaatgctggtctgcggtcgaatatatcgagagagtgtatactaatctgttatggatgaatgccaatataaagcgctacatcctagtctctctgcatgatgtgttattacgagtggcattgatcacagccttgaggtatgtcaagatgaagggtcaaggatatatggattttgatctatctagatctcaagagagtggttggtggttggaagaggtggtggtcagagaccactcaggaagaaaggcgaaggatcagctgacagctgcctggctgcagtgaatgtctcaacaaggtacataatatccaaccccagactgaaacagaagctatacgtatgaggacttgatggtaggtcgttctcagtgggcaagtaatgtcagtcacagtcaacgattgtccgtgagcgacaagacaaggcggcctcgatcgggctggtcggggtcgcataagcttatgcggcttggcgacgccccacgtgtagtagttcgaacatggcgatgccacttcacttcagccagaacgttgaactgcagcacccatttgtccaatttcttcctgccattgagacgtgcgaataaggatcagatagtctggagcagggcgtacagttgctcctctctcccttttatacgacatctctagcgctgctttacagaaatcctacgatgagcaccatatcgtcaatgccacatagtccgactgatgcttcctctccacttcagtcttacgcccgcacttgctcttcttgtcgacagcgaaaggtaaaatgtgaccgccaacggccttgtatcaactgcagccgctcgggcgtggaatgtatctatccccccggacgcggcagggctcctaagcggccccgcaatgccgtgaacgcgcagttgtcgcaccgattaaccagactcgagtctatcataaggagcttcgagtatcatcagaaccaggaaagctcaactcatccacctgcagcgccagtcgccctatcgtcccgagcaggcagcagagcgtcagagacttcccgtatccaatctgtcccccgcacgagcaattcagactcagaaaattccattgagcagcatctaggccgcttgctgatagatgatacacggagctactatgtcagtaacgtcctctgggcgaatctgggtgatgaggtatgtctgggtcccaaccgagactctcactgcattcattcgctttcaaactaacgagtaacgaagtagattgcagagctgcgggatctactacatgagcccttggttgaagaggattctgcctttttggaggagcccgttccggagcgacctttgcctacgggctcaaatgctgcaatattaggttttcgggctcttgctcattcacttcatccctaccatccacccttgactgagtcggtgaccctcttcggggtattccaagagaacgtctctccgatggtacgtatcttccatatgcccacgttagctcgtaattattgggatgcggttgcgtctctcgaatcgcttgataaggataccgaagccctcttattcgccatatattactctgcagtaataagcatggagcccgagcaatgcttaagaactattggcgtctccaaggcacatgcttcagaaacctatcttttcgccgtggaacaggccttggctcgtgctgacctgctgaatacgcaaagcgtcacgctattgcaagccgccgtgcttttccttttcgcgctacgcaacgaagatgactcccggaccgtctggtctctcacagcactcatctttcacatcgcacaagccatgggtctccaccgtgatggcgtcgtgtttgggcttaagcctatggagacagagctacgccggcggttgtggtggcacatttgtctcctagatgctcgctcatcagagtaccacggctgcgagccgattgtgcgggactcagcctttgacacgaagctaccactcaatgttgaagatgctgacctgactgccgacatgagcgagctaccaactgagcggaccggtgtaaccggcatgtatttctgtcttattaggtgtgaggtcatgcggaccatgtggaagcttagctgtgtggctcccggcttgggaggttcgagacttgggactggcagaccatctctgaaagaacgtgaagctttagtgcagaatctgcacgatcgccttgaagagcgatatttgcagcactgtgatatctcgcagccttttggcttggcttcaacattcgtagcccgtctaatggttgcacgcgcgtggctcgttgcacgatatcttttagatgagaaagaacatggtgacaatttatcgggccctgtgcgcgatcaactcttcatgtcatctattgaggttctggagttatccagcttagtcctcactaacaaggccattgctcactggagttggcactcaaagacacacatccaatggcatgcagttgcctttgtgctctctgagatctgcacccggcccccttcggcagactgtgaccgcgcatggcagtacgtcaataccgtctacaacaattggaagatgaaggaaagcgggagaaagggtacgctatggcggcctattagacgactgatggccaaggcacagtacatacgagagatgcaggagctagaccctgccggtagagggagacagagagcgccgccaaaccgagatagtatgcaaggggttctaggccccgagatgtgctggggtacgaacgcggcatatgtgtctacacctgtcgacacagcctgtaatgtggtaggagctctgcccagcgaaatcttggcggggactttggatcccttcgaagagcttttccccggtgctccgcacgttgagagctccgcacatgaaccgtgcgacaatatagggccaatgctccctctttatgatgactcccatattcctgagtggctggttccggagtggatcaggaatccaccgggcaatggggaatgaggtgaagcaggggacatgagttccctttcttcggcatactgcaggtctcacatcataagaccatcacgtacacgactcctagaggccatcccagcggaaattgtaccactatttagccttgatgatcaattgccatattcgtaggtacgagcgtgcgaaaggtttggcgggaagaagtaaggataaaagcgattcgatgttattctggatgagggtgcacaaggcgggctttcaacatcttcattatggccgccatgagtgcgaccgaccggagaagctcagttggccctggggtctaagctcgatgtcattgggatcacacggactatgacaggggtcagcgggggttcggataagcctatgcggccccgaacaaaactgcatgagccttccgtctcggccatcggttgcgcataagaccaatctgttcgagtaccccatctgtgtggacgcttgataaatggacggattccccaagtgagacgtggcagtgctgcttgcttgctatcgttttataaaccgggtgctaacatcaatcatgtctctcgaccaccaagagcgtaccaaaagcgaagctgttttggctcatcccctactctacgaggcaacaacccctgatgttctggttgacttcaatggcccagatgatccataccgttctatcaactggcctttttggaagaaggccatcacgacgatcctatacggaatgactacctgctggatcacctttgcgtcggcaatctattccgcgggaatgcagccgatcgcgcacgagttcggcgtctcgaaggaagtatccacattgggaatcagctttttggtctttggtcttgggctgggaccgttgctgtgggcacctttgagcgaggtttatggccgtaaaatggtcaccatcttagtacgttccctgtcatgcgaccgttagttcagactcgttaaatcaccatttcaatcgagctgacttgtgatgcagccgtatttcatcgccgggattttctctttcggaacggcaacggcaaaggatatccagacattaatgatcacccgattcttctctggattcttcggcagctctagcgtggcaataactggcggtgttatggcggatatctggaagccagaacatcgcggtgtggccatcgtcgtctattcggtcactctcgttggtggtccttgtcttggtcccatcattggcggggcctttgtgtctaatagtagtctgggttggcgctggacggaatacctgacggggatcttgatggtagtgcaatccgtgttggacttcttggttctagatgagagctatgcgcccgcactgttggtccaaaaagcacgccgactgcggctggaaggcaagaattgggccctgcacgcgaaggtgagcaagcgcggatgctcagagacttgcggcttcttccgagtttgttctcatgctaactaaacaatagcacgaagaatgggacgtgtctatctccgagatgtcgcataaatatctaattcgccctttccagatattgaacaccccaatcgggctgttcatgtcgatctatgggtctttcgtttacggtcggtagtcaatttggcaggggttctgaatgcggttggttactcaccatttcgatagccatcctatatgtaaacctcgaaagctttccgattgaattcgaggaatagcgtggctgggggcatgtcacaggaggccttcccttcgtcgccctcctcgtcggaatttttgtcgcggctctggccaacgtctataacaaccgatattactttcggaagcttcgcgagaataacggcaaacccgtccccgaagcacgactgcctccgatgatggttggaggggttgctttcactgggggcttattcctttttgcttgtcagtccataactccctaacaacatctcctggcccccattgactagaagcagggacctcatcgcctcaaatcaactactggccatctctcgttggcatcgctttcacgggttttgggtttactactatctttcaaagttcaatcaattatttggtcgacacgtttttgcgcttcggcgcaagtgctgttgctgccaccactcttctacgatccatcctggcgggtgcattccctctctttgtgcagccgatgttccagggcatcggagtgaactggggcatcacggtattcgggtgcgttgcggcggtcttgatccccgttccgtttctcttctttgcgttcggcaagaggattcgcgcgaaaagtcaatggagtactagcaattccgcatgatgttgtgtcaggacgcagggaggaatgtatgtatttgatatatctagatctcaagatcatggttggctacttagtgtcagagatggcggtctccgaccacgtcgaggtggcagacgatcaggtgatgcctggctacagtgaatgtctcgatatgagatgttgttaatagtcattaggataatatatagaatgcgatgatggccgtctcatatcctaaaaggggaacgggatcaaccttcactaaatgcatgcatatatgatgagatagtcgagctacagataccctattcagacctttcttaattatatgtccagatctcgggagagtagtgtgcatgcactgatgaatatctagaggatggcacggcctctggttggacatgaaaagacctgggtggagaaggaatgttgtcataacctatcgctaaccgagcggcttcatccggatttgcggaaccgctcctcggcaagagagtgtggcgggtggctcttcggaaccgggcgtaccatgtgtacgcgggagtatcttcgaaaactgaatgcatgcttaacacgaagatataaatagtcaaagcgacttataaagtatatcccaattcaacaatcgagtgtcgtttcaatgctctgtcagtccagtatgtgtgtggctggttgatgtcggagcaagttggtcgcgataccttccgtaaccggataaagggtaggagatcagaacagttcgttatgtcaccgaagaggcgatgacgttcaggaaagaaacagagcgaaaccccagagccaatccagtccctaacttgacttacttcgtttagtgtccctcggcttgccgatcggatccaaccttagcagccacaactcctctctctctctctctttctctcaatcaatcaccgtccatgaaacccccttccttcatgccgcaccattattcggtcccctgttggtcccaccggatggaacaacaacaacttaccccccggggaattttggatccactggggctagacctagactactgttagtcaatcagtcagtcggcagtggtcgcatcattgccggttcttctgagcccaggtacgtcattggaaaaggtccggtttctcgtcgccacaagttctgctcttttctttttccatttgatttttcatagtcttccccgaagctatttcaccaggggcatatcctcctattcttagtctgggctttcgccatctgtacatcatcatcattattatcgttattattattattattattatcatcactttagttttatcggtctttcaatccgtccagtcaaaaacacgtacctgcctaaatatgtcatctaacggtatcacaacgagaaagattgtctgcttctcaggtatgtaagagaaacgattctgtgtcttgcttgtttgcttgctttctcgtgccgtggatcagtatctccacttggaccatgccgctaatccgcgacctatcggacagacttcgatggaacgatattcatgcaagatacgggccatgtcctttttgataacctggggtgtggtgccaagcgccgccaaatgctcgacgagcagatcaagtccggcgagcgctcattccgtgaagtctccgaagaaatgtggggatcgctacggatccccttcgaggacggcttcgatgtgatgcaggaggagctggatattgatcctgggtttcaggaatttcacaagttttgtatcgagaagggaatcgatttcaatgttatcagtgctggtttgaagccggtcttgcagaaagtgctggacactttcctaggagagcaagaggtatgttgattttcttcttgtataggagttgagggtctggagggtctggttggtcagttgctgattgtttgccacaggcatcgcgcattcagattgtcgccaatgatgcagatatcaagtccgacggctcggagtggaagccgatctggaggcatgaaacagagcttggccacgacaaggccctgtctatcaaagagggtcgtgcgcaagcagcagaagatgccttggaaggagagatccctcttatcatcttcattggtgacggagtgtccgacctcccggctgctcgtgaagcggatgtccttttcgcgcgcaagggactgaggttggaggaatattgcattgagaacaagatcccctacattggcttcgactcattttccgatgtcaagcgggaagtagaagcgatcatgaaggaggaccaggagaagaccaagggcgtgggcaagcctgcccggtttaacccccgggccaatatgtggcggcggatttccagcaagcaggctgtaagtgcatggctgattgttgcagatgcatgatccatgaagctgacagtatcacaacaggttccgaagtttgtcgctgccacaccatccagggaagagaagatgttcctctggccagagagcttctccgaataccgacccaagaatgcggatgatatccgagtttgagagtcgatttcagttaatgtgtggatgactcattttcaggcgtttggtggagtgagctgggtacatagatcctagatgtgttcaaatgaatgttaatttcaaacctattctgttggggttttgttgtatatcggatatggcttaaaattggaatggcgttaggttggctacatactacgaaagcttgcatttgggtgattggtgttatccagtggaataggacaaagaccgtaacttgtcaaacaagagagtgactattgagatcccgaaaaggaaatcgattcgagattcacatgtttcatccaaccgtagttttttcagcaagccatgtggcaacccagggctaagcaactgccaagagccaacaagctccggagtatacccctggcactaagcattgctgccataaatgacagggttgatatggggctggttaccgatacgaactgtccttgtgcacagccctcacacgtagataactgtcagcgccaatagtcagatttatgttcacctagcacagtcaggcgtcctgaaatgtattatcttacccatatgatttcttcaacgtgaaggcctgaccccgcaacaaatgtaatggctgatgcctggtgtggctgcagcacagcctcgtaatctgacacttccgtcgcgctggatgcctaatcggggcaagcgttgcgggatctggccaaaacatccagcctaagtgtgaggtagagaatactataagacttctttgtcttgatgggcgtcttctcacctcttcttcacttatccatcacatttcacacctccacagcctcggcctcaggacattgttcctcgacaccatcagcaataacacttctccagaagtcatggatctcagagtcaccctcgtcaagggcatcgcatccggcatcggtctagcttcggagagcatatcggcctataaagccagcagagaagagaaaaaggcgcaagcagcagactcggacaatgcggtcagagaagcgactacggaggacaccggagtcgaacatcttatcaatgaacagcacgaggaggaatgggttcttgacgaggcacaagatgaactagctggggatgaacatcgcgcttattcagagcctgccagcggtgatatcgagggtctagcagtttcgttcctccaaaattatcccgctccacctccttacgcaccctcgccgggctcgcccagactgtcttgtcctgtggtgctgtctcagcgacggccaaagtctcgcaagagaggctttattcgagcctatgctcccgtcctggaggactttggtatcgacaagaccatgtttcttgagtttttggagacatcgaaccgagcgtgtcaggcgactccgtggttgcaggctatcaatctggcatctattggtactatgttcattcctgaggctatttcaatagctgtttctattctgatacaattggcgactgatgtggcgatggctgttgatggtaggagaaggtagggcttgcgtggtatggtgtggtgttgcttgtgtgatgctgatgcatagtctataggacgaacaaattctttgacaagatcaatgacgaatttttccgcccccgtggtctcttctgtttggttatgacatggaaaccagggtctgactcaccctatgctaccttcgatatgaactccacgatctccgcggccatcgagcatggtggagcaggactaatgaacagggtccgacataaactcaagtcatcggatgctaagacgcacggcactttgcccttctcggagtgtgcacctcttatctttcccgaccttgacgagctagcagaacaccggggagacaaccagtcgaaactcaagggtgcgaaaagaagaaaggagttcgtctcggattactgggaccgaaggtcacaagccaagttcgtatgttatcgagaccacactaatggtggaggattggtactgaccaggatattgtagatgatgaagaatccagatagcgctttgagccagggtcacaagccaacattcacctcccgttatgccgaccctagccaccctgcgagcagcggctccttggtcggtctactcacgggtggatatatgactggtgagaggttggtgcaacttcgaagcggcataagtggaaccgatggtagaagaggtctcagcaggcagtcgattgaaacgccaccattgtcccttggtggactggcggctggtattcgtgcagccaggtttggtcgatcgccggcagaagatccgcaagggcgaagtgtgatgcaaggcgaagagggctatccacagccagttactgaagcttcgactggtggccaaagcgttcccggtcgtgggcggggaatcagagaccttcgccaggcaggatctatagtaagtccaattggaggaatcaaaaaacttctgaaggaggtacgtatgaacccttttccggcagcttgcagatgctaagataataatgacagaatattatatatctcatgattgtcaatatgccttcggaggaagatatggaagaagctcggcggattctccagtcacgatcactgttttgaatctatgttgttcggtcgctttatctttagcgggccttgtattttgcttgctttcttgatctgttcttgtagttttagcgagactaaaatattagcaagggcgtgcagagtaagttaaaatgtttatggaacgagtacctgtatggtttctgttgccagcaggcagtcaagggatgatattcgaatggttcctggaatgcccggcttttggctcatggcacagaatggcggggtagatcattagcgatttatgaaagcgatggaagtgatcgaaaacatgaaagttgggtgattggcttctgttcagcgaagcatagcgtcccatacttcgtcacccacgccatcagaatagcccatccagaggcaaattttaccaacgcccataaaattgcaactataacggaaggttatccatccgagttcacgtctaggcccgcctattcttgaatataatctgggtggaatacatgggacatggaccctaatgataaaacacagaataagctgaagaggcgccaaatcgcccagtttctttcgtattgatactacatgggctagagggggcaaaaaagtggattgacaggtaaattgcctgtgctgtgtttatggcaggtgaagaagagagggatagtaaaaatgcaaaaagagatctccccgactgggagtcgaacccaggtctcccgcgcttgttcccggaagggattgacaagcggaaatcatgaccgttagaccatcgaggacttcttatttgctgtggccttattttgctttatgttcttgttagatatttagaagactgaattgccacccccaacgaggcagcgtagcactacctatctataaagtatcttgtcgcttgctagtccatatgcagtgtctataatatctatagtatgtttagattccgaaggcatggtctattcctccctttggtcactggaggcttttgttaagaagtaatactagtacctgctactattattatggttgccggatatatattgccgcaaccctggccgcgcaacgatagttgtcacaattcagtaaattcaatgtactgttatcattatcagaccagaaatgcatcagtctacaatatggtatatcttgttaattctgaaatgcattggcacagggaaattgcattgatatgccaagctacccttggataagtcggggcaccaagcaaagaaggaacagggccaatcaagagacaccaaggtgagtgtctctaaaggtgaggataccttgacaagcttccttgaaaatacctgttgctatcccatactccactctcccgcttgactctcctagtgaggtagagggccagaacagaacatggcactctcttggtggtttgcgcggcgccgtgccgggaggtgtggaagcgacaaagagaactgttctacaatatatgattatcgaaatagctctgctgtaccaaacgtctagtggcactaacaccacttcccagcaggattagtagcgaaaagcactgctgtattcaccgatctggaaacagccgtatgcccatagctatatgaccaaattcgggaaagttcgtcgggccgccacgtccatggttggattatcgaacataagaaattgaaaagccaacatagagtcattattcactcacattgagctcagaactgctagtaacaccgggggtaatatttgtcactgaataccctgtcacatgattgtggccttgcttctgatcctcttttctttgcctccccccaccctctcttttgccttcaggtacagctatccgcaactaccaaggtcagctaatcggctatttactttccttaacctggaatcaaacctcttttccagactattatccacgatgacggagagtctggctcggaagaaactgaggtcgctataccttggagtgatcggggaagagcatagtacacccttcgtctctaattcctctggctcagaaggggacgtcctgccgctgtttctgcaagagcatgatatatctatttcttcttaggaggttgagtcaagctctgaagatctgtcatcggtaccgttcgtcccgcagcctcggtcgtttttacaagcccaccccacaatttctcgtcttcccttccccaactacatcccactggccgatagagacgaggctcgggaaaatggatggttggtgaccgacgaagagaactgttcccaagaagctgctttcttcttcacccaatgggctactgccaaccgagtcttccatcgtccgtactcatcactgatggatttctgcggagtacacaaaatgacgtgagtaccatacatttcaattaaaattactggttcaatcaataaagtatgctgatctttaggccaccgagtcctttcatgagtttcgccacacaaatcggatggtgtccacctacaggacgctgctggggcatccgccttttccttgagccacagagtcgcaatagtgcaccacttccccatgttgccgcggtggcttaccagccaatgaatgccagagatggctcaatattgggtggtgagctcgttgccattctttcaattatgcatagccgtgtcaaggagcccaaagtggagagtgaggaggtgatggaaggtctatctgatatgaatgagcaagagcttgaagatctttccaagaaaagcccagccttcccagatgaacagaagtttccagtcctactcgtgtcctttgtgggcccacagcatgcacgactactttgtgcctcattgaacacaaaccttctggtcattcatctctcgaagctttatagcttcgagagagagcaggacgctccactcgatttatttatgtcctggctgtttgcgcgtcctgtggcgggagcttgaccgattttgttcaaagcacttgccatttgtatctaattacttattaccgaacttgataccctgtgctaggttgccctgatcattgtgcagtagtggctggccatatatgatcgtgactttgaggcaacatcgtccggctaatatctgagtcagtactcatacaggaatacttgtgcggcttggtgagcatacttcttgcggtagtaaatgactcttctcccagaattgcatctactcttattcagaatggctagttatctgtgggagagatagagaaggaaaacaaaaaaaatagaaagaaaggaaaacaaaggagaggaagatcgagagattatttgcagtaatcttcactggtgtggttggactctctcttaaaatgactatgttacaatagtaaaagcgccataatgatctgggcatagttccgtcggttggccgacatatgtcccaggggccgaaccggcgcatggtcgcaaacccagctctggagagacagcccgggcccccctccatgtacctcaaccatccatcatcgtaaccaaagacacaaatatagagctcggtaccatctttcgacaaaagtactcgtgaatcagcagcccctgctaccgcgggaaaattcttaatccatgcgactatctctgccacttcttgcatgtccactttcggagagtgattgtctctccatgatcttttgcattcgacgagtgccaaaatccgaccggtggtggcatcttccagctgtccgtctgtgtaggccacgaattttctctcacgctgcggtgtgccgaagtccgccacgagtttcttcctctccgttgtccataggcgttgagcaggctgcggacacaagtctgaaagggcgtgcaagaacgataaaaaggcagtattgacggtcgactcagttgcgccgcgattgataccgttgatagtcaggttgcgaatgacctgctgttgttggactgctgggaccctaaagaggcggtccgttccaccccagacccaccccgtcgcctgcgcctgtctattggtgaaattcgcgatgtattcgttgaacgccaaacaatttagccgctgattggctggaatcataagatgtggttttccaaacgtctggacgttcagctggtttggctgtacaatgggagggaggagggtgcgaaacaagaggtattggcggtggctgacatgcgatgcggaatataacttcacgttcatccgtagagtttgattctccaccttgtttctccttgcttggtctctccagccattctgatcctctggtaatattatggcagtcatgatgacggtatgaggatttatatctaggaatgagtctcaagatagatggaatgtgggatgtagctctggcgaggcagagatgattgggggtgcgaggctcagtgaatactcgcaatggtacagcccttcttgtgttgtgagaaagagaagattctgtctgtttgaattcacttgctagctcttcgcgcttctcgtgtttctttttcttttctgtcttatctccctcctttcctcctctttcttcctctcactacagcctgcttccatcttaaaaggcactgccaacaggatctgttcaggttttactttctttacgttgacaaattcgtttttatagctcctctcttcccccaaacggccttttcgctatgtctgtataccagaatagcaagctgcctgatagcctggtcattgcagcagccgaggtgagaattcctatggaacagactcttgttacttgagcgaggctcacttagaacatgggatgatagaatggcttcctataccgcatgttgactcgccctccttgagactgttcgccccggtaagtccctgttccccctccccctccctctccctcttcctactgtcaacctccccagcacttcggttccttcgtatcgtcggaaccgtcgtgatggtggtgcccgagtgttgcgaatacgtctggtggctctagcacccgccctctgaccgtggccgtcgagacgaacaatgattccttggctggaaaccggaacgaagaagccgaaaaccgctagaccaccggtaaagacgtgcgcgctctcgaggcgcagacctggcgagctcgccaggaggaggaacgacagcagcaagcgagaagtcgagaggcttctcgaggaccagttgccggcggaaacttggccttgtcgaatcgacaaggttttagtggatgcaggtgcctggtcgatctcgatcaggctccggcgaccaaggtcaccttgctgaattccctagaaaaaccttggcctgcgtcgaatccgatcaggtttcaagagaatgtggtacctggttgatctcgatcaggataccagtgggtgcgggtgcctgtgtcgattccgatcaggtgtccagctagaaaatctcccctgcttaaaatccttagcaggaactgaggcctgtgtcgactcgatcaggtctcaagtggacaccagtgcctgtgtcgaatcgatcaggttactggtgggtgcgggcgcctggttgattccgatcagatgccctgctagaaagactcccctgcttagaatccctagcaggaactgaggcctgtgtcgactcgatcaggtctcatgtggatggcgggtgcctggtcgatttcggccaggcctccagcgatgagctcgcacctcaccgtggtgctggagtctagtagccagggtgtattgcctatggtgaagctaagacgagctccttctcccaattgatctgtcaccctcatcatctgtgtaaaaggcataatgttgcgaaaagaaattagccagaggactgaacaatgatcttgtatgatacttcatattaagcatgtaatagattgccgcatatcaaggtgtatctgcatatctgtggaatagaacatgtagaatcttcctctccggacaggtcctcacctagctatttaatttaccgagattttcatcagaagcttttctaaaactgaaacggctgaaactggcacacataaagggaactcagcgccgaccttcgggtgatacaggtaaactaagtaagcctggaaagtgagaaatcggcgtgaccgtcgactttttccacttttgaagtattgtactattgatgggtacggctatctaaataaggggactgactgaatctagtgagatgtgccgcgaagtaaactaagcggctgtgcctgcagtgaggcgtgatggaacactgcatccgatctccaagaccgatatgaaccttaatgacaatggtctaagtttttttgtcatctcgcatagcacggtaggcgactaagttgaaggataaagagagcaggattaggatggctcgagatcaaattgaaagtaatagagtaacaggggaaaactctaacagttggctatgacgaaggtggcagcgacttcccggagagagattaagccgggtagaaccaagggacggctgtggctggatcaggaacccaaatctattccagtatcggaggatactcaggggtcccgccggggttttcccttgatcggagaacatcaaccacatcaaaatgcggagtaacgatgagggggaagtgcacggccgacgtcagagtttcgcttgggtggatctgcaatgtttaggcggccgactagaccgacagtccagcacctgccctgggagttcaagacagtggtttgaccatcttttgagaagactgaaattcccgtagattccatcaagattattcatgtatcactagcgactcagcactgggtaagctgcacccacggattttctcagctatctgaatgtatcagagacaaagatcttcgtggatggaggccatcaaccgagctttaatgcgccaaacctactgtatgactgaataatagatggatcggcatgtcgtacgatcgggtaagggtcctaaaaatggagggccggggaattctggggttagccgtcgggattatttcggtacgacaaactcactgttcactttgatctcggcgtggttgcggctaaaaagatgaccttgaaggtggagcgaacaactggaggtgctcggagggacgcggagaagagaggatccaagacatcggggcagggaagtccatgccgcgtgcagtcacgcttttcctccctctgctctcttctcctccacattccacattccacctccacactcctccactcttcctctggcaccttcctcttcctcgatttcttggcttctcggttgattgtcttcgacctcgttgcgatgaccccaccgcattttctgctgccttggcctgtctgatgccccggttaatttcacgaaagtccggtcataaaaggcgttgtatcctccctttgcaacaatgacaccaggctcagcttcctccagacagccggcaacatggtggccttttcagctctttcgggcgtcagcgccgtttctttactactatccctcgttcaaaatgcacacggaatctccttgaaggtctccacccagggtggcaactcatccagccccatcctatatggcttcatgtttgaggtaggccgcagactaagcagtaaaagacaattggttctctgacggtgattaggatatcaatcactcaggagatggaggaatttatgggcaaatgctgcagaaccctggccttcagggaacggcgcctaatctgactgcctgggcggctgtcggtgacgctaccatcgccattgatggcgacagtccattgacctctgccatccccagcaccatcaagcttaatattgcggacgatgctaccggtgcggtgggtctcaccaatgagggatattggggcatcccagtcgatggcagcgaattccatagttccttctggataaagggagattactccggcgacatcaccgtccgactggttggaaactacaccggcacggagtacggctctaccactatcacccatacgtccacagcagacaactttacccaagcctccgtcaagttccccaccaccaaggctccagatggcaacgttttgtacgagctcacagttgatggaagcgtggctgctggctcgtctttgaacttcggctacttgacgctttttggcgaaacctataagtcaaggtttgcttccctatactccgaagagtgaattaggggctaattgtgtagggaaaatggcctgaagccccagcttgccaatgtgttggatgatatgaaaggatccttcctgagatttcccggcggtaacaacctgtaagtctcagctcgcccggtaagtgtatagaagctcatcagaggtagtgagggaaacagcgcagaaaaccgctggaagtggaacgagacaatcggcgatctttgggatcgtcccggacgtgaaggtatgtctcattattaggattgaagcattcatccctgacggtatataggcacttggacttactataacaccgacggactgggtaagtaaagggctatatacaagtacctagatactgtactaacgcttgtaggccttcacgaatacttttactggtgtgaggatttggggctcgtaccggtgctcggtgtctgggatgggttcgctctggagtcgggtggcaacacccccctcacgggcgacgcactgaccccttatatcgacgatgtcttgaacgagctcgaggtatgttgagcggcatatcaaattgataactgaagctaacccattggcagtacatcttgggtgatacgagcacgacctatggagcgtggcgcgcggcaaacggacaggaggagccgtggaaccttaccatggtcgagattggcaatgaggacatgctgggaggcggatgcgagtcctacgcggaacgtttcactgccttctatgatgcgattcatgctgcttatccggaccttatcctgattgccagcaccagcgaggcggattgcttgcccgagtcaatgcccgagggtagctgggtcgactaccacgactacagcacgcctgatggactggtgggccagttcaactacttcgacaatttaaaccgctcggtaccatacttcatcggcgagtactcgcgctgggagattgactggcccaacatgaagggatcggtcgctgaagccgtcttcatgatcgggttcgagaggaacagcgacgtggtgaagatggcggcgtatgcgcctttgctccagctaatcaactcgactcagtggacggtaagtcacgactgagcagcggggtttcaggtatgaatgagctaacgagtggtagccggacctgatcggatacacgcagtcacccggtgacattttcctgtcgaccagctactacgtgcaggagatgttctcgcgcaaccggggtgatacaattaaggaggtgacgtcggacagcgacttcggaccgttgtactgggttgcgtcgagcgccggggactcgtactacatgaagctggccaactatggctccgagacgcaagacctcacggtgagcatcccaggaacgagcacaggcaagttgacggtgctggcggacagtgatccggatgcgtataactcggacacccagacgctggtcacgccgagtgaatcgacggtgcaggcgagcaatggcacttttacctttagtttgccggcatgggcggtggctgtcctggcggcgaactagcgttgattggggcgagctcgtatgggcggcaagtcgaatattatctgcaggtgtggtgtcatgtactgcagtatttctgattaacgatagagagatagatccatgctatatacctgcttgtatatccaaggcatttatccaatgataggcaacgccaccacacgtggctatgcacatactagtcaggaggtagtagagtgactgactgctatgtagcggtcggccggggatagcagttgaatgaccccaattaacagaaccgcctgactctccaacgtgtacctctaggttattttatatttcttgttaaagccccccagaaacacaaccgaagaatcaatggatgcgatgaaaacaaggcactggtaagcgaaggagggaaaaacaagcggattggttggttgtggcccgatgcaaacgggcggcctctccactcgaattggacagaagcgaaggccgtgcgccgagacgggttcgggcgccttccgtctgcagctcccctcactgttcttttctaccgcagctgatccccttcagttctcattctgcaattattatcgaaacgatgggcttctgactagtactgactaccaccatctcatgcagagacattgtcctcattgcatgatggttctgttggtgtcagaatggagagacactactgcattctacttacactatagaaatacccccacccggcctgccattcgctgcggcggcccactccgcgcgataaggaaatctgaagtttttttgctttagttgctttttagtgtcgccctcgcggtctggcctcgtcggcctgctttaaatctcctctcgtccctgcgacctgtttctgctttcttttcccttttccttctttgcgccctttggtcctggcagtgaacgacttcggagctttgcgttcacatttgctggcgaaaagctccatttgatacccttcatcgcatttccgtttctgtttctgtttccagttcccgtgcgctcgtcgcattctgcggcttccccgccatgtctgccgataatgaaaagtccgcggccgttgccgacgtgcagccccaacccgagtattccacggaaaagacagagcaggtgcatactgtgaccgaaacgtcggagcagaccagtcaaccgcatgatcaggaggcccagcaggagcagcagccgacccagggtcgcgcggccaggctatttgcctacatgaagacccgcgatttctggttggtcttgattttagggtgagtacatctccttcttcttcttcttcttcttcttcttcttcttcttcttcttcttcttcttcttcctacggagaaaaatactgtcagatactaatctacaatagtcaaatcatcgcgctggccgacatcagctcctccaccttctcgaccctcctctccaacgcgggcaacagtatccccgccttccagaccctttggatctacatcctgctcaatcttgtctacaccagcattaccctctacaagtacggcttcaagaaatggtttcaaatgctttaccgtgactgctggcggtacttcattcttgccttcctggacgtcgaaggcaactacttcatggtgctcgcctaccgctatacctcgctgctcagcgctgagcttttcagcttctggaccatcatctgtgtcgccatcatctccttcatcttcctgcgcgtccgctaccacatcacccagtaccttggcatcttcctcgcctgcggtggcctgggcatgctcatcgcctccgactacctgcgcggtgccaactaccccgccgaagatcaagtgaagggtgacctgtttgccctcctagcctgcactatctacgccttcagcaacctatttgaagagttcatggtttccaagcggcccatgtatgaggtcgtcggccagatgggcttctggggtatgttcatcaatggcgtgcagtgcgccatcttcgaccgaagctccttccacggcgccacctgggacaagaaagtcggcgggtacattgcgggctacaccatagtgctgtttatcttctacacgttggcgcccatcatgctacgcgtgtcatcggccatgtttttcaacatctccttgctgacgatgaacttctggggcttgatcatcggtatccaggtgttccattactccgtgcaattcctgtatcccattgcctttgtgctgatcgtcattggcctgtttgtgtacttcatcatggagggcgagatgggtgaggcgaagaagccgtggctaggaaaggatcaggagcgcggagtggatggtgtgggaacgggtcgtcgcgcgcagcaaacgggacatgcaattgtctagatgtgggtggtatgagattaatgtgcacgggaacaaaagtttatctggtttttaatctacttcaacttaatatatagtactagtgctagagtctgctgtgcaggacggaatgtaatggaacgaatatgagtgatgatgtttattgatgtttctcccactttttccaatcaaacaactattgctatacggtaatttcactggagttgaccacttgatatgactgtatttggttgttattttccgtgggtacattgaataattgtaacccaacgatacccacccgtagcgcaacgaccgaccatcacccattcgaactgaaatacccttgaacgtagaagaaggctctcagctcccttaatatttcctaagatccactcatctcccatcaaatggggctgtggtttagtggtataatattcccttagcatgggagaggtccggggttcgattccccgcagctccatttttgagttttttttcgccttcttcctagccgattgtcaacccgagatcaactatctaccgtagtctgttctgtatccttgttgatttcacaaatcactgtaagtcgggatccgtacatactcattggcgacatacctccgaatagatcttcactcttactcttcctttcaccacatggccttttcacctccctgacctctgatgtggcaatcaccggatacagtagatgctagttaatcaagatgagaagagtgacttggatagtagcttgaatcaaatcctcattgggaatattgaggattcaatgtaaataggctacttcacctttctctctattggcctcgtctttataaggccgcttctttctctttttccttctcttccttttacttcctctcttagaagaatccttcatatatatatatatatagtatctagagagggggaacggctaatacagttcctaaatatatataacttcaaacataaaatctttatccactcttatgctcacggaaaatccattataatattactctcgagaaattacttatatctatccacacaaggctaaatggcatgaaagcctctataataaaccaaggccacctcagccctactcgcgacccaatctgaagccttcttctaacgcaggctcggtcttccttctatccacgcagccagccaaccaaccatcccaaacagcgcttcgactacgtcgcttcatcaacgacattgtagtcccccccctcgcgatggcaaagcaggtatggcgctaaaaaaaagcccgcagctgaaggttcgaaccttcatcctctacacgtggccgctgagagcaagaataccatacatacctcagcaggcagccgggacgagaacgggaatgctggggaataactcagccacaggaagatgtagtcattggttcacaaaagaaaggatcaaatgcaggctactgctttgaatgaagattcgatagttcggtttatcttccctgctgccgaagccaatggcacagcggtttaattaagtcgcgtcattagcgacaccgcatggtggtggttccaggtatggtgctaatacgcccgtacttggaggctcgaaccttcgttctgtgcacgtggttgctggaaggtatattattatctcggtaggaaatggagtgaggatgtcaggggatagctcatccagcggaagatacgttcgatgcttcggctgaagatggtcagatcgatgccgagatggacacgattgagccatctggcgagagtcgacctgagaaaagttcaagcgttggagatgaatatcgaaccttcgtccgctccaacactaatgcagatgttaccatgagtaccgcccggctgaacgagatggtggaagctgcgcctggtactgatgatgaaaagcttctctgcagtcgccaatttcttcgcaagcatattttcaccaaggagtgtgataccaatatgatctcataccctgtgcacgtggctgctgaaagcaacaatgcctcagtaggcaaccggactgatgatgctgaggggcagttcaaccaccgcaagaggtgctcgatgcttcggttgaagatgtccatctcgatatcgagatggctacggttaagccatccggcgagaattaacaggagaacgccggtcctgagactgatgcgtaagtcttcatacacattatcatatcattcttaatttgaaaggcttcgctaactgtcattcgcaggctggatgacatgggacgtgtcgaggtagacgccatcgcgcactcccgctccctctatcttcttgagcatccgcagtctattttgtctagtggtcagacacccaggaacaccgttgctttcaccgatctgcagcaagttccatcacctgccaccccacttgagggccatgcaacgagcgacatctgggcggtggtgcccgaagcacaccagtgcagcgtcagaatcaccggatgatgatgatgattttgatgtcacctagtaaaaggagatgttgatgaaattaggataccatttgggtccattgaagactggcgaaaccctgcagaatgtttccgcttctgaaaccggtatgttttgctcatagtatgtatgacaagctatctctcttcgcaggctggatgatgagttgcacggttgcaagatcggaggtaagacttctcgacaacctgactgactgacattagctaatgcctaagactccatagcaaaagggacactcccatctgcctcatctctctaaaaatcccagcagaagaaacttgagcctatgttgcataggcttcaagtggatgcgggtacctgtgtcgcattcaacagattgacaggtctccagcgataaagctcacacctcatcgcggtgctggaatctagtagccctgtggcgaagctaatattagctttttgtgtcttttcttctgtggtagtggaggatgccagtagactgtgagtttgaactggtggagaggttctgaggagattagtactatatgcagttagtatcatgctttgacgcatttattataacgtagtacaacagtacgtttgcactttagcgtattgaattttaccgaattatcctagagtgtttattagaatgtttcttctcatccatagccactcatagcatgcttcttccgctttgaagagaaagattggaagaaatgtatagtcagcacattgtgatgactggtacatggggtttcctcggtagagagagagagagagagagagaggaaaagggaggctgccagcacccacgaaaaaagacccgtggtacactaccatgtgcgatctctcttgcatggattattattactaggagagaggacataatgagacatgtcatgttcgtttcgatgagcggtcagctggttactattaaggttcttacactattaaggttcttacccctctgccctctcttcaaatgtgtactataatgactctaggatagattgggttattctaaatccattgattgcattcttctgagcagataatgaggtatagcagtaattcctattatcgcatagtcaatatatctataaggcccttatgaagtatcatcgtttctgaacgtggcagagttagtacgttgcgtaccgcaccggagagataggacgtaaacttcatgaggtgatttcagtcatggtttgcgtgcaattatgactagttacataggcatctttgcatcgtaaccatatcacagctatatcccctcattgtctgtcttgttgacatcattgatttagatcagtctcatagagaatgcattataggaggagattgttgtgaggcatgaggcatttctgaggcccgctactccgcattctgcagcatatcgtctctgcgtaggggaggtcgaaaccagctgtaggactcggcttcggtgtatctgtaccgactgactagaaatcgctcaatcgtgtagtatagctgtctctttgttcctcacaacatgtctacgatatgctattaaaaaaagcagaagatggagtcagagccacccggttagggccgggccgcccgggaggagaacaaaatacgggacagaatctcagtgatgggggagaagagagagtggcgacctgacaattcacacacgacacgaataatagccgaaactaacaagataaatcacatcacatcatgaagaagacctgcgtaatgatgataagcaatcccaccaataatacaatgccattgatagtggctgacctgaagcaattcggggaggagacgccaagctcgacgatcaccggagcttgaaagaccaacgagacaagatgacaggcccgtcgcaccacgccactaactgccctaacagaaatcggcctgaatagtgcgacgagtgtcccggttctgggcctccacgataagataagtcatgggcttatcgcgtcatcggcgccgatctcgcgatcagctgaaaccaatcattcaatcaatttgcatcacccgactgggggcgagatttcagggccagctgaaacggtcggctgccgagattgtcagtggatgatgaatgttatgctggaagagagggggagaatgacgtctcaattctgggtcacttactagttgactagccacctagtatttagctgctagctagggattcggtttaaaagcctggtggtttctctcttcttctcgtcattttctcttcatctcatacccattcttcaaaactcctccactttgatcaattatcctccatcatggctaccaaaatcaagctcatccccaatctcaactacaagcgctcaggcaccaagtcctacgtgcacttgatgcgcaagtaccgcttccatcccaccaagcctggtccctacactctcagcagctccatccaacagaccggtcgtccgtacactgaaaagcccatcgggggtcgggcccatatccggcagctggtgcggaagaagagcaccaccagcgatgaggttggcgaggttccggccgaagatgtgcagaacgactccatgtatctggcgaccgtggggatcggaaccccggcgcagaacctgaagttggactttgacactggttcagctgatctttgggtacacccccattatgaaagacctaatatggaaacgagcgtcactgacagatgtaggtctggtccaacaaactcccctcaacccttctatccgagaacaagacccatgcgatcttcgactcgtccaaatcgagcaccttcaagaccttggaaggtgaatcctggcaaatctcctacggagatggatcctccgcatcagggagtgtgggcaccgacgacgtcaacattggcggcgtagtcgtcaagaaccaagccgttgagctggcagagaagatgtccagcacattcgcccaaggcgaaggggacggattgctcggtctagcattcagcaacatcaacacggtacagccaaagtccgtgaaaacgcccgtcgagaacatgatcctgcaggatgacattcccaagtcggctgagctgttcacggccaagctggatacctggcgggacactgatgacgagtcgttttacacctttggcttcattgaccaggatctggtgaagacggcaggtgaagaggtctactacacccctgtcgataacagtcaaggcttctggctattcaactcgacctccgcgacggtaaatggaaagaccattaaccggtcgggtaacaccgccattgctgataccggtacgacgctggccttggtggacgatgacacgtgtgaggccatttatagtgcaattgacggcgcctattatgatcaggaagtacagggctggatctatccgaccgatacggcgcaggataagctacccactgtgtcgtttgccgtgggtgaaaagcagttcgtggtgcagaaggaggacctggcgttttcggaggcgaagacgggctatgtctatggaggaatccaaagtcgtggtgatatgaccatggacatcttgggagacacatttttgaagagtatttatgctgtaagtgcattgctgttggcgttaaggggtgatatcgaagctcactaactggattgcagatctttgatgtcgggaacctgcgctttggagccgtccagcgcgaggagttgcgccagagcctgaagtcggagtagacgagtggctgaatctatcatggtttgatgatgttatgtatttgcatgtcccgtttttttggttaaatcctagtggcttttgagccccgaagtatgtacgcagtaaatagcagtgcaatatagtactccgtaccttgttatcagatgctctggtttgaagcacaaaggaagccatcagtctcccaatcagagcttccagcccgccccgtccttccatttccacaacctcagcgccatgaaacatgccatccctgctcctaccataaccgccgcaaaaagctgccccttccagaaaacagcatgttccagatccaacaacgccccggcaataggatttccaatgagaatgccaagccccgcgaacacgaaagacatgcccatccacgtccccacaacagccatgtctggacacaatagcgccagaactggaggcatcagcgcgacgaccgttccggacgcgaagccataaataacagcaaagacgatggcgccagcgttactgtgtatgcccatccatgcaaatgcgaggacagtgaccacaagactcacaagaatcatgacattcagcgatcccagacgatcagcgagcatgttgggcgaatacgaccgaagaaagaagaagcactaagaatggaaaggacgtagaaggagatgttaccgcctgcatggaggtaggtagtgaaataggtcgggagatagaagtaggggaagtagaggcccacgaggtcgaagaagagcgcgaggcagtagataaggaaaggaatatcacgaaaggccatgagatcaaggagctgacgggcttgtgtaggaggaggaaggcgtgatttcatcaccgctatagagaagaggagactggctagggcaacaaaagcaattacacgggttgtccaaccgaacccgacgcggtcgattaatttgtgaaacacgatcgggaaaattacagcgcctagaatgtgggtttcaggtgaatatagttcgatggaattgtttgaggaggacgaggcttaccgacgctgccccctgatgcggcaattccaatggccacggctcgtcgggaggtgaagtacgtgacgggtatagcaacgctagggatgaagagaagaccagaaccgaggccgacggcgacgccatgagctaaaaagaattggtagtactcctttgatatggaggtcatcatcagtccgaacacaatcaggaacgtgcctgctattatcaagaacttgatatatcctctatcaaagatcggaccgacgataattcccaatgagagtaagaggaaactttgaaccgttccgatccaggcgatggaggatggagagtagtctctcagcaggctggtttcatagtagctttggtagacgccgaatgtattgattatgcccctgtagtacacggaatcagtaagcgggacagcacagggataacccaggaagacctaccaggagttgaaaaaaaggaagaaagcgccggctacctgaacccaagcgaagatacctccgttgggtggaggagggggtagaggagtagagtcctcatcgacagactgtttctctgtttctgcggtattcggtacagctatgggatccacggacagggggcttattgaagaagcgtcgctatccgagggaacagccatggcgaacacttcgagcgaagaaaatagtggagcgaaagaacgatatcatcggtggagctcgactgagtcgacatcaccatattgtactgctaatcaagctatagaggaattgcggtctatagaagcagaattcgcctattggtcctaaaaccgaccaagctgttgtcaatagtcgaagggaagaggagatcgacatgttcgttccctgttctcttctgcttatctggggaggacaatagagggtgcatggagatcattgaagcttaacacccgaagaagcctcttattggctggtactttgcagctgatgaagcagagtgacgaagccgcgatgcgaacgctgcatgatctggccaggtgttgtgaccgaactgggtcaatgcaaaggctatatgtaaaatttctgtccgaccacaggcactgaaaggctcaataccagtccgtcaagccataccgatgtcagcttgagggcactatagtcataaaccggaaaatatctccatctgtgtcagggtccctgcctactggcttgaacgcagaaagagctcgcaactcggcgtcgtttgaacttaactccgcgtggttccaaaggtgtctaacagtcaatcaatgcgccggattgcaacccgacgcagaaaagctggcgaagcatcgaatcatattgactcaatttcatccgccgaaagccagttgtcgccttgagtaatcgccattctaccaccctggtcataagtatagtcaatctgaacgttccgcgacatgcaatgtgagctttgacgggttgaaaagtctttccagaagtcgaaaaacaaacaaaaaaaataaaaataaaaataagtaaaaaaaaaaacactgatggatgatattgacgatcatctgcaagggcactagggtccatacattagaataaaaagttcagcgtaatatttgcgctgcgatgaggaggatgatgaattccagacgaccgaaagtagcagccagcgtgaccacggcctgactaaatgtggaatacttgagggttttcaccgcgatatttgactagttggtttcgattacagggcaagctgaacgtcacaaagagcgaccactggaaagatcaagtcaacacagtggtctcagtcagcctgaagtaaagggcttgtctctcccatgtgccattatgttatctagctgaagtgaaccttgtccactcacatgattctgtacgtggccggatcttgccaagtgagccgtaggactggtcactctgctgtgttacattattagatgagcttcgcattgctgtgataacctagagcgtagctacttagcacagataagccatcaataccagctggctgtttagccagctcaagttttcaaggcgaagcttgtcatctccatttccctgtgcagaggaactcaagagatgacctcacttgcttgtaaatgagcggtagggcattttgatggtttcggtttccgaaggacgatctggagtcaagaactcagacacggtatccattgactcatcatgacattctttgaccaaggcccacatagcataaactaagcgaccgttgtgatgaacctcggcgagagggaggcagaatgggaagatgagaggtggggacggagagagacgagactggtagctagcttgtcgggcggctgctgccgagccgtttagttagatcatagtactactataggcccgatcgggaccagggactgcgactagtctagtaaccattaaacgaaacgcacaatcgcactcgcgccgtctacagattcttaatcctctatggtattcttcagcgggggaaggatttccattaaagctgtcatttcgtctgcattatctgttaaaacgtttgagtcaaccctgctgcttggtagccagcgatatatcgttttggtcacaaatcgctgttttaacattatctgtggattacgaaaaaaaggtcagctgtaggattatagtgggcatgtagttcatttgtctcgagtcgttcatttgtctcgagctataccatgtatactacctctgaacaatccacataatgggcgccatccgcgcacggccacaaaagagccggatttaggtgacagaaggtctatactcacaaagacgccgcgcaagtgacggattacaccattgggttcaaaatttaattgccgaggacagcgactggaaaaagacccgcaagcctgggtgatgcccaggcaggtttgaaaacagggatggcagcatgaacatgcatacatattagggaggatcatctccaagacccgccagtctattgaatttgctaccctccttgatgacgagacactcccaaagtctccactgctggagggggttaaattgatggtcacatggaatattcccgccacagtcaattgaactttggcatccatgcagggaaaccaccgtaattggtttcctgacggacatcatcagtgtcgcaacaatcaggcgacatatgtcggcaagccgacgcacaagtgcaatgacaaccgagatccaatgcgctcgttggctatcagcccctttaagaggcctgggatgatcgaaaatttcctttatcaaagactagccggcaatccttcagggaacccactcgaaggcctgagagatattgcgcgatatgactgagccggagcccacaccgttaatttcggcggtcaatccccgatcgtgtcatcttcccatttgtgcgacatggtcaaatcccgaagccatgccaattcattgacaggatgcctggagattgacctctttcgcggcggttggtctaggcacgtggggccaacaagcctatcagcatcgcaggagattctttagacactgctgcagacagagcttatcagcaatcacagggaattctagaccagtcaatagaccgtaagcgtttgagtgttgatgaatgtgaagtgcctgtgcggtgggtggttatggcaaacatacacctcattcagtatgcaactccaataaagttttcctacccgaggggtccgactggtaagcatccacggcagcagtggcgcatttccaggacaccggataggagatagtgtacgagccaatggtaagacggtgagactagtacctcgagaaaatttttgtgggatcaaaaacctagaggttaatctcctgggaggggcgcggaagaataggagagagtgtgtgtgagagggacagagaggggcaagagagctaaagactagaacagaaaatgccaaacaaacatttcttggaattttcgcgcactattgcctttggcacccctctttccctcccagccacctcgattttccggctgcttggccctggctttgttgcgctgactgacttttctcgccccttttacgcccatggtccgggcgcgttggcgcgcaaaacgaccgcgatgggtagaaaccagaaattgaagaccgagtagtggtgcacggagatgaattgatgatggttgtgttagcctgaaacttgcatgaatagctatagttttgaaaaaagtcatgaatgcccaacattggagctatggcctctgctcgcgacagcatctattgcagatggtgggtagctcgtaattggatgacatttccccttaatcaggatatctgtccagcgataacctcgatggaaatccctcattggtgacattcatgtgatgtaaaagagtggagtgcatatgcagagcacagaagcattgacattgctagtcagtcagtcacaagcgacccaaagggtgagcgacaggtctgcgaccgttctatgaaatcgatcgtgatagacaggagacaaggattgtcagggccctatgacgggagttcctggtcaacaggatcgcccacgttagcgtcttatcacgcaagataagccggcggtcgcatttgccacagacgtgatgggatctgcggatagcaccggttatggtgggaaggatcgccaccagggtacgtacgatgtttctatgtacagagcacgtcgtggaggctgtggtggtacgaattggatgtgtcaccagtgatctccgacaatccagactgggggggaaaagtggagggaaccataaaatcaaatcaatgattgaatgtgactgtgagtgtgactgtgacaagcgagtcgagaaactgagacggtgacagaaatctccaccaagtatccgagaatagaaaaaagacggacaaaaacaaaacagacacaaaaattaaaatagaaaaagaaaagccaacaaaaagaaaaagccggcgagcttatcagtcccacgtgcccgtgcacggactgattggatgggcttctggaacatcggcggtctttcgccatgattcaacggctgatgcggtccctttttacaattacgatttttgtttcaaaattgtataatattccatttgggtgtgattgtttcgtgtccagatgcattgttcacacgcagcccattggctccaagttgtctgcatcatcagacgcgtctcaggaacagcagaaagagcaggttcgccaggagggacccgcgattgggctgtgtttgtcggcctgaattgcgggctggaacagtcggtctccactgggcgatccaccgtgacgccgatttggctttggcagaccgagttctagagcgttcgcccaccaggttttcctgtcccatgacctggcggttatcaagcttgctcatcctccaccctgtccaaatgtatatagaccttccccgaccagctcggagagaattcttttgacatccagacaagccaaagccaaagcttcctcttcctctccggacttttcgatactctcgcccttccctctcccacttcgggtgcgggactgcgcatctgcccctccattagcacacgcagcagagaggcataacagaactacgctagaccatacaatgtcctacacttcctcctcccgcttttccagatcaccatcccccgcgcctcgtactagacgaccctctccgttggaaagaacctcattgcatctccgtctcagcctgctctccggcgagaaatatgaccaggaaagcagtgccaaggaacctgatctccgtcgctgcctcagccatgcccacatccacgccaagtccatggctatggtcaagcgagacattcgcgtccacatccgctccatgggaatggccatggatgatgacagcgacgaggagctcctcgatcacgaagtcctcccgccgccaccgtcgcgccgatcgtcccgcagcagctccaaggccgcagcagccccacgggtgacggtgtcacccaaacccagcgagaaatcgagtctgctcgacaagggtcgcaagtgcttggagaagctcttccctcgcaagaacaacgtgcatttggcacagtctagagttaccgttgtcacttgaagccccgtccatctcttggcctgctcgtctctcggtttaaacctcccactactactgctgatcggtttcgccaccaaccttcgctacccatagtatgatgatatccatctctatttgtggtaatcacgccatttcgggtacccgcgcccacatcaatggtgcttcaccgtcacccagactgcccgtcagagtctcctgtcagtcctattcatcccgccagtccgttcgagactagcgcgctctcatccggtcgagagccttgacctgacgccggcttctggttgtgaagtccatatcactatctccttcactctcattaatctcgatgtaccttcccctatcatgttcttgaagcgggcttcaacgaccacgatgttcggaagtaatgtgtgcctgtcactatttcctttgttcacttgtctgggattggagttatagcgtgcttttgttctttctcagcaatggataccagttagagtatagaagacccatagattagatttcagaatctatttttgtcagtgacatcaacctttcctcttcgaaaagtatggttttctttctgtgttgccggtccacgagcccggcaatcccagtgactcaccagatggtcaccagcaccagcaccacgttgcacatacggtcgcacaacatatcctttcacaagccctcaaacagccaattatcctaatatgcaccttatgactcgcaattgcttactcggctcccaagccacttggcatcccaccaactccgtggttggaatagaaaacttcgggccgacgataacaatgccgctcttgcagcggctaatttgatattcagcctgaaccgcgataggccgccagttcccgaccatccctgcatgcaggtcaccaccccctccttggccgcacctgcataaccgagacgaatctcggtcaaacatgtcgtgctctgttcctctgatgccgcgcgatgccgcgcggaacaaaattgcggtcgggccggctttacacctcatacatcccccgagtcgaagatgtcagcttgggttttattgacgcgactgaagtcaataatgttgctttttgtatgagttttattggatgatactgataatgagagattactgaagtctaggaggacgataatagtctgattagtaaggaaggtacactgcgctatccgccagcggtcgcgcggtttcgaagcttcattcggctggatgtcaccagcatctctactaaaacatgtcaaactgacatgactcgtcatcgatagaactcaacctgaagaagaaacagaaatcaaaataagaaaatatagagaaaaggaaatagaagatgaaaagaaaataccccgatgatcagccggaaattaggagtcagatggtacgcatttgttgctaaagcatgttccatgtcttcagaggtgaggcagaaatgtcgcccaatccactgtgtgataagcgctgacttccaaatctcttagccccaacgaaagcctcgacgatcaagtatagtcttgcagcagcatacgtgcaatcaagggggaaatatactccagaattcggccttcagtggcagttccttggggaccttggcagattcccttgtcagtcgcgcttgctccacatctgccagcttagatttccagaagattctgcagaagaagcgccgccagcgtcctatccaatatcaggcagctgacgtttcgaagacccaaaatgcaaccgtgtttccgaacagaaacatgctgcatacccgccagaggatgagctctgccctggtggggaacccgaaattccagccgatgagatgaatcgaggcatacaacaaggtggcaacacaaagtattacttcctgatagcccttcaggtcaggaagtctatcgttgccaagacgcggcaatggccgttcgaagggtgcgacaggcatcttcatgaaaagctgtacattcaaggaccaacttgggagtaggtcctcgatgaaatcaagtggtgtctgcttgtacggttccatcgcatggtcgccggcttccctacgtatctgttctatgctaacatgaagctctagtctgattggagttcgaacgtcgctaggcttgtggagccaacagaggctcgtcatgacagaacagactacgatagcaagggccgacaattccagtgtcgtgatggcaagaccctgtgccgcccgacccaggcactgaagaagcatcaacccctgtcggttctcgtgcacgtccgcctgtgataggctcgtgggcctcatcctgcatgagcccctcctgggaagcaccccccaactcttcctcccagcgcctggggtgacaggcctgattccctctcagtcggccgggtcttcccagctcaattcctcgccgaaattatccatccagtacaatcttcactcagtccgctcaaccattctcagctctttgtacattctgctctcaaattgaaaagacacaacatccaatatgcaagccacatttgcggacagtccatcgataacggaaacactcccgcgccagcggaagccttctcttcccccgggagccttcgcagaagaaccagcaactcccgagaaagttctcttcaatgatggtgcccccatccttgtctcttatgacgaaatccccgaatggtatcaagacaatgagtttattcgacatggctatcgacccgtctctaattccactcatgcatgctttgccagttggctgtatctgcacaatgaaaccgtgaacatctattcgcatcttgttcccgccgtcttcttcctcgcagcagaaggcatgttttatcagcatcttcaagtcaaatatcccgaagccacgttatccgaccacgcaatttttgccttcttcctcttgactgctgttatatgcttgggtctgtcaactacctatcacacactaatgaatcactccctccaagtctctgagctatggttacgactcgactttgttggtattatcgtcctgaccctaggagattttgtctcgggaatttatatggtattctactgtgagcctctgttgagacgattatactggggcatggtatggtcgatcactccagtgctttgtacacaaagctaatggattttggaagatcatctcactgagttgcattacaataatgatcctcgtgaaccccaaatttcaaggaccccgttggcgcaccttccgtgtctgcactttcgtcggcactggactatctggcttcgcgcctctgattcacggtatcagcgtctttggttttgctaaaatgatggtgcagtctggcatgccatactacctcggcgaaggagggcttcttattctaggtgcacttttttatactgttagtaccctgacacagaagcaagataccatactaatgattgatctagatgcgcattccggaatcaatcaagcccgggaggtttgacatattcggctgctctcatcaggtatttcatgttctggtcgccctcaccacagttgttcagttgattggtatcctttcggcgtttgactataactacaaccatggaaaatgcagactgccatgatgtgacgatgtctcatcaatatgattgttcagttatcacgatatatgtcccatatttgcatttgtttccttgtgtttcgctagagatgttggtatagagagggagccccgaagttctatgagacggtaagaattatcctacatctggatattcaaacatatctataagatggtgattctctacatgacacataatgcatgatacgaagaactttggttctaccaccatccaacccatattatactataagaactttagaccagacatgtcttcaccttcaatggaaacatctcgaataccccagagaaaatatcttctataacaaacaatgcatcaacatcaaaaccttaacccgagaagggtgaaaaagagattgaaaaactaaaacgaaaaaagaaatctccccgactgggagtcgaacccaggtctcccgcgcttgttcccgagagggattgacaagcggaaatcatgaccgttagaccatcgaggatttcttattttcacgtgtccaaatcttagtacaagagcgaggataagagtagcataccaagatctcaccggcacactgccttctttgtacccaatggaacagagtggcatctgtactcatatgagtatgaaccgtcaatgaacaacagcggaagatacagttatattcgtaccttacaaacatctccaacgagttagtcaagtgcctgcccgcaggaagccctcagcactatgcatctgcgtcaagtgaaatcccgcaaatggaggtaatggggttgattgatgtattgttatccattgaagattctgtatcacagtcaaattagtacttgggtccgactatccggaagaaagcacttactgaaagaaaatagcaggcagtgatgaggctactatcttgccttggtaccatggtctttcattgtactctaaatgcagcatgtgctgcataggctgtcatctctaggatagttccgtagcctgatggaatccctgctcgtaatatagggtgcttatcaatgctagggatctggacaatgattcgtacctttcctgaaacttttcacttcctttgtaggaaggaatttcccaatagtcaacctcaccttcctgtgctagatgcgtacaatcaccgtggaagccttcgcgtcatctcaaaattctctctactatggctacctgccctccttccaggtaagagacgatgacagctaataaggacaatcccgcctggatgtagatgttcgaggaggaagttgtcccggcgatatcgtttcatctgcgtgccttagcattggcggcatgaccaagatataggtaaaaggcagtgttgtctgtgaaactatattaaagccataagatagctcacagggcttcggaggggataatttactacccgagaataatatcatcgacatctgtcgtattgtccttagattctcaggggactgccgcatgatccctatttgcagccgagctatcttgtctcttttgacatcccttcgttgcccactgaggatattcgcagtgcaaatcatacttgactcgcaaagacaacatggaagtagcagtcacgcatcttcggactctggtggggctcgcaacgcgtacagatccatcgcccctaccccccgtccaggatataatatcccatatccagtcgttatatgactctggcaggcccttctacaccaaggatttactccagtgtatcaaagagcaactccggggtgctcgtgatgggatcattcaaactatccgtgtgcccggagtggatgaggttattgttgagtttccggtaatgacagggcaggttttcccgacaccagagcaaggaatggagttaatcgtgtaagtgtttgtgtttggatttctttcttctgtctgattcatatttacccggtgttgcaacgtagtaagagtgctttaatcactaaccctaaattgtgaagccgaaacccctgcattgaatatttatctgtgcaggaactgcttcaagattgcgatctgagggatgataatctggcctacaatcacatccagatcggtcattatcgctttctgcggaatattcacaccaaggagctttactcagacctttcagtggcttcggtacctgatgcaagcgagcttcttcgaagaagttcgcgtatctgggagaacaccgcacagtgtcaagctcttcgggcaatacttatgtcacgaaaggatatctctatatccaggattgtggggcttgcgctcgggtctttcgcaaccgtttaccctagtctgcaagatcgatcagctttccagcatgcccttctattgactctgcgtgatatatcttgcaatatgcaaaatatagcacagcaatctattccgtgttttgcccaagacccgatgtgcaacatagttgatatcaccgccgctgaagaggctggaatcacgattctggaagacactgacggatttcttgaaattgatgattccacggtggtattctcatgcgccccagacattcccgtaaggcagattgttctggatctagctcgacctgccgtcctcatatgggacaaattgaggaatgaagatgatgatgatcactcgtgagttaccacccttctcaagtttcagcatgcgcagacttatcgttgtacagggccgaccctgcctctccacgtgtgatgacttgcctacggaacatctatgaagaattcgaatttcctgattatgataagcactttggcgacctggcagtatacattcgtcggaattagggaagtcgatagaaacaaaagccgaggagacataccaggagggacttcgtaggtttgccacagcagatccacactgctcttaccaagtatgacacacactacatgagtctagacaggacgaagcgggagaataggaagcgcggattgaagtgggaggatgcaagttgatataagttacagctcaaaataaaggggttttcctgggaaacatatgatcgttgtattggtgaagaggcggttgtatagtcatattctgggtgacagtcgtaggtaaaggtgggtaaatcactgcatagcacgatcagcataagattcaaaccctggaagaagcgggtgcactagatactcacaaccctagaagaaatggagcccagaaagggacctcagagcattatccgtcagtcagaccagctcagtgcagctcaaattcaaattgatgtaataatcaacgatcgtatactattactgaaaacaagtccccacacgcaaatcagattcatgaaattcacatctacgatcgtagagctcataatcagatacatattgctagtaaaagaataatcagtgtaacaacttatttaaaaaaaaacatgaaaactcattgtaaaatattattcatcatgtagtttagctccagccgttcctctatctctgtctcctacctaagctgaatgacaccgtagcctgcgaagcggtcgccgacggcaggatgggttgggggaacgagacagatggaacaatcattagggaaaaaaaagagagagagaaaatagagaaaaaaaaaaaaaaaaaaaaaaaaaaaaaaaaaaaaaaaaaaaaaaaaaaggaggaaaaaaaaagggggggaaggcaggaaaaggaaacatgatgcgtgttggtcagaccaacattggtcttgtttagccattcatctgtctctgtgttctagctaatttgactgaacctatagctagtaaagtggttattgacagcagaatgaattaataaatcaagagtgacagacgagccaccattatgagaaggaaataagtcataggaacttagtgatttcgacaaagacgcggaattttaatttggggagaagtattagaacaaggtcaacggctcacacgatatcgattatccgctcgtcatatagttcgagtcctaaggacctgaagcctgcatgcaccgccatgttattatcgattgtgggttctagttcgggaggtaattcgacatcccataaacgatctctggctctggcattgtcttcgaactcttgtatgtcccagtgacaggataaatctaatgatggtcttaagtccgttatgttttgatgtagatccgtcccaacggccttgttgaagttctcgtagttaccaacccacttctgaggcaggtggctaccagggaatgattcccagcaggagccgagcacagtctgagtatattcaaatatcttcagtaactgttccgttgttgctgcccattgttgaatttggagaagagatttcatcataatctttaggattggagttggagtgcattgtggtttctgggtcgcttgctccgggtccaggcgctttaaaaacgaccagacaaatcgactcagatcccatgcatatgttgaaggatattccaccccggaatatttcaacgcgaggaactcataacacctgtctattttgatttggccttgcccttgtatttcggcagcatccaagttattgagcaattgaagaagcagccatgttgcttgttggtcacggaacatccaaccaagttcagtgttaaatttttcccatgtgcgccataactgcctgtcgagctctggtaatcccgtgaataagcataaagagaagctgaagaccttgtctctggcactggagaagggcacaggaattgtatcatctaaggcgacagattgccgtctagtttgctctataaccagatgaacttcacgaatcaagctcttctcttcagaggatagtcttaagatgctgatctgttgagtcaccctactgctggcccaagggagcagccaattggagggaggtcgtccgagcgaaagggcgcaggccgatacgagaagataagagccaggagcagagccttctctgagaatgacagggcttttgcacccacccagaagaaacaagctatcgggcccttcttcataccctctatcgaggaaggaaacaaacagagtagctcttttgtcaagtgccatgctgatgtgtacataacctcgattccgtttgatgctgccctgtaacccgcagatcctgatagagcaagtgcgcaggattggcgtggccacgctcagatgactttcacatttgaaggcaagataatcatgaaatagcacatgacgtgcgcctgggagtttgttacgtttccgattgaggtcttgatcgcttgcagaaaggacttgactgaacgtggataatgcttgggaccagtctgggacccagcaggggacgtcgaatgttttcacatttaaaccagcgaattcgagaacatccatcgaactgcaaactgcgataaggtacgcagctagaccgatgtatatcttttcaacggaaacagtgtagtcggggtcaagttcactctgggatatcaagctaagcaccgcgaacaccttgtcccgcggatcggaacacttgtaagatgatgtctgggatagtatgggtaagagatcacgatcagtaagtccgtaccacttttctcccttgaacaaccagtcaggtataggaacatcttcatgggccagcgcaaaaggcgccttaggccatggagctgactgtgcaccgcaaactaactcaaggttccgagctaataatacttcaacaagaaaccataatcgggtgaacaatggtctttctagaaggattctcaaagctcttcgattaacttcgttgatatgctcatggccagttctcatttcttggacagttatagccatgctcttgagaaattccaaagcttctctaccgtcggaagtttcttctcccaagtaggcgacaactttagacgccttcaggcaaagttctcttctcaaggaggtttgctgacttttttctttgagatttgcctgatcaatgcataataagtccacccataagagtcggtcaaaatcctggttccgacaaaagcgaagcgcctgttgacagttgtatgacacgtaaacaatgtcccagtacttgcctacaaagacaatatgggaactgtcagagccttcgctttcattcgcagaggtatatgacaagatttcaaataattgagccggttgattgtaaatgtgcaccacttccaggtcaacatgaagcaggccatcgatacgaccagcgtctaatctgacaagccgtatgtgatcttcggagggcagtgttgggaataagctctcttgagagtctgttcggaattcgctttctccatgttgtgtgcttctctttgatatagtttggctacctgaaatgaggcatgatggccagggagaactatgagaggatttgtttagcggcaccgatgaatctgtgactattgtttcttgctcgacgattgcaatggcaaagcagtaattgcagcatggaataccacttgccacactgacagctggtcgtctgcagctcggatcatgccagcgaatcattgtgtgttatctttgatggagaaggttggcaaagttagtagaaaggctgaggatgacggtatggtagaagaaggttattgcctggaggagaacacacgaaacgggcggctagaggatacgagtgaatcacgggaaatcaggcttctagttacataagctgaactgaaaagcgagaagccttgcattaatgctagaagctgatgatgttccttacctgatccagtcgaaaagtcgacgccccatttgtaagatgaaagaacgagctagcttacctggtcttcgtgggattctctcagttttgcgaaggcaagatttggagtatcgccaatacatcaaaatctctatcacatttttcaggcttcatttctagctgagagcgatatccttgttattttggggttccataccaccctttacaagccttcaacgatagttggagaaatacccgaccgaaagcgctcaatatgccttacaaaaatccacgactgctcgagaaatactgtgttcacttagtgattgccctttcgaggctgcatacacactgagccgctctatttgtgaatttattttggcagtcctcgactgggtgattgggacagacaaatgcgcactctgaccgttcgattaaaatataggctcaatttccccactggcgtgcgtgaaggctgtgtctcgcagcatatgcacgtgctcggcgccatatagcaccagtagctgcacggatgcatgagtgactcatttgcatagagatgaatcctacggctatcatgctagtgactctacccaggatgggtgcctaggtaagcatcgctgtcccgaataaatccagaatcgggctttggattaaggaacaattgcagtttctagagtcgagatcctgcaattccttcttcccgagctaggagacctggaacttcgtctcggaccctcaaattaaaatgctacaacagtctcttccttgtctcgttatccgggctgctccgaatcttcacatcctccggcttggtctgtgggatcaattctataatttaagctcgaatctgtttactggcctggcccaacaagtccgtttcacctgcttctcggagctccatcttcgctgggtcgagcccagtcagcccagcttccaactcttcttgcgcacggctgcccctaccctgcagattctgaccctgatcgcagtcagctttgatgaccccatccccgtagggatggatccttcaccagagctacgcgaggccatgtccactctctggcgccgcttcttgaatactttgcgcgacaccattcccactattggcttcttccgtatgcggtggattgcacatcgccagcatagattttccagaatggatcctttggaaagcgcgataggtttgcgcaatttgtactcccacgacatctatgtctataagatcaatacgagtttaagctttacgaatggatcgatcagttagaattgcgcccaggatatcttttggaccaccgtctaccaagacatcgcagtatgttgaccgtatatgccacattgcggctgttgacgattactaactctgatgatatagttatgtgatagtgtttttgaaccacaatattatctccccgctgccagagggagggttgcgaacggcgcctagggatagcaaattttatggacgataccttactagatatcgtagacgtgatacctaggaatttaggatataatgaaggaaataatctgcccacaaccgcctatgcatatattaggttcatcgtctctacggcggattatgacgttgcttggatgggcccttgtacaacaatgatgacagtcccagagccatagtctgaaccaggaaactacaccctaccggacagtgttattcaatctttctttccaatatttgctctcggttccaggccataggctagccatctccaatacagttcgttactgattgaaaaagagggaatgacgcgtggagaatatacccaatatttatgatgatatgcaccactcacgtctttgcaaattctcgctcgcaataggtaggcgaatgtggtgcgatttgccgttcatacgtcatcttgtgtatgttctcaaaactggccgtagtgacgagtaaccttggctttaatgggatcaacattgagaagagagccagagggactgttatttatgattatcatatgataacaaaggtgataaatccacttggttgtatcccactccgtaggctatgcggggcatctacctttgtctcgttgtggcgagggtcctttggcgcatccttagtagccgttgaaggattttcttatcccagttcaccactctagcctgccactccatgctcccaaaatcccgccagaataagatcctcacaaaggaacgacgagtacagcaaagccagaagctgcaaaacgaaactatgaacgcctgtctaaccaagaacagaaattgatatgtcgggctcagcggctcaggaagttgagatgccgcgaggtaataaatatatccggctgatcggaacgcaacgagcagtgccgatatacgggaggcaatttgtctcgtcgggtccggttgtgaaccagtcagcaattgatttgaagccatagaacaagtatgaaagccaaatgctaccccaaatgcctgaatctttctgttaatattgtccgccttataatataaaatatattggttcagggtagtcagcgaggagaatctatgcagctactgcgtccagcgagccccagggtctaggatgagcccatgaaggcataaagctgaagaaagcgtgatgtattgaacgttgttacgaacaacgtagatttagtgttgagtcgatcgatgtcaacaataatagtaaaaatgagataccaggaagcagcgacagaccatctggggcgccgctcggtggccaagaacattcttcttctgtaatatttttagcagaatataacccagacatgactagcaatgagtacatacgaccacagggtgtggaaaacagggcttcccgtccgctcagccgtacttaagccacacgccgggaggttagtagttgggtgggtgaccaccagcgaatcccttctgttgtatgtttttctcttttattttatcattctggtggtcaataaatcaattaatagacctgtgttagttgttatggagcatttcagggttatatctacgagcatttccgctactccgaacggtggccttctgttttacagtgtctctcgtcctcattttctctacacagcatcacaaccaataaaacactactagaataattgttgttgaaacatatcctaaaagacccaagtattctccctcccagacttatggattataatctcaactatagcccaacgtttccgatatataaagcgatagtcgtgttatgttggtcctctaccggtgtctatcgtttcaccacatttgtcattagccaaaatgatcataagcagaaagccttatgcactgacagatggtctatttctcagttcggcttgtagttcactgagtctcgccctcttcttggcaatttcttgcctggtaatattgatctcataatttactgagaatgcctcgttgctaggttctgatcatccacattaatattttcctttttcttgttttgacacatgcaatgggcataaatgaactttctcagtcctcagaagggagagaattcttcgtcgtatgaatcttctaataagactggcatcttcattggattttctgcgagccattcgtcagagagtatagtaggtatatgtggattatgggtagcaaaatacggggagcactttaaatgacttggatttgtcaaatcgatggaatgctacaatgtggtgatgaaaggtgagaagacaaaggtgaccgacctgctcaattcagctagctcgtcgaaccacattaacgctcaagaaacagggcagaaatggattcaagtatacgtatatggtctatctagatctcaagatgatggttggttggttggttggtaggtaagatgtaaggccccgtagacagaagaggtggctcaacatcaagctactgagcattctcgaacttcaatcccgcctcctggcgcacagcgccatacatacccgcaacatctcccctctcacccatatgctccttaaccttcgccatgtagtcatcggccaactcaattcccttcatcctagcgcccaccttacccgccaaatccatcgcatgacgagcatccttccgagccaggtcaaccgcaaacaacggctccttccgctcatgataatcaccggacctcatcctagccgagtaagccacataggggccggggaacacagcctcaaagaactgatgcagagcatccgtgcccagtccacacttatccgcaaccaccaatccctccgcaatactctcgaccatacccaacacaaaggtgttaccaagaatcttcaactgcgacgccttagccggaggctgatcactgaaatccacaaccgccttggcaataaccccagtcgtgtagggcttgacctgctcgacggcttcgcggggacccgccaggacggggataacttggccggcggcggccatgggaggggcaccgaagacgggactggcgacgaagcgagcacccttggcctgaagcttctcggagatggaggttgtggtgtcagggtggacggtggagcagtcgacgaagagcttgtcggtgagaggggagccgctggcgatgctggcgtcgatgatggattggatggcggcgtcgtcgccgacacaggtgaagatgatatcggacttggtgacggcttcggagacggtgttggcaatggtggtgttgggagtcgcggcttggaattcttgggcgcgggtgatgttgcggttgtagatgattaggggggtggcgagggagcctttggcagcgaggtttttggccatgccctgtttttgaggttagaggttgtggactgttaataagttattggggacggggagagcgtacgcggcccatgttaccgaggcccagccaggcgagttgaggagccattgtgtgtgatgtgagaaggtaatgagaatggagagaagtagtcaaggcagagacgttggagtcttacaactctcaagtgaaggataggaggaaagtgttagcttgaaagatggatctgaggatgccatgtctgtctgtacttatatacctttttccccgggtattctgtccatggaatcgagcagagccaagctgaagaacaaacggggcagtctacaaaatcatccgaaaagggtttagattccgcccacgcttgttctgagcggaggctaagctggattcggacagtgtttttgcacgcagcatcttccagaaggtgaccttgatgattaattcagcttaataatgtagctgttgtccctggcgattgtctttgggtgtttgtttgagtcgtgttgtacattcggtggcagatgtggagtatacgcgatctttgaccatgatacgcggttatatttgcttcggtcattcagtaattgtcagttgttatatgtattattttaccaacaatgtctctgtaggagaagatgttgttttatagtatgattataattaagtacaactgttactcatcccttgatggcatgaagctcatcagatatgtgttaatgaggccaccacgcagggacaaccgtgccacgacagaccctgatctacggtctaacttttatcgtactggtgcgaacccccagccaatgccatggcattcccaaacaaggcttagtgcccgctaggaaaattaaggttagtgcaacggatggagactaagccagaagcgggcggatggtccgcaacccccggtcttgccacattgcttgctttgtgaattcgactacaacagcgaggaaagctgacggacaaaaagtataacagaatcttggagaatattgatggattgcttagaaatactgccagatctactgagaagccgatttataggcaagggattttggtaaacggtggatccggttcttgccttcagatggagtgaaagggtggtatttattggtgaggttaagcctatcacttcttgttgaatctgcttaccaaaagactgcgtgaagaatagccgtaactaagatcgagtttcgttgatatctctaggcagtgtatttgttgacaatctctgtggactgttggcttacgaatcagggtcctggaggctattactgtaggggcaattatcgggcatttcctggcagcaatggaccttgtctcaatatatctatcctttgcgctactgtgagtctgacttgatctcaagagtccaacgttacattatgccatcacaggagggggtagttgcggcatttttggtcataaacaaagaacaaagaggggaagtaagacatttagcagggattcaagcttgaccagaagggctacctctgaatgagcctgtagtcgtggacatatgagccccgctctccagtctcacaggggtcgatattaggccagagtctatgtcatgctggaaacctgccagtcatcaatagtatcaaaatgtcttatagaaggccgcccttccttgtcccatccaaaagatatagcccaaaaaccattatcttttcttcctttgactgccttttaaatcaacgctcaaatctagctcaggcttcaacgagtaaaaaaatgaagtacatctcaaactggcatcctgttcacagggtgcctatcgttgatggaaaattccaaaatcccactaccggtatcattgaagaaattgccgacaagtactttgtgatctgtggtcctccattcatcaaagctacatggatcattctgaaacctggctccggatttctcattacatgcaccgacttcccacccccgatcgaagatgttttcgtggctattgcggagcatgtaaaggcaaaggcatacgaaatcgaaaacatcagtgcaaccaagtatgagatgacagtggtctgttcgagcgatctgactgaggagatgatgcatgaggtggtgatgcggatgaaacgggaattgtggaaggatgtgtacattcctccggaggagattgcggctttcgaggcgtttgtggaggaggaacggaagaaggagaaccctcggttctgattctttgtgaaacaaatctcagactagtagcactagtttgtatagtaggtagctccactatgcttgactaggcctatgggatggttctttctgacaaggattaacagctgacgtcaacatatccattcaaatagcattacaatgacagcaatctatcatcaagcttcctccaacagtaactagatatgaaaccattccctttctaggaaagagcaaaccgatggtctatgcatagttgtccgaggtacagggtcctagcgaacccagcacccgcactaaaatctcacgccgcttgtctccagccttacagcctaagcattctcccaaggaattctttttcttgttccctgagccctggcctccggttgaatctatacaccgataatatacggaattattactatcacattttgtttcacctagaaacacctgcgctctcccatcctggggagcatacaatccagaatgtttttttctattctcctgaaatatctgtctgagctctcacgtgtttctgttaaggatatctttgggttgattagtctcacgttgtgagtctaagactctcacctttagtcttagcgggcgggcatagagctacttcttaagctgtaacttggcggcacccatgtctagtcgtttgggccaacatattactttgtgtcaaattaaagagcggaacgtcatgaaatagtgaacagacagaaccatgaaatggtatcgataaggttgcgtcgaactcggatagccggccggatccaccgattagcaccgtggggtatatgatgtaatatttctccaaacatgatataaggacgactttcaacccatgattgtaatcatcctaataacttttccttctttcaatctgtacagtcaaaactattccactgaaaccacatcgcacatcgtgatcactcatcctaaccctacccccaacaacaacctcatcttcctactcagcaatcaacccacacaaacatacacccagccaccaaccttgacaaacaaccaaaatgtccacaatccactggccccaccgcttcctccccggcacaaccgaaaacttcgtctccaacgaaatctacgtcccccagttaaccgcctcccgggtatggccgaacctcatcaccccatcgcgatggacatcctactacagcaacgtggacgaagtaacacctcctccaaccagcgacgcaacgttccaaaaccccggtgacaagttcagcttcgcgacgttcggattcccgcccctgcaagcagagatctgcgaatgcgtagcgcccacagcaaactcacccggccggttggcgtggcgcgcatggcaggaaggggacgaggagacggccctggaggtgtatcatgcgtggatagtggaggatatgaagtggggagtggtgaggattttgacgcaggaggtgcaggcgggcaagccggctgctgggttggcggagaagaagccgaatccgatgcttttgggacatcaggagtgggtggatggattggcgaggtttagtttggagaattgattaaatcattagtaggggatttatccctgtacattgtgcgcaggtccaatggggatggtttcgtgtttccttacattctttggtaaaggctgcggctacggttggatgataatgaagcttagtgggatggttaaaagagaccctggcatgtttgtttatcccttgcagatagtatgtagactggcgaagagcctcattggcggaatgtggatgcatgccgatcgccaggcagccgcgcaggcagaagtgctgccaagctgccagctgggggagtataaaatcattgaggatatggtctgggcttgaggcagccaacatccgtctctcagactttgataaactatctgtcaagcatcgtgcagctccacaatggccccagcagtctccgccctctcgcaaaccctgcagtccctgactcagagcaaaattcgcgagctcgagaaacgacgcaagagctatgaggctcgcaagcttgccatcctagaggcggcccagtccactcaggaccctcgtcggcgactcaaatacctgctcaatggagcaaaagtgctctacccgtcagcggctactgatcccactatggccaacattgagcggtggatccatcaatcaagctacgactcgtcaatcccgccacaaaagctgcatgaatttgagactgagcttctcaggaaactcaacatccagagccgaaagctagacctcgctgacctgtactcgcggctgctgacggagtgggtagacccgcctgtcgcggcccgggatgagagcgagatggcggtcgacgacgactacatggtcgtggatgagcgacaaaagcagcgtttgcagcaactgtgcgatcaattcgacacgtccgtgttcgagccgttggagacagacgaagggcggatccgggccttcctcgatgacttatttccggacgaggagagtatggaagccttgggcaatcttcgcaggcagctcagggactctacaatgtcattgtggaaagtaaaagagcctttcacctcgcaatctgtggagtattgtgtgcgtggactcttgaatgaagagcttctcagtgaggagaagcgggaaattatgaattcgtttctgaagacaccggtcgctttaactgagattgctgatgtgctgaatatgcgatacagtgatatcgaaaactgggcctggcatgctggggagaatggaatccctgttgttccgaggcagcaggcaaatggaaagtatcgcatttggatggacgaggatctcctgcagttaatttttctgcagtatatcgggacgcgacattgtaatattttgaagctgctattattgaaatttgtccaacaggactcggtgtggaactggaaacccgagcgacagatgacgacacgcgatcgccttcgacggaaattttacatgagtggtgacagtacatattcaactgccgaggagttgcgattcacggagtacctggagacatacttcttgtcgcagcttccaaaaacagagcaaacattgagtgagaagggcaattcgtatgatgatgacaatgagaatgctggaacaagctcaacgaggcacgaagggaaaaatttccgacagcagctgctaaggaaaattgccacggaggcgcttgtccggcgacacctgcacggcgcagcagtggtgattcagtccgacatgaaatggtacgccacctgtctgcctcacagtacaatcgtcattatcatgaagtatattggcttcccgcaaaactggatcgacttctatcgccgttacctggaagcacccctgaacatggacagctcctatgaaggacgtgaaccagttggaccccgcatcaggaagcgggggatcccattctcgcatgccgctgagaaactgcttggagaaatgatcctcttttttatggatttagcagtaaatcgtgaaacaggtttgctcttataccgcctgcatgatgacttatggctgtgcggcgagccagccaagtgtgtgcgagcttgggaagtgatgggtgaattcgccaaggtcacagggctggaatttaattacagcaaaactggatcggcttatctggctgagtccaaaagtcccagaatcgctgcccagctgccgaagggctcagtgacatttgggtttctgaaactggatgcagacaccgaggagtgggtgattgatgagacccttgtcgatgcgcacgttcgacaactcaaacatcaactggatcgctgtgatagtgtaatatcttgggtccgcacatggaacagttgcatcggaagattctttaagaatactttcggtcagcctgcctactgctttggagagccacatgtccgtgccattctgaccacgtacaagaagatccaagatacgatattggatagctcgatttcagggagcacaagtattccggaacacctgcgagcaatgatcacgaggcggtttggcgagactgagattcctgatgctttctttttcttccctgaagagctaggtggacttggcttacgcaatcccttcacgtccgtgctcctcgttgagggtatcatgagtggcccaccgctagcgaggataaagcaattcctagacgaagagaagaatttgtatgcccagcggaaaaaggagttcgaagacttgagtgttcaacgccggcgaaagatgctagcaatctgtgcttctattgcagatctcgaaggagacttggtcaccgagcgggaagtccatacgttcatgtcattcgaggaattttctcgattccgcgaatcccaaagcagcggtctcagacggatgtatatcgatttgatgtgcgttccaacaatgcagccaattgatgaaacacgagagcttaggagagctctccaggaaacactcacacatgagcaagtcggcaagctggacagtgaagagttgtggcatttgcaattgtatgcgggagaggtgctagaaagactaggagggatcaggctggtggatcagaagttcctgcctgtcggagtgttagggatggtgaaggaaactcgagtcaagtggcaaatggtgctctgagatgtccctattaatactgtatgttgaggttcccaggcatcacctgatctttagccatctctacctacgtagtctctgaccaccaccaaccatcattttgagacccagatagaccatacacatacaattgaatccacccctgccctttgtctcaaaaatttatgtttgccttgtttgatcggcttccggtactggagtggcggataacgcagactgtcgcgcttacaccgaagtactcaattaccaaatcggacgtggaagagtgccttcggcccacttattacaggatagaaaaagcgactgagagtggacttgcagacaagatccaggaattgcctctagaatgacttcacatggcatgtgacctgtgcgtttcccatattttcgcgaggattagctttctccaagccaccttgaataagcagctatctattcaattgcatctatggcatttagtgcaccaatatatgcatcgaggtaacgcattaatcctgcgaactcggccagttgaacctaacagcatcgagaacaccacagaaacagaatggtgttcaaagagtaaacaggtagtgattagtgacccgtcgcgcactaaatcagccgcggctgactagcggcaatagctgcataccgagaggttattgcgatttgcgaagcgtgcgccgtccccacatttatagacaatagtctggagctgagactgaacatattactttttctgcagagcttacttatctttcaggtaagtcgcttgcaattagcaattgcatatcgccataatcgtgccgatcaagcgcctcagctgaatcgaacattgcttaaggccggacacccatcctggatagtgttagtgagttgaattttcttgtatttagataagcaggttagtcgaaaagtgacagtcttaatcaatgccagtcaatcaaactatgagcgtttctctgaaataagcggtgtaccacgatatgctcaacccaatatgatagtctgctaggtgaggaataaccatccatatagcatggacaaaggcagtttattgtcacaaggtaagccgacccttggtgtttataatcactgtgttataaagtagggaacgatacaagaagatgtcgatgacctcacgacttcaggagtgttcaatctgaacttccgcggggcccgtacgtcataaggcccttaagaagaatatgttaagctcactgtgacaaaatcagaatcaataatgtttattgtaattgagcacgaaggtggggatcgatcatgtgaacctctcggtgtgtcaatcaaccgctagccgcggaatacttatagtactaaagtagccactgctcgcccagaattttgcattcgcagcgggcctgtggttttctttcccccatagcgagtcagctgtaaccatgaaggggtatctttctcggggtttggccatctcaatggtggcgcccgcagcatatgcacaggctacaagggctgtagcttcattgagtgcagcagcggcaactgtgacaacgagcccttctgctgcgccgccattgtttccctgggaaaaagtacagctgactgagaatgcactggctagagttgataccgccctgaataaccagtccttgtcgaggatatttgctttcggggcaggtgactcggctaacaacagcgggacaccccagcatagttgcaaggtcatgccaggagatgcgacatggccaactgagtcgacttggaatatttttgaccagttgctcggtgggggcttgcttaagcctgcgcctttggcagcctcctgctatccagactggcctgaatataacaccgagcaatgctccgagataacatcgaattggcttgacgactctctgcagtgagtatatcagtgccgcactttcatatcaaggtaactttaagctgagaagcgttaagctacgatgatcctagctccatcatggcacccttggacgagggtcgctcgtgcatgcccgtagggtacaactacaccagcacatgtacgcaaggcggttaccctacgtacgtcgtcaacgtatccactgttgctcagattcagttgtccgtgaactttgcccgaaaccagaaccttcgcctaatagttaagaacaccggccatgacttcaacggcaagccctctggaaaaggaggtctgtcgatttggacgcaccggctcaaggacaaggttttctacccctcgttcacagctgacggtggttatgttggacctgctattaagcttggcgctggagtgcaagtttcggaggcgtatgattttgggaaagagttgaatttgaccgtcatcggaggcggatgcctctctgttggagttgctggtggcttcacgcttggtggaggacactcgccattgagcagcatgtatggcatggcagcagatcaggttttggctctggaaggttggtttccctttggttcacctttcattatccgtgacctctcactcatcaatgtctagttgtcttggcggacggtcgctttatcactgcgacttccaagcaaaactcagacgtcttctggatgcttctcggtggaggaggcagcacaattggagtggtaacatccatgactgttaaggcgtatccccagttgcccacaacactcgtcactttcaactggactatgaacgatactccaaatgctgaagcgttttgggcggcttttcagtcctatctagacaacttcgaggactttgtcaacgctggcacatatgggtactattttctgggatcctcgggagctgagaagggggaagcttcttccggcgaaaccgactacaacttccgcatggtctcctttgttgctcccaacatgaccgttccggagacgcagaaccttctcaaaccttggttcgataccctcaatagcctaaatgtcagcttcacccccatttacagccatgcggataacttttatgaagtttgggaggaagataactttcctctggaaaccgggggattggacatatacaagttggcgtcacgtcttctgcctcggaatgtcttcgagaaccaagacctccgtaaccggaactttcttgctcaaaaggacgccgttgacaaggtatgctggctgatatgatcgtaattgtaacggttactaaccatcttagggtttgttcatcatggggtttcacatcagcggcaaaggaagcgctgtcgagccaccgacgaacattgcagttttgccggcatggcgtgacgctctttctcacgtcatcgtcgcaacagaatgggacttcacctcgagctgggagacggtctataattcttccctctttgtgacagattggatggatgctctgcgggagatttctcccgactctggcgcgtatatgaatgagggtgatttgttggagcctaacttccagcaggcgttctatggtgccaactacccacgtctgtatgagttgaagcagaagtacgacccgaccggtttgttctttgctcttacggcggtggggtcggaggactgggaagttcaagtcacggatcctttgccgtattcgtggaacaataatgggcggttgtgtccgagatcttcctgaaggggggttgaggtcagtgcacggagtatacgtaaagagaacacttagattcatcaagatatcaagggccatcgtacctgttctcggtgcaatgacaggggtgtagcatgtttgattttatggtcagtcagaagcaggcagataattagaaacaataatcagatgattgactccccatgatccaaatgattccaaggcaaggatggaacgtcagataaggtgaagattctcgggaggacaaaggtgacaccaacaccgctggggacgacctcgaggctgcagaccgagaacgtgactttctcaatgcagctagctccgtcaacaacgacgaacatagccaactatcagcttcagctattacaagatgggaagcacatcccttgattcttcgagtgcatggacagctgtactttgtccctgttcctcaatcggaaccacgagaacaaatgccttttctgacccaacaatcaatcacgcatgtgttgcaatagcacctgaaagacctggagaacaatccccgacaaccttctgcgctaggcgagtagcatctcagttagtacgagtgcatctcataaaatgactcactccaggcaactaaagaatagatctacaaccgcgacagtcgcgaaaatccacatctccccgaaagcccagcaagcagcccaaaccgggaaaacctacgcgccgaatgcgactcgactgagcccgcaggccaaactgtccagccatttgtcaacaatttgttctgcatctgccccgtgtgtcagcaacagcctcggcgaaaatgatcatccaacagcaaaagtgaactgaaacgaaggcggctaaacgagtcggactgcagtcaccagataaatcctcgcgcacatacaattacatcatcagtcatatgagcaacgaacgacgaaaaaggcaaaaggacatgatgcatgaaatggatgggggggccaagcagctagtctcccaaaccagttactggtcgcggtactttctagcagggaggcatggtacttttgcttgagggctacatacaggggggaagggatcggcgtggacccatctcttgtacggagggttcggaactctccgcggtgaacggcactgcaatggtacttttggctgcatcaaatcggagacacccggtggagccaccagtgcttcgatttttactagtatatggatgtggcaggactcgtaattggggtctgtctagaaagtgagtctggccccaacggaaatgagctcggcgttggtgggacagtttattgatttgtttctgtttatataccggggagtaacttatcttagcggtcgggatggtttcaatgcgatagtctagtgttgtggcgtgctgacgttggtatgtcccgtcagcgataggaactagtatcacttcgaacttcgtggcggtgctgttgttgctcctccccgggtgagagaggtaagaacgtcatcctacatatcaacctgatcctttgattaccgaacaccagctgagctcttcgtatgattaggcagcgaagggtacaccggcagctgtgacgtcaggggttaatctaacttatggcgcatggacattgtcaccccacgctatggatttagcacatcaccgggcaatttgtccatcattggggcagctgaagaacagatactttgtagtgattcagagagaagagagttggtaagtggcttatgtgacgattatctgtgtcgagtaaagaacagactaatcacttgttgaaatatcaagacttgttaaatggtatagaatgaagaacgctgaatccgcttcacaagggaaatgcaatcaaagatgaggccaataaacgaagaccgcagaaatttaagtcaaataaaaggaagatcatcccaagcgaaaaagcaagcagatgccgaacaaaaagtcagaatcaacagagttccgataaacacccgatatcgccaatttctccggatactcatcatttatcgctagcttgaagggaattgctttgaccggtttgttatgcgtttcttctcttgttctagatattcgacggcgttaaaaaagatgtgcaagacaaagaaataatggacaatatatacctagggcttcgttgatctggcgcacagtatcatcatggattttggcccattgtgcttgataagtagccaggtccggtaaatcggagtgagcgccattagcggcatggccacttgagccagtgtttctgctggtagcacttcggtccattgtgtgttactatgtagtatgctgtatggtcgccggttgaacacaagtgaaagaagagacgttcgtaaggcaggaataagcttcgaagaggaaggaggtgggctgaacgcaagataagctcccacaggaaagtgatcatttaggtctaccggttagcaggctggcgagcatatttatagacaagtaagtggcagcaccccgacgtcaactccattcatcattctgggtctatcgacccgataattcactctcccgtgccatgtggccgcccgtcgacgaagagtccacacccttgtgtatcggccttgttcgacatttcccttgcattccgtggaatggacaagatttgttattcaaagaaatgaagagatgccccgctgctgatgggggggaaaaaaacttccccgtcgtggcagagtggacaggcggtggatatgcaggtcaacttctgtggaataccaccgtccgacaatagtgcgccaggccccttcctcccaaactgagcccgtcgtgaccgacgagtccttgggacttcagcctggtcggctcccgattggccggggaagtcgagagagaccaacatcggaatgaagtcgaagggcgggacggaacacgtagttcgcagggtgagggtttgtgtgacagactgtcgggatcaacggttctggtctgattggcctcttactctccgatccgttcacgcggatggtcttccgggcatactagttttgatcccgggtattgggcaccgatgagccggttaggctatagtagcaatggatttgattgtgcgacaagtgacgatgatgttggtaagggtgggccgactgagacgggtcgccgggcggaatctggaactcaaaaagaaagaaagggaggacaggcgacaaagaagaaaaagatgcagaaaaaagcaatgagatgcagatcgacacatccatccatggaagtttcgccctttcttcttcgaggtgctccgtttgcgggctccactgtggatgtggatgcgttattcgagaaagtcagacatgtttaattcggtgggtatcgcgattgatcgtgtttccgatcggctggaccgcggcggatggagtccgtcagcccgtctattgaaccacatctgcgcaaaaatggctggcaattgcttcaggcgatcaatagtccaatcggggaagggattccgttgtccatcttgcaggaccctgagatccaccactgaccacagcttcatacggttgaatgccggaaaaagcaccattggcagataaattgtgggacgggaatcttctaggcctccttttcaccgccacttccgtcgcctcataatcagtattccagcctcaaggaaaatgatcccaaggctcaaagaatggcttgtggaagcctgtgagggttgagttcaccgccagaagcgtcagcaccaacaacaaaggcgataaataacctcccatctctgcgactggccattggatctgaatgttgtggaacccggctgggttcttgatattaaccggctagtcggatttagagctggtgcgaaagcatggcaaaccaacaggcatcattccaggtaccagctgtcgtcgcatgcaaacccatcatatgacaggatacatctcagcctcgtttcagccgacgacaggtacagaacgcgggatcgaaacgctagacgtggcctgtcatgtcggtttgcctagtgacgagttccctatttcgttataagctctacttcccagccagacgagcagatatgttatgctgctgtgtcacgcccagttgttataaggcagcgggccccagttgcatgttttccttggcttgggcttccctttgtctccattcctcgtcacctactaataataggcaatcatgtcgtcgaacgcccacgaatcttgtgttccctttctttccgatacttttttcttgccgcctccccctttgctccggttttcttgtgcgacatcaggcattccgtccatggctatacagcccatggccttgttgagcttgcagtagttccccacatactccgtctggccaccctttttacaactctccgaagcccactggtggaggaaataatcgttgagacattctaaattgctttttcctggctcctgatacagtaagtgacagctcaatcaccagtgtagataagtgtgatagagcactgttcgggtttaagagtaaatatatcacttcaatagaagaaagtggacactcagaacggtggctgcagataaatctcgagcaattgtagaaaaggtgaccaggcagagtaatagcatccagcagaactgctatcaagtgaggcattcattgtttctctgatcgagatagacacatgggtaggacacttcgttatgcattttgttgagatattttattcactctggccacgtatcacccaatccttgaccactactacaatgacaactaacattttgagatccaaatagaacctatacacacgatcggaccagtctctgtccttttatttaggatgtttggctgcagaaacatgaaggaatcgaactctatgtcagcgatgtaactttgcatgacatactccttacaggtgttagagctgccacagctccattcaggcaaaacgcgttaggtacgtacactcccttgctatctattagtagcccaatagcaactgatgtacgtcggattaatcaaacaagcgtttgataggttgatgacagtctttgtcattcgctccacagtacgtgggctacaacgactgatccattccaaaaaccatgatacgatgcatcactgacttgttgggctgttcgacagaccgaatccgtctacaatgctcagggatcttgggaagagccttcggtggcgtaatggacgtcaccaggaaggccctactagttgttcaagatgaggttgggggccatctttctgacattttaggggctactggtttgaaacccgttatgtgcacctgttctacccccaggaactccatgaagagaagctaggggaagttaattcctctataaccgagagttctaccatggtagagggaggggaacgtaatctcaagctaattccttaggtatgttctgtatagaggcttcatgtctctatacgaggatctgtcctctcattagattggggttgaaattctgtggatattgggaagccttgatgccaggcagggagcatcacctacaaggctactatacgcaataggcggctgcattaggttaaggctcttctgggctgcggcacatgtcggacacttccatgctacagagtcctgcctgacatggaactgccttccgtccgagtcaggtacccgggcggaatctcgtgaccaactggcgcctgactctccttcgcttgtgacactggcagctaccgagtcctcaattccaccatccatatactgaggccgtactatgtacgcaacaagtttttagttgaatatcgtccctataaatctagacatacacagacacgaactagctcaatgccaccttcgtcccattcctcgaacaaagtgtcagtgcatagccctccacccactgccctgtatccttgctttcaagcacggagaacttctgggctagccgaaccgtgacataccctgcctccgttagtgcatactgttgaccaacgcagatgcgtggtcccccattgaatggcaggtactcccaccctggacggatctcagcccaacgttcaggccggaactcgtttgcatccgggccgaaaatgtcctcacgacggtgaagagcatagacattataggcgactgtgcagccctttggcacgaaaacaggcgacttgccgtctggtccgccaccgcggggaagtactgtatccgtgttcgcaaagcgcaagtttgctggaacaacagggtggaggcgaagagctatagtgccaagtaagtcatgtttcatggggacagagagctctctttcaggcctttctgaaagtcatgattactcacattcattcaggcaatatctcacatatgtcagattacgcagttgctcgtacgacggcgcacggccttctaagaaggcaatctcttcgcgcaatttgttccagatgcgagggttctttgctagcataaagaacaagttgctcaatagggacgccgtggtatctcgcccggccaggaggatatttattagctcgtcgcggatacgcctgcggtcccccgtttgctgggctaaaccatgcagaaataaatatttctgcttctcctttgcgtcatgactgtcccctacggggagcgctttctgctcgctggactgctctcgcactctcattgcgctgtcgacgaactgctccaccagttcatggcaggttcggatgcactctcctactttgcggtcgcggcggagatatttaagtctaccaaggcgtagatctgccacaatagccttttgtgcataattgaaagcgctggcaaagtcctgttctgtactgtcacgggccccagtccgccgcttctgaaggctgtgcacgctgtgcccgaagaggaattccgttgcagagtcgatcgtaagctcgaagaatagctcctgtagatcgaccgttctgccctcggttggaatcagcgatatcagttcgttcactagttcctcaaagatatccaagtgcgcgacttgctctttcgcgaaatttggacggaccatggcacgcgactgggcccagtgctcgccatcggtggtgaagatgccatggcccaaaagtggacccattgcatcgatgcggcctgctaagccataatccttgaatcggagggacaaaactgtctttatattctccggctcgcatgttatgatgaaaggggtgaatcgacgctgtgtaaaagtgttgccgtatagcttgaatcgctcgattgcccgctcgagaatcttatgtttcttggaatacttaatctgctcaaacagaatgtcgagaccgaagatagggtccttctgaggataagatggcggcggctggcaattgttcgcttttatgatacgacggtgcgtccatttccgctgcaggtaggttgtggtataccaaagaacgagaatgaccgtcgcaatcgttataacaggatgatcaactttgtcaaaagccatagtgagttacaattctgtctagagatggagatgagttgtcgagtttgagctgacaagcgaccagaagtccttttaagcagcgcttgagtgatggatcagatgatggcaagccgcaactcggacggctccaacggagagttcacgccgatgaaccgcacatctagcgctagaatgcctgaatcattggcgagcagggcctcctcatgtggagtgaagtacagcctcggcggcaggagcagactagcatgctgacataaccatcaagagagatacgaatgagatgatgaccctgcgaggaaggggggggaagctactagtgctccagccgctcaatccctgttgtgcggggttcttattggctttcagctaggtatagatgcttgcaggaaggatcaattcgatttgaagcgctcgatttgcgcagctcatctctcacgtgtcaaattccaagtttaatatgttcaccgcagctatgcagctgaacatgacaactcatcaccatgggcggttaatggccgcagtaaagtcccgaatgacatcacacaagacgatgaaggtatattgcttctttctttgttcagtttcttttcttgttttctgttccgcccctcaatggccatgatgacctcgtttcaagatgcagaatctcgaatcttcccctaacaataccagccgtacgctcaccgagatgtacatacataatccagcataaagccagccatcttcagccaggtggacggaccctcaagcggttcgatcgggtgtaaccactccaaacttactcggtaagtattgtcgatagaggtaggcctcattggggatcacgcttgcctgccggaagtgcgactggtgtgataagcactaaaaaccgcacgagacaatgtcaccacgaatgggtgctgcgtatgctgtcgcctacacgcattctcgcaagtaccgatagactatggagtttgctgctggtgggcaaagatagttcaagtgacgcattttagtctggtgctaccccacactgcagcaacgcagtctcaaccactgatctccctccaagccaccaaggcgtgagatcacctccaccttcggagatgaccactggtgaaaaccttaggagagttaatctatatcttctaggtatgagcgagcggggatatacgcatacatacttcattgttgaataagcactaatccgatcactgagcggcaagcagctggtcatcgtgggcctccaagcaagcgtcggtcatcttatcgattgcatccgcccgctcggtgcctgcgacccaacttctgtccaccaatctggccaaggcatcccccacccagtgctggcagttccactccaaatccaaatacccattgcgcaccagcgttcgtgccaccgtctcccgaatctcatcctcctcgacggaggccgacaagtccgccaccggcactgcacgcaccaaatccccaagttccatcgggtcagctccagggtattccacgtatctgtagagaccctgggtgcctagaatatgtaggatactgcgtttttgcgatgcaaactgcacgtatagagccgtgtgtcggtattcgctgtaatcgaggggatcgcctctgtagacgaggataaagagtctgtgagacatgctcaccgtaagtactttgttctggaaagttcttgactagaagagaatttccaggaatcggggatagcaatggtaaatgatgatcaggtgtggaggggcaattcatgcggtggtcgcgttaagagatacgccgaccgggagacacgctaatcgttattgggaagcggatggttctgcctgccgaggttttgtgtgcctgagcggatccagtcacacaaccaatcgatatgatttaattcaaactatacaacataaactacattcatgaatagcttggctttatatatgaatatatatgatatgtggtttgctttgcatttatggtggcaaagaaaggatggcttgggagcttccgaagtttccggggaagtatgcatatgcttaacatgttcactatcagcttatacttttgctagccagctgatcattaaacagtcaaatttccatttcaataggtaatggctgtttaatactaaatgccgttagtagcatcttagataataagccttatgaatcctggtaggtattcaggtacgcacaacttttaaccgtttcaatttaacgcggaacgctacgaaattataatatacgatctataataagatcttcaagccaagcaataccccacctagatagtagatagcttatttagatctttgaagatcagcacttaatcggagcacttgcgttgtagaagaccaagcaaacgtcagattcagatttctgcaatgtaaagatactccgacgctatatcagcatatctttagtgtcattgatggggaagaaagaagctcaagcccaacaatcactgatacagctacaggatatatcactttaagttgctactaagtctcaaactgatccttcccagaatccaatgatctaagcccacacttatttctttccggtcgagccaccgtttccgctgggaggagtataggtcgaaccaccgtttccgttgttgtagtaggtgcttccattggggttggagtagtagtaggatccgtcactacgaagaagttgttagacaggggttggcttgctctagtggaagtatagctaggttattgagatggatagctgacctgttcgaatagtggtaagagttcgagttacgactgccggatccgtagtcgcgggagcaccagtgatttcccttttgattgaatgatattgttaaatgctgtgatgatgaggtctacatgcggtaggcgatggcacttacctggctgttggttccggagcccttgtagctgaagtcctttccggagctggacatggttgttatgattgactaaggaagtattgaggagttatttgatggagagagaaatgtgagagagtctcaagaagatgaggcttttggataaagagttgataatgggtggaaaggtagatgtgggtgagtgattatcataaatagagggatcttaaacagaaggaggggcacggcagcagccgcaacggatcttggccccatgtcatattgagttggtgaatatggaactttcctcctccgtctgttcaatttatacgagtgaatgaacaataagatttgtcaacgggccattcgatgcatgtacgtagatagttaactttatcgggctgtgtcatcgacaggcatattgctgtatgttaggcttttactagcttgtcctccattcttttgcttacatgacttgtactatggtatcaatctgtacgtctctactgtaacaggaaagttcagaggatactactacggaatagacttgtcattttcgaggagttgagtaattgatgtatcgaatttgtgactgagcgaacatgatctgtactcaacatcaacttcctatgtgtatgaaatatagatatctgccgcctactttgtatgcatacagcccatcaacagtgatacaatggagaaataatcggtgactacttactacgtagtgatggctcatccgagaaagcactcattaagtaccgaatcaggaaggcgttattctctatccttattggctgtagtttctctgctcaatgtcttatgtcagcactgcacatcttgtgcacattcccgattcggcatagtcacaatcgagcctcaagggaagtatggcgacaggtgggatctctaccttatcctagcctagaccctgtacctgacagcttcagggtaacgagaacggaccccatcgtccctgcattggcttcatcgctaatatagcttaatggcacgagctcgctttggccgatgatactgtcgttgttatgcatcctttctcttgtcacgtctgctgagaagtttcggtgcacaaaatacggatgaaagcagatgttctgctacgtatactcgttatagcttcctacgcacagtgctttaagcagtgatccagttgtcgggggtaacatgtcgcattactcctggctgaagacttcagagcatctgcgttcctgaaagagagaaagacaccgatgattaccaaggtgatagctgtttcttctgctaaccttgaacgcagcgcccaaattatctgctatcatcaatactacaaaacgagatatggcgctactgctgcctatacggatcacgtgtacctccccaacgtcatgtctccccccaacttgagactttgatggcctacatccatcactgcaaccgagctacgaccatcatatggcccctggacattcaaaataatctaacaaatacccccctctcttctctggaacaaagtctgatggaaagggtttatatccaggtattggctgtgctcgattcctctttgaccatgtctatgtcattatggctcgcgggctattatcggggaacggtaagccagcccgtctggtatttctattccttaagctctagctaactgtgaattctcttattaactatatggaaagactttttcagcgcttcctccatacactggccatataccgcggatctttcgttcatgttgtgagacttctccgataccatccacgacccgatatttccacccgacgctctgaagctctactcgaatggggattctagtaaagatgatcaaatcgaagcatctaaataatcgacagatgtctgctatgcatacaagcttttacaaagttatgatcgacagagcaaatgcacttacacagccgagctgcgagatctcactagtgatcttcagatcttcagatcggcagcacagctttctggaagatcttctacaatataagcagggacagtcattttcagcatgcacgcgctcatccatttcttctacttaaaagtaggtataatcattcaaaaacatcaacagaaacggaattaacaactcaacaagatcagatcaatccggatagctcatcactcattttttcattcatccccagggtttgtcttcgtctcgaagacattgaagcgaccgatatctcatgcatagagatgcatttaaacgtaggtgacagtgacgctgtcgccagagacggaggtctcggtgaggacggtgccatcctgctcaatgtccataacggtagcgtcagaggggccgacagtggaaccgtcgctggtagcctcagcattggtgaaggtaacggagccgaagtcagcgaaagccacaagagagtcaccagactcgaagtcctcgacgatccactcggcgttggtctcgcaaaggtcaccctcgacgttgccgctgaaggtgtgggtgacggactggccagtggtcaggttctcaacggtggcgctaccgctgctcttgctggtggcctcgacagtgaccttgatggtgtcaccctcggagatggtgatgtcgttgaagtcgtaggcgtagtcggggtaccactcgtaccaggcatcgtaggaagtctggccatcctcgtagcagaagtcgacaccagtctggagaatagcggtctcgcaggtgtcaccgtcgataccaacccaagcggaggcgcagtactcctcggattgtctcttgttcttgtagtagccgtagccaccgccgtagccactggagctgctagatccagcagagacactggggacagtgaactcgccagtgaccttggtgtagccgtcgccgatcaggacggcaccagcccagttggagctgtaatcctcgttggaggtgccgttcagcttgaggatctccttgtcggaaccagggatgtagggagggttgctgtggcgcttgccagcggcgcgggcctccttgcgagcacggcgcttctcagtgagaggagcagccagagcggcagtggcgaagagggagccggtaaggatggtagagaacttcattttgacgtttggagaattggtttcttcgaaaagatgaagagctaacttattgacaaggctggtggtggaagagtgagaagaacgaaccaggcgatgcttgagagacttgcgatgctggatgaagaagaaaagacaccagaacggcggaatccaggcctctatttatgctcgagcgttttgcaaatgaagttgatgttttccctcttccatgctcttccgatagcatgcaatccgccgacgatgacaccactgctcctcttcgtccgacggagtttaatctccaggcccgccaactaaaatcgactaaaaccggggatgcagaaaggttcaccgtcggggcagcagcaaccatagctgcagaaaaacgcccccgcccaacgatacggggaaacgattgtggactgcaaaaggtcgagcgagagtggagcagcgtactatccatccagcatggcccgcacgaattggcatccctacgcagagacattctggttggagcgcaattccttgcaagccaagattgtgttgcattagtgatcatctccctttcttcgtccaggccgcaatgaacccccggcaagccatatccgcccttttcccctcattgttggatcccgtttctacctagtaaggtcctcccttggaaccttacccaactggcacggccagctagccggtcagccagcccgcggactaaacacggatactccgggtgggaaaaaaactttcctagtagcgcggacgaacatgcaatagtacgacagccacccgatccagggggcgttgcttctgagaacgatggcaacagccagacatcgttccaccagtggagaggggagaggagggggaaagaggggggacggacgtccgacggcttggcccagcgccgggagcagcggcaactagctaggtacagggccttatctgaccgcaaggcttgaggaagctggctggcgctttgggcagatttggtatattggaatacgtggagggttagtgcgcggatggcgtcgcccgaaaaggcaggggaggaggggagggaagcggcaccggcgcaggcacaacaagcttcgtccaagccttgtgggcgaatgataagcaattaggggaggggcgcaggttgggatggaaagagtatagtacaaggttagtactccgtagtactatactagatagattgagaaaggggagaggaaaggtgtgcggggaaagtcatcaattggccagcaggggtttgataagggagggttgagaggaatcgtactaaatcagtacttagtatctactccgtagtatctagaatactgctggctggctggctggctagctgtctggctaacaacaagaccgagtacgaacaaagctggctagacaaatcgaggcttgagccggcgtgtcttggccgtaataggatgtaacatgtttcttgcgatatattggcagttgaagtctgcacgggcagtggagatcgagttgaaatgaatcatgacggacgaggcgcgagggggaatccgaatcgggcacagcaccaacaacgatgagggttagtggtatagagaatagattaaaagcaggagtctaattctgcagagataaagccggtgacaaggtaagcaaccaatcagatccaatacaagagtcagacaatgccacaaaaggattgttggtgtggggaacccaataatccatccaattatgactaacggcgggatccgtccggctgatcccttcttgatcgagcttaaactccttgacgaatgttgccattcgcttgttattctaatgctcatccgcttcggcgaatttatctccgggttttcagtcgcagctgatttctgcaggcacccaaattaacccagtcttacgattgattggtttgatatgtttagaatcgagtagtagtatcttgtgtcttctatctctttcttgctgatcccaattcctcctttgcactttgtactttgcacaatccaatcgtgttgtccagtctcatcctgaagttagctccgtagatacatacaaacttagctccgagatgggctccagctccagctccagctcggaaatggaccttccccttctaggaggttctccggattgcgacagagtactaggcatactaggcagctgcggtgtaaaaccaagcacacgacacgaacctgtccatatggagcagtaagtagtacagagtacccactactacaactgcaaacaagttcagtccctccttatcaatccccgatgtataaccgataggaacattatgcaagataagtagtggcaactacgcaggtagtatcactgacaatcagaagatagttactaaggtactagtactccgtaggataccggcgaaatccttcctgactagccaactaagcggaatgtcggaaaacccgcttgaacccctgactcgattcataacccatgcaacaacatcatgattatactctaatcatccagtcataatcctggaattcatctcatcggagatgcaaggtacataccacagacaaattggacaagtcatgacatggcatgggttggttatacgcggtatacgccggatatgcatatttatctcctaccgagagcaataatagattagagtgattattggtttcttcgaacaatgctattcttgcataacagggatattattgatagtgtcactgacaagggtcatgtcatgaaccaacccggtcattcaatccaggcacgactgggctgattttctgcagcttggccagggaagggagtagcgctaggacaggacatggggtttatttgcactattactatatcatcctatactaatcaactaattatagttggttcattcaaactttcctttcctagccgagattgttctatcagccctccggatatccctcccggtacctttccatctacgtaagagtatatactatagctgaatagtgtcttcatcgcatacccagtcaatactccatcggtcctccgaaccccccctcataagaattaatcttcacacttggcatttcccgacaccatgcgatgcaatgcgaatgcatgtgtttatctcaacttccaaacccctgataatgtctgcacgggattccgcggggactccgtgacaatctcccacgattcttgtctgaagaaagatagcggagagtactcggggaattacgagttgctattctgcagggtggcggcggaagtagtcggctatcatgtgatggactagggtcttcttctggatcctggatcctgaaatgttgtgctggcgtgtttatgtacgtagtgatggaatggtctagagtgtcggcggaggtgggatttggataggtttcttggttagtgggaagtcagtggccgaccggggcttgagggtgtgggtggtagatgggtggctggtgagggtagatacttgtttcttggggatgtcgttgagggatttattcacgtataggagtagtggtggtgaaagtggttagtggtagacgtgggggtgaaggtgttgtttggttgtgataatcggtgctgattgttagtgcgggtcggcctaacataggggaagaagtacttgaggggttatatcccccagcaggtgctactgagttctttgctactttttgacagctgttcttggttgtctactattttcgtggataggtcgcaaaatattatactgtgagttggagccggtgttatcccctatgttgagagcgagtcaggagtgccttgaaggaaagtttaagtccagtctggctcactactttgtacactacatgcttggctcacgatatttgacaaggaacaatcgaagaatactctgtcttgatataggtgaagtcgttgaaagatcatcatgatcgacatgatcgaccgctagatcgtggcgttattagctgtagccatggcggaagaagtcgtgatcagccatccgccatccgccatccgccataatcagccacaagataagcctgaagccatatctacggataaatcgtaccctacgcctcactacaactcactccacgtatgaaaaataaaaactcatcactccatttctagtctataaacctatcaaccactgtagtcaataacaacagccaatctaacaggcccagcagaaaggtttccaccaataccaccctcgtccgtctcagcagaagtataagcattatcaacctcggcagcatcagccgtcatactggagcaagtcgagcccagcgcatcacagatctgcatgccctggacgctcatatcattatcctgagcctggatagcactgacatcaaatccagaccagtcgttattggcagtggatccgaagtcgaattcaccccaggtgcaagcatatccgccgctgctaccagtggggagggaagagccctgagcagcaccaaatccaccctgggtgtcctcatcaaaggcaacgtacttggtgtcaccaggggacagggtgaacgagagagcagagtatccgtaccagccgtccatcttgccgtcggggccgtacttgttccagaagacaacggtccagtcctcagtgttctggccggtcacctgcatgacgtacttgtagttggaggcctcggaggcagacacctcgaccatgttgcttccccaggggttgccgacattgccgacgtaggtgtcgccgctgccgtaggcggaggtgctggagccaaagcccgaggtcgagtagtcgccatcactgggggtggaggtccagtcggaggagctggcgctgctggtggaactggagctggagctggaggagggggcggagacggagatggaggcagaggccgagatgtcgatttggcgacgggagtggccttggggcttggtaggggtcggctggctgagagcgctggggagagcagctgccagcagcaggaggggggtgctgaagtacatctttcttgttcttttaagagagtgtgtgtgtggagagagagaatgtgtcgcgtcgagcgagtgtgtgtttgttacaacgaaagtgtgaatgtaatgaatggatgtcgtacgcctatcgaaagagtacgacggagtcttggtatgtaaagactgtgtggtagttgggaatcacaatgtcgtgaatgatcagggaaaagatggatgaggaagaagaagaagacgaggtctatatacctgtgctggagagcgtgccatggctgtctctcttctggaactgggaataatggatgcgtccagaacagggaggggatggggtgcgtcagcctggatgccatggattgaagtagtgggggtgggttgacgcggtggagggtctacaagccattatgaaagtcagagcaagcaaagtaatcccattggctgaacattggcttgggatgaagtttagaggcatccactgccatgaatctggactggggacggtggaggagtggattagggtttcttggtggtggggagaataggtttgtgacagtgagaaaagtcctttgaaaactcaggcaaaggtgtcggctgttccaagggcgcgtcactgccgtcgattcatgcctcaaaaagtggcttgaggctgttacttccattgtatgtgtgtaagaactaggctgtttcagattcaacggccacatggctgatgcatgagaatgtgtgtgtttagtcggaagccaagcgggccaagggatcaaagaaaacgccaatgcagagtggagtggacgacaaactgctcagaaaaactgggttttctatagtgttgtggagctgttagtacgcactattttcgatgacagtggttaggccaagcgtatctgttcactgtccaactggtctttgcttccttcctatcactcactcacctccaaccgccaacaacctgcctctacaaccattcagtccctatccagcctcaactcaccagcagcacacaaagacctcacagccaagacaggaataaagcccacaaaagaagaaaccgcaaaaataatcaaaccacgaattgtccccatcaaccatggttatgcatctctgggccaggggctcgaacccaatgcacgcaagcagtggttccgctttcaagcgcaacaacaacgcccattggtcaaaaatgtagccggtccaggggaacatccgccccggccaatagcaaaacatcgcctacaaaatccatgcacagtcagcggttattgggcgagactgaaccgtgggtccacagcttggaattctcagaaaggcaacgcagctgctccttggcagggcagcacacgtttgagggcgtcgccctgtgcgccctgttcctggcgacccagcatgttgctgccgagaattccatgggcggtgtccttccaacggggtcaaagaattttctttcacgatggtctgttgttctgcttgtgggtggggaggaagtagatctcgacacatttagcgtcgtttgtatatcccagaaggagtaggtggatcagacacataatttgtgccaatgcatggcatttgtgcggcatttctaatgattgctgctaacttgcttcagtattgctctctccacattctgtgtgtgtttggttgacgtccacgggtattcaaactggattggcgctcgaggcgaaccgatcctgcttgcgaggcgcacactttgcaattgagtttagccatggagtttgtggccaggattgatgacctggcaggaaaacttgaggtgtggcgaagagtaaaccgctgcgagttggatggcactagactagtgtcttgcctgttgcaactgatgaactagcgtaaactgggctagacgtctagactcggcgattacgcagtacggtgcacactactatcgagagttattagtatactcatcatatacctcaggtcagtcgtcatgagatagtcggaaacctgattctctgcctctcactctatggatatacaagcttaaacttccgctgtggcaagatgagcttcagcatattgcctcatgtagaaacctggagtgagctgtgcagcttgaattgactttggaaggtgagcaggcccggatgagggaatctggttccgagtgtgtccggtcggggcatgtttcagtggacactgcgaggtttgagaaaggctgttattcagcggatgagatatttatggcgagactaggcagaagttagaggtcactgctatcatgaatcgggtggtcactgacgtcttagtctagtgtaaagcatttttagtttcctgaggtgccgggtttttatacggtgtcatatgcaggtgaatgttgccaatgtcttctagactagcgaccacatgatatcatgtgaacagccatagttggcgtttctgatctacagctgttagcagtcaagcatgccattgatcgcctgctgccaaccgaggtctgatgcagatgaaactcaacttgaccaaatcatcgcgggaaccccgacagagcatactcagtagctccgttctatactcgatcgcgtcattgaccagtcacagctccacgaccgcagtctatccagctacttctgcctccaaccgaacacaatccaacaccacaaacttatgaccacccctacaacacaatagcacctgaatgaaccgcaacccaatatgcatttattaacccggctaaccccaaaacccaaaatgaccctgacaacaaacaaggcggaaagaatccagaaaaatttaactcctgacccattattccctttgcaaaagcaccaacaaccccataacccccaacatggccgtcttcaaccacggatgctccgacagaagaatcgtcacgtaccccacgaatggaatgtacccaaacacgcttcccacaacatcgtcccgatcaaggtaatcttgtccgcgcgcatagagttccgtatcatccgcgatattgttgtcgcctttcgtgaggagtttggcttcggatctgcatgattcaatcgtaaccagattagttactgcactcgctaccttcttcccgattttatgtccaaagtgggtacactcacccctcaccaaactgcctcaccactctatgcacaatcgggatatccttatccttcacctgatacaccacgatctctccgacgttcagtgtaggttgcgtattccggaggaagaggagatctccgcgctggaaagcgggctccatggagccactgaggacgactactatcgggctgggggagtttgtgaggaccgagaggcctttccacatctatagatttccaggtgttagtgccatacattcaattgatcttgtcatcatgatctttctttgcgatgatcggtaatgggaagaagtgaaaataatcgtaccatgaatgcagtactcaggaccagcccgaagttgagcagctggatggctgtttgccgtacattttggattccggatagcatggttgcgtggggggggttatgagggatggtggtgacgtgcttgtgctttgtatgtatggatggtctaggtggccttgtttgtttgataggtcgtgatgcttaggtaatttgtggctgatgcagatagtgttggcacgtgagtgtggcgcgtggtgtgtgctaaccgatttgggaagtataggccatgcagtcattctttgtttcggaggtgaggatggtctatgcattgagagtctagtacatgctatctataatggtatcatggtgtctatttactctgcccgcaatagcggtcccctcttaatcggctcaagtgccgtgtacggctgtgtcggcggaagcgcatcctgactccagtgcacgattgcatgcctgagccaatgcgcatacgtcccgggcacattatctgatccctcatgttccctccacagcgacccgagtgtcacattcattacctccaaaatatatccgtgcgcgagcttgaacccgaaacttttcttcaggcaagcctcgacgatctccctagcctgcttctgctctgcggtttcctcctcgccctccttgggaagggacaatgacatgagctcaaacgccttccgaccgtcccatgcagtcatgtcattgatcagctgcgatccctgcatgaactcaatgccatagacatgttccgcgacatatttcggtccatcccagttatcttctttatccactaaccccataaccagagtcatcacctgcccctggataatatagtccgtcagctctctgcactgctgctctgtcatattaccggttccagtgaggagcggcaaatccttcaacagcgggctttgatgcattccttccgtactcgtatttccctcccataacttcaacagtagacggtggcatcgcttgaatagcggattatcacgcctcgacatgagaaagtagttggtgagactgcgctcgtcgacatcgccagcattgtaggagagaacctcgaaccgcgagtcgggatttccgaccgtctcgcgccacagtcgatccacgtcgccgatctggattagtccaacgtcggcatagataccaccgtacttgagaagtagaggtaagcgaacgagatcggatgtgtgctgctttgcgtaagtgccactgatggtgccttcggcgaatgcttgaggaaagttgttcgaatcattgacgtcgataaagttggctatgttgagcggggaggacggatggcggtcgacgacacgcacaatccatccggctttggagaagcgccggtgccatgcgcgcacgtttcgcttggtatatgggtgcatggtggagtagccgctgtgccagaaaagccaaatgttcttctcgtctgtgacgggtcgggggtggaggaggtcatagtcgacttcggagtctgggcggaggtccaggaggtgttctgggattatgtgtacccctgctggtacggggtattgtttgctgggatattccatctttttgtggtgatctgatgatgtggtggtttgtactagtggcattgatcacttatgctcgattctatgttggtgtgttggttctggcttggattttcgctctgcgagagtgccttggaatgaaactggtgttgattgtcaacgaaattcaagatttattcctcatttatacaaatttggtatctatatgattaccgaaagtggaatatccgcgacccacctggtggagaggcggtgcaggatctggaatgagtgcaacatgactcatgatgagggaggccttctgagaccaatcaagtctcctggattgaactagtgctcactcgtggtgcaagacttctcaagattgacactctgcacttttatgccggcatatatcgctgcgatcaactaaattcgaacatagtctgttctgagtatattgtgcattggaatccagaccttagtgatagttgggtgatttgtgctttgtgagtgttctggcaacaagagtggcaaggtatgggttttagtgtactgtcacggcgctagtccgggttggcagatttctaatatgggatcggacataatgttgaagcaactctcaccttttttggagggaatagaaaacaccacatagacaatgggttgcagactcgacgctactgtagaccttccatggtattggcacagtgcgttggtcactagcagtataggcaggtcatagtatgtcccgcgtatcgcagcacctacccggtgtatctgagggttcagtcaattagtttaccaccacccagtatctcctcacaatcgctaaacagtgaatactccctcatctacgcgtcacggcggcgcgtcttcattgggggagggatagaagtggattttcgcgatactttcgacatctcggtcggcgggctcctctcattggtctgtctagatcatatcagatcgatatctacgggagtgtgtgaatgtatgcatcgactaggactggggcaattcatggtagcacgtggtcttttctgtcggtagactgtctcttttggtgttgttatcagcattttcgtgcgagtaggcgcactgtagctagtagtaataattgttgttaaaacttgtagactgcttctctcctgcgaaatagtccgggatgcgttctatccgcacaatatatatcttgacacatcggagtgaaacaggcacaccatcaccactccacgaaaatagcccttccaaacatcctcagccaaacaattgattctaaagtcacataatcaccgaaaatcaagtgtatgacagtaacaaacgtagtacacggagcatccaaattcaagtcacatgacatggaaaagacactatacccagagcggctgctcgctagccctggcttctgtagcactaaaagaaagcagcaatcaccaagccagcccggctagctcaatcggtagagcgtgagactcttaatctcaaggctgcgggttcgagccccgcgttgggctgtccaacttcctctttccctttgcccggctagctcaatcggtagagcgtgagactcttaatctcaaggctgcgggttcgagccccgcgttgggctagaggagttgtttatttttttctattttttgtcatatttttgctggtatggaatgtttggcgtacccgctgtgtaggagtagataggatacccagcccggtaagagacacgtgctgcaccatatctgtgcaatcagtctacggagaaactacagtgattcgccacgctcggcatcacgccgaagaatctgcaagccattcaacacccaaaattgcattgattcagcgaaatgcactcggtcaggcgcagtaaatctcacaccagcaaagagcattatcaatcaacacccataacattgactcacctcacatcagcaagcggcattcggcctcggccttcggacattgcttatccgacagcaagaaccataacataccaaacagtctttaaacacataaataaccatacacctggtagactgtaccacaaatgtaacacagagaaacaaaaaaatccacgcacctcaaccaaaagacaaggaattggaattgatcatcatgcctccctctatcggcctcataatctgcagccaacgcactccacgcgcaggccctcaaatcgccaccttcattcacaatactattcgtgaatcctacccccccgaaacagccacaattacgaccattgacctagcaaaatggaaccttccactctacaatgagtcggggatgccatcgttcatcaactcagcggacgagtacgagcacgagcacacaaaggcctggtcacgggagatatcgcgccacgaagcgtttattttcgtcacaccgcagtataactgggggtatcccgcaagcgtgaagaatgcgattgattacttgttccatgagtggaagggaaaggcggcgttggtggtgagctatggggggcatgggggcgggaaggcggcggcgcaattgaggcaggtgttgcagggggtgaggatgaggccattggagaggatggtcgagctgaggtttccggagatcgaggaagttaagagggccgctaagggggaggatctgggactgaatggtgagggagggtattggactggggagagggaggggattaaggctgcgtttggggaattgattgctgcgctggagggagaggctgaatagattgtttgtttgatgcatagtttagactctggcatatgagatgtaattagtcacaggttaccccgaggttgagatagaagtcccacgaaagaagatattgtcacaagttcatgatactaacagggtattcatgtgatgccaatccggtcatatacctgaagtaagagatcaaatgtacgtcgatgttgtacagacaaccccatccctgccccgcagttgcggtaaaaacccgcaatctcacaatagactcattatcacctagcgaagtaagataaccgtgtcgaggctgaagtcaggtgcaggtgtcttcttcgtaggaacggtatccacaaacagatagatgcaggaaccaggcacgctggcacactccactcccaaggaaatctgatgagcgcagcatatgattccctgtttgtcatgaggatgccgggatgtatcatctcatactatccaactgggctattcttcaaaccggcgtataagtaagcatattaaaagccactattccatttgaggtggccgactaaatgtactagccagtcacagaagcactcactgtataccattattatattatcattcgtctctgatggtccactttataagcttattctataccctcgtaggcttactaccagcggctgcccttccctcaccaacccaccactctctcgagacaataacctgcgacatttgcatcctcggaggtggaagctcagggacgtacagcgccatccaactcaaagatgcagggaagcacgtggtagtaatagagcccaacaacaggctaggagggcacgcagcgacattatacctgccagatggcaactacgtcgactacggcgtcgaaggcgtcttcaacaacgagctctcccgcaactatttcctccgactcggagtagactggaagccactactcccactgaacaaacgaaccgactttgtcgacttctcgacaggtgaacgcgtgaaccccgcagcaggaatcttgcaagccctcgtatcaacatttctttaccgctcatccataaagcactggacgtttctcacaagaggggtttacgacctccccgacccagtaccagaagaacttctccgcccattccgtgaattcatcgaggaacattccctcgaagctgctctgcagttggtatttctcttttctcagaatgtaggaaatctgctcgatatgcccaccctctatgcgatccagaatttcggggtcccgcatgttgacgctctcattcatggatacatcacaccgaaaaacggcatgtacgagctttacagacaagcgagggaaatactcggctcgggtgtgctgttccagacaaacgtgatcgcaacaaataggtccgattccggcgtggaggtaacagttcagcatgcgaacggtactcgtcagctcattaaagccagaaacctcctcattaccttccctccgctcataaaaaagctccaaggcttcgatttggatgaaacagaaacggaactattccagaaatggttctggaggacatactacgttgccgtggtgaataataccggtatcccggacaagctgtgggtcaccaatacagacccgactaatggactggggtatttacctcgcatgccatttgatttcctgctgcagtatatgggagcaccagggtattcaaccagcaagttagtaggcgatatgaacttcaccgaggaagatgcaagagaccttctagcggcggattttgcgcggatgaaggcaaaggggacatacccgattcatgatcctcaaatcgtggtgtttggggatagttcgccggagactctgatggtgtcgccggaggatattcgtaacggattttatcgcaagttgtatgcgttgcaggggaggaggagtacgtattttactgggttgacgttttgttctgatttttcgtcgttgatttgggcgtatactgagacggttttggagagtatgaattgggaagtgtaggattatgcgatcgtatatagggttatttatcctatttcagcaagatacaattactcagtgaaactgaacgatacgaagatatgtttgcatactggtagtgattttgaagtggccttgaagaaccttaaattgtggccatttttcttgagcaggaagtctaggcttttcgtaaaccattctccagatacaactgataatcgcatatatgagtcggtcttgagaccattaatccaagccactatttgattaggcccatacaaatgttcttcctcctaagtcactgtagcacctagatgacgcttgtcatttccgcacaggcaaacccaaaattaccgatactgtttcagcacggtggtagacccagaccaattccgaggctgtcgcattatcctcacctttgatgtattacccctgtatgtgtcaaaagtagcaaatagcataacacaatatggcccacattcgagggcaggcagtttagacttggtagatgtcggtaattggtattgtagctttattctgaacaggtatctccaattcatatagaatacactatattataagatcatcatcaacagaatataaagtacctcttaagtcgatgaactatatcttaataacgtccactatagcccatgacgtcgccaacgcgccacaaaaaccaagcaagtaattccagcgcggggaagtcaaaaaccacttcaattgcaagctgtaacctcatcagcaactcaacccacaagacactatttgtagcacagcatatcgtcaaccccaacgccaccaatatgacgagtggcctgacacatagacctgacacattctgatcgtcccatatcttacctacctgtatacgcccagtacacttatttaccaatggcctagtatccagtctagaccgcacatcgaaatgacgcactacgtcaccccaccttctacacttgtcaagttaagtccaagtgcatgtacatactcagctagccagccaacgccgatccccaaaccaagattaagcgatgccaactcccaatgagtatctgcagatcgaagaggtgacgatagcgatagcgggtcagcgggggctaagcattgaatgggtcgggctggttggttggcgggacgggcatcccgtcgccgccatcggtcggcagtgactgcacgtggggaaaaccagtctcccgcttggcttatcgcttggatttgggtggttggccgatcggcgaagttggttttgtttgtttgatgtgtcgattctgtacttgtcttatctattggtgagtgaattgtggctggcgtgatgatgaatcgggggtgatagtggtggggtggtactgtaggtaagtagtataaagagggggatggttgtgtttcccctttgctatttttaatctttgtttgttgaacaataagtaattgaatcttatcatatcagaactttcccataaagtaccccaaaaagtcaatatcctttatcaaccctcacaaaatgaccatccctcactacggcgtctggatcgcccaaccaacccgctacaccgcccaaaccgaagaagaagatcccaagtcccctcacatctacctctacttcaaagacgattcctcctccagcaaggactacgaagccgccatcaacgtcaaatccaccggcaaagactctcgtctcgtatactggttcgaccggagcttcagccacccgatcaccgagcagctttctaatctcgatgagggcttccacctcctcaaatcctattcccaccgcagtcgtcgacaccaagaatcctcctccaagctgaagggcttggacttcatccgcacaaagggtcttgtgaatatcgagtcgggtgcggtcctctctgaggccgacaccgggccgcacaatgctgtgctcgaggcattggagcctattctcaatgatgcgatcagtaagaaagcaacggtgtatatctttgggtcgtcgtatgggtcagggatccatgatgttcatatgaatcaggggagtgcgccgtcatatgagaatggaatttatgaggatggggcgttgttgtttagtttcggggatgggcattgggaggcggtgtttttggcgtttgcgtcgcaggagattccgacggatgataagggggagcccgaggaggggagtaagactttggctagtattctgggtcagtaagtgttttgctcgaggtgttgatttgggtggatgatgaaatgttatgatttggatgatttgagcgtagtagtattgagcagaatgttactgcgagaggcagtgacattcggtactaggttcattgcctaagatacgatagtgacgaatacactttaccgttctatacgcctgagttctctacgtagtcattgacatggaagattccttgaaataacatttatgtcaatgtgtctagtggtctaattatgtgcggacaacaaccactcaaatcatcaagccttcttcacccacaacatttgagactgggtataactcttcaagccctcgagaccccattcgcgaccgttgccactcgccttcatacccccaaagggaatattcggagcaacctggaagtgtgaattgatccacaccgatcccgactccaactgagtaccaatacgttgcgcacgctccacatccttgctccaaaccgaggcacccaggcctgtatcggtgtcattggcgcgagcaataacctcgtcttcatcggaccatttcatcaacgggagaataggaccgaatggctcctcttgcaccactctggaattgtcgggaggattgtcgatgatagtaggggtaacaaagtatccctcagattcagtgatagatcctcctagagcgggcttcaggttctctgtttgaatggaagagaagagatccttgagcttcccgtattgcatttcattctgcacaggcccgaaaaatacatcgggctcagtgccattgccgaccttcaggtttttagtgaagttgacaaaggcttcgaggaatttgtcgtagatcttttcgtggacgtagagacgcttgatcatcatgcagacctgtgccgaaacaaggaagctcaatgtagcgagctgattcatctagttagccttcctcagtgtaacccaatgggaaatatagacatgcctgcggaacaacctcgtcaatatctacatcctcgcaaacaatggcgggatcatttcctcctagttccaaggtaaccgatttcaaggtatccgcacaatggcgcatgatcttctttccagtctccgttgatcccgtgaagctaattttattgattcccggatgcgccgtcatcaacggcccaatattcccatcgtcactcaatacctgaaccacaccaggcgggaagattttcgccgccaactccccaatcttcaacgcgcagtacggtgtgaaaggagatggtttgatgataatacagttgcccgtataaactgccggggcgatttttcctaccgctagcagcagggggaagttccacggcacgatgcctgcgaccacacccatgggtgtaaagcgttgaataacacgctgctcagcagtatcttggagcacttcatcgttgagttcgagctgcggaatttgtttgcaccatgttccggacatgtttacttcgatagcggcttggccatgcggcttcccttgttcttgaaccaggagagccgtgagctcctcagcgtgtagatcaatggcttcacctagggcgacaaccttgccacggcgctcggcggggcttaatttggaccatgttttgaaagcagcccgggcgctgtctacagcacggttcaagtctgacgcagtggagacgggaacgggtgaattgggcttgcgcgtggccggattaaggctgtggcgggttgctgatgtggttgtgagttcattgttgatagtattatagaaggtctgtaaaagaagttagatagccattctatggcaggaaattatagtggtgatggaagtaaacggaacgcacagtaaaatcaatcttatccagggaacccattttgaggtggaggatctcggtataacttcgggcaaagaatttgatgtaggactgtctctctcgaggagaagggatttctctgtcttataagtttgaaatatgagctagctgagctagcatctgtagcttcgtatttatatcttggctggatgggttatcccttaaactactccaccttcagctcccaggtggggataaagcggggattatggaccgcatgccgtcccgacgaatacgagaggcgttttgccgtgtgatgacgcgtgatggctggagcacatcacgaagtgatgctagcccaagtagactagtgtggactgaataatgggcactttctgatcgtcgggatcaatggcgttcccgggaactacccgagaataggaaatacgggtttcgcggggccccgcgactcaccagatcaaaaagcttcctttcaacacatccggatggagattcggcttaataggtagtcgacggcagatcaaatcgggagttgcaatgccttacgcccgaaagctagatgagaatccgtaaaccccgcaggatggagatctgcgaacggatcagcatctgaaggcttggctgcctacagagccacggcgctcttatcacgttcgccaatgagagcgtacttttcccaaagggatgtgaggagtcacatcggggatgtgctgagaacggtcccgataatccggcatggtttctatcggcgacaggaagcgcaactatagcagcctgttggataaataccccacanaaggtgtccgcttagctggtgactgacctaataattggcggttcatcaatagctggtaatgaagagagggaatcattgagttcgcatctggtcgctagtggagtgcttagtaaaccttaatcagctctccccgcagttgagaatccggggtttgctgcctatctctggtattcggatataaccaaggatcgggttcagatcacggcaaatccaaaggtcgagctgattggcatgcctcgtagtctcccattgagcccagttttggggtatgtagtaggataccaagcaggactgacgcttaaatagaacgggtgtttccgttatttggccgaacatgcgcgaagatagcttttgcattgaaaatcttctttccttcagctcttattaagcaaacaaaatcatggctgcgaccgccacagcactggtgatgagagaggtgaatagtccactcagcctggaggacattcgtcttaatgacctgagagccgacgaagtgctagtcgaaattcatgcgacaggcatctgtcatacagatctgtcttgtatgaatggaaatttacctgcatctactccatgtgtattcggacacgaaggtatgaaaatcccgcttggatgcccataaccagctaagacttcacctaggggctggggtcgttgtgaaaaccggcagcagcatcacacatctccatgtagacgacaaggtgttattgagttatgcattctgcggaaattgcgagcaatgcaccagcgaacatccagcatattgcaaccagtgggtgccgagcaacttcggtcaacaaaggtcagatgggagctttaccctgtctttcccgaacggagatcctctgcgtggaaatttcttcggtcagagttctttcgccagtttggccattgtgcatgcatcatgtgttgtgaaagtgggtcctgaatgtcctttggatagattcgcaccgctaggttgtggattccagactggagcaggggcagtgataaacacacttgacgtgcaaccaggatcaagcctagcggtattcggtgctggttccgtgggtatgagtgctatcatggcggggaagatacgtggcgcaaagactattatcgccgtggacttaaatcaggatcggctagaccttgcgaagaagcttggagcgacacataccattatcggatctgatgaggacattgtcaagcagatccaagcgatttgtccaccgcttggagtgcagtatgccgttgactgtaccggtgttccggcagttgttgagaaagctattcaggcgcttgggacgcgaggaaaattggccactgttggtgctccaacacccggaaaaacagctaaagtcgatatattcgcacaactggtgttcggtcgccagtatgtaggttgctgtgagggagacggtcaacccgaaaaggtaaatatgctcccgcacaatcagataaagcagcatcgctaagaacgtctagttcctgccatacctcattgagcaaaataccaaagggaactatcccatcgaggaactcatcaagaactatccgattgagaaatatgatgaagcaatcagcgatatgaagaccggcaagactttgaaggcagtgctactgtggaagtagagttctggtttttgacaggctccatagctgccaggacacgaatgtatagaatgaatgatggtaataatgatggagtcgatggagttggtggcgttggggttacgcggagtgaagcggcaactgggaccgtggaggagatcatggagcctgatcatgtgatcgatatatttacaaagatagacaactgataaatatacgaccaacctgtctgttataattctgtcacacgatatacaaatcaaacttataatctcattctggttcagcatcataaaagaactagactgcaaatgtctctcaaaatcaataaatcaacgaatagaaagccctatatccgctgcagatacttgactatctctaaatggtcctccttcttcgccaagtccaaaggtgtatgtccatcctcgtcaatgctgtcgggatcggccttgctctgcaccagaagctcgacacacgcaacatgtcctttctcggcagctgcatgcaacgcagtcttaccccgctgacaatggacctcgacgtcagctccatggcgtaataaatattgaatgacctttctatgaccgctggaagctgcttcaaacaggggagtgttgttcgtatatttagctcgtgcattaggattggcccctgctctgagtagcagctgtgttaatccgttgtgacttcccattgcagcataatgtagcgcagtaaggtcccaatcatcggttgtagtatttgggtcgcctcccttctcgagaaacttcttcaccactggcatgttaccagctttagctgcttcaatcaccattcttccgtagtattttcgcacacgggagtgatttggcggctgggatgactgagagacaaacggtcttggaggggaagtgttctgctctgcatgtttcttctcagaatcagttttctcgggttgctgaggatgctgcataactgggatagatgggtgctgaaaagaatgtgccgacggtgtatatctcggtgggggctcggaatttatcggttgctggtaaacctgcggactttgagctagagggttcgagggataatgtgtggccccctggttgaccccgtgtgctggcaagcccaagttgatgttctccggaatatcagcctcggaagggctggttgaagccgtggctaaaaattgttactagagctttctcgaaggagaaaacaatcatgaaacacattcgcgtgtagatggggtgctaacattctggagaaaccgagccttcaatcagaagcaacagatcttttgtgtatgcagctgccgtaagtgccgcatatccctgccacatgtcgttcttatgggagtctgcatagtcacaaattcccctaatgacaagacagcggaatgcctcctgataccacaagttaagaagaggaaatcaaggaagaaatgtagaaagacgtgcgactcaccaaagctcccgctgcttccgtctcaaaacacagcactccgtgcttctccctcagacgttccctaaatttcccattcttaatgacttgatttcccgatccaataagcccgtagtgaacatttggttctgtcgtttcccgtggcgtccgaaacacggccatgtggtgactgcagtttctgcaattattgccagcgacatggtcgtaatcagcacggtatagcacatcgttcaccattcctggatgagaaaactttgcacgtatcctggggtgctttctcagagcgtcgctagtgatctccatcagaccactgtccctcatcatatagtctgcctgcatggcggcaatggctgctaaggctttaggtgccggcctgttaagggcgccagttgcagtcacctcgccgtccggtcctaacttgccgaaatcgtactgcagcactccagggtatcctgcaaccggcatgctgaccaccacatctcctaagcgaatgtcatgggactcgcttggcacaccacctccgatgcccaccatcaaagcgaactgtatggatggaaagacgcgtctcatcatacttgatgcaagggctgcctgagtaattccgtacacaccggcctgtaagatggccagtacgacattatgacccccaatccggccaaagcgatactgattggtatcaaagtctgatagaacttccagatcaggtggcctccgatgttccacgtccagcatggttctcgctgctgtaagctcgagcggcaaagcgcagatccagcctactcgatagtcggcgcaccggagtgatatctgtgggccgtatgcacacatgactagttgttaaggagattgagtaatgttgtaggatatggagggcacttgaaatgagaagaaagtggaggcttgtcactagcttgcaaggataattgcccgcttttcaatgttcctctgctcaatgttgggctgcaaagccttccaacaattgtccttatcagcaactaattgccagcaagtcgtgggtataactcagctttactaagtgttgttcgggcagctataccttcatgaacaggtgttcagggtgcttccaacccccgggatcatcggaactctatcgtaccacacagtgcgcgtgtacgtggaagggtcagaaccgatggttcaagcagatggtatggagacatagaagcttgaacggtgctcataagacaagccacaagctgaactttgcaaagtaatgaaggcgagaatgtagataatcccactttgtttcactattaccccaccatctgttgcttcagtccgaactatctattattttggctaaattactgatattttagggactcttaggaggttctaccatgaatggattgggtctctatggaacaagttcaaactgaaatcacaaaaagcaatagtagtcctcgcgcacccagtatgaatcaagcaaaacttgggaatatcccggaaaataatcagaagccaccaattcaagcattcaacagcctttcaaaggacctcattcgggctgagactgaccgataaagctttgcagttagatagagtgagactatgcttaaaaggccaattgcaaaggaaggtattagcttacctcagaagccgtgggcctgataagcccaacaaatgttcatatcttctttaattcgttggccagttcctgagcgatactatcaaatagtcctatgaccgtcttctgagccaggtatgccaccatatggcgcttgaacttgtcattcgactcattgaaggctttcactttttcgggaccgcagatttggagtacatggcttcggaaaagttttcggagagtatcctgcctggccgtggcatcgatgtgttcgagggttatgtcgacaagatcaagtgttgccttcccattgcttctttcagggtttccggacattgtgacttcggaaaagataaaccagttgtgttaaagtgttgtagcggggcagagctgagggtgatggttatcgtgtcgttggctgatgggatattgatactgttgatgcgagcatcatcgggattatataggttttgcaacaaatccccaaagttaagttgtggtttctcagaaagcaagcgtgatagagatagcctcagagttgagggaggcaatacgcagaagcaaggacgcccaacgagtagacagcgtgtacaggctcactgtggtcatctccctgacttttctcagccataatgccagatatctctattctacgaggctaaaagaattgctccttcccgaggtatacaatgggaagggtgcttagggcacgaagtatacagtgacctcctgggtagtcaacagtttaaccgtgtgatgagggtacttgggcgtgattgcattagacatgaaagaagacatgaaacaaacaaaagagaggtggcaaacagcactcagtagagtagacagctgatcaggagcggtgaagataggggcatctgataaaagcattttttttaccagacaggcttccttactggacattagccaggacacgcgcagatagacatttgcacgttttatgggcacactgcgtatcaactggggagaggccagcagaatgactgacgtgttgccacacgtttgggccacgggagtttgccctttatcgttcatgcagtgcacaaggctgatctctgtgtatgagtgcagtgattggcggtcacggtcaagcactgcactagttgcttgcatgtattgtttcgggcggatgatggtgatgtcatcgagtttcatctaattttgaagacgatgttccatttagcaagtactgaatcaggcacagatggatatttacaaagggtaagagcatatggtttattcagttctcgtagcggccacatagagccgaacatgaaggcagattcggagaacagcgaccggcactccagacattaggcatcaagacagcctggttaggctgcccccagggtaagttgtcaggaataagtgtgctcattgcaagccatactttgctatatctcggtgattgggggtttgcttctccgcggttgccgcacaacgttggggggggggtaccgtactaggggagaagctggctatgcgatattgggttctcaaccctcaatcacgcgcacagagtctatggctaccttatcatcgagttgtgtgctggcatccttatggcagcgacgttaaagatgtcggaccgaaggcagaaatcatacttagatttccctagtccaacgctagtcaccacgacataccagtaaccattgcttctattgccaggttacgagctatggatccggaatggggcgatgagtctgaagcctcaactgtcggcgacgagcaggaggatactatcaatgagattgtcgccgaagttatcgatcagtttctcacggaatttagccgacaactcgggattcgacaaccggaagactcgtcaccgccacgttcattggagcccaaggtgcccgagactgaggaagagtatcgagaatatgtctggagttacattgagaataaactccgttcgtattatcaaccgggtgaccaatacgtggaagagatagtgaaaagtgcagctgtccgcgccaggagtctcacacagaagtatgagttgaaagctgaaaccacgccaaagttggccattatggccttatatgactttgtgatactttgcggtatttgattcacttccctagatactctgattccgagctaaccttgtgcactagacgatagcaagtcgatgagaaaagacaggggcactcgcatacgggctctcgaagaaacttgtcaacgtgttgctgaaatcgctagcgctgtacacgaacaggacgtgtatctccggtttctaaacaatgcagaagatcggcatttaaacaagttgtctcctaatgagatccaaggtcaaatgaagaagataaagtattctgggttgaccagactgggaactgtgctcagaaccaaaatcgttgagcctctcatttacgatcctgtgataaatggcctgtctgcgaagccagtgattactattgtcgtaaccgatggacgtgtgagtaatgtctagcttcatcaaatgtcagaggaaagactaatccgatcgaaacatcagccagaaggtgaacacgagaactgttttggggagactatcttgagctgcaaacagaggctgagtgaactttccatgcagccagctggtgcggtgtttctcatctcccgagttggcaatgatgccaatgcagagacattcctgagtaatctcaagatgaatgaggaactacaagagatgctctattgttgccaggaccagctggatgagcgacgggaagtattccgtagagctggcaaagatggtcgatactcttcgtatgtaagtgtacctcttgcttcgtgctgaacatagtaatgtcgcgctttctcacacctcggtacagcttattgaattatttgtcgccgcactagatagccaggctagatagactaggtcagtgactcccaacatttcatatgagagtacattctcagtatatagcctgaaatatagtccagtatttatttcttttctttttctttttcttttcttttttttttttttttttttttttttttttttttggtttttatgttcctattgtaaggtatgttggtaaggaactggtataattcagcatcactaataacttaacaatgtatggaaaccaactgggattcttctgcggcatatgtggaagcaaggacagcgatactgcggatgcaatgcagctgtcactatgtcgggcgtatgtgctgtaagaaaccatcgcccgaaaccacacaataccgacgcaatggtgatgagccagccttttagtgtgtatgttaggatagaaagatcaccccttaacaaatccaatctatgactacgatgccggcatttgcacgatcgaatctgtgttcttaatgattcagtgacgataattaatatttgtgatcttttatctctttcccgacaggaaatcgtcactgaacacagaggcttcttacttccgcctcgtctttcaagggttcattcgctctatttcatctaagacctgcttcatctgcccttgagaacaaggtaattgatatataatttctctaaaatcctctgacatgtagctattacctatcccacgtgttgtagcagccgtctggattagtctcgtactggttaaaatcatacgtcaacttagacatactacgtctagtataaatctctatgagtctcaagtatacaatacctagtaccactgagggaggttacactatcattagcattgcttgcctggccatcgccactgttctaagtagttcatatagataaggctaatgattagtgtgctgcacacttttaacaaccaagttttctacattgagttcagtatgtgactaaaaaggctaattagctaccgtggcgtaacgggccattccgaaatttccagatatagtggcagatattgtagaagcctaatcacaaaagacaaaattgctaaaagaattagtgtgctctgtacaaccgggagatgccgtgcgatctagagtcagagcttgtcttaccttcaatgccttcgtggctggctcagctcagatcaccccagagaatcccagagatataatagtaggtgtcatcccatgcctcttacaatcctcaacccacacaataacgtcaaatattgactggtcgcccgccgatctgcctcctacacctcgagagatgtcaataaccgttaactcgcaagtagttgagcttgattgcttgatacccagagtcgttgatgttgaacgcgaatgtatctactccagacactcttatttggtagacgatttgctaacgcatgatatcagatgaagatgtcgaacaattcatcccctgggtcttccaacacacggatctcatggactgggactgcacacaggactggccagaggaggaacatctcttcaagaacttgtttgcttcactagtcgactatatagaggagcaaggacatggaaatatgatttcagagatcttgtgcaaggaaacgggcatatcgaatatcctgaaacccagcgagacaatcacattgccccgaaaaagctggagagtcagtaaacgatcatctcatatgaatttcatctactcgcaaagccatatgtttgccgacttgatgcggaatatctattataggcttgatgatgtggatgaagaggccccgaggcttgggtaagtgacaaatccactgtggatggttatctcagcatgatggtaacatgtttctagcgtcataccattcccacgtgatgtgagatacgcagtgggcagggtacaatatgctgcccgactagagggtaatgttcacgttgggacacgagctgattttataccaataatctcttttactggggtatgtatattagccactgcttgggaaaaggctgcaatctaatggtatacagtggtacgagggacaaacttggaatgaactattgacggacacaatttgcactatgctgggacatctgactatgaacctaagaataagtccgcatggcggtgttcaaagtcaggaggtctttgttgttggtttccatgggccgtatcttcacatatgtcgtggattcttctcgcgagatcttattgctagagtgcatctatatggatgctcagatgaggaagagtttgatctggagttcacacggggttataacctatatttgaaagaagattggcttgaggctatacgtgcgttgaccagactgcttaggtatgttcttagtggcaaagcaatggttgcagcagtgcacagaaagccgtaggatggatgggggtgactggcatcatttacatagtttggctaatctaaaggatcaagctgcaactaatcgatctaagtctgcactagacagcgttgcacatccgcgcttggattctctcgcatattctctggcatctttcaagctattcggggctattccccactaagcagaaacaatagaaggggaattgcagcttcaacggtattgcattaccgcttcgccccagacttataccatactatgcagataatgtcccgtcacgctaattttcggctcgcgcttgcatttgccagctgatgatattcccaaaaagtagcattgatgaacatgactttactgccataccaacccgaactgctcgacgacttaaggacaagggagagcacggcatgagttcatctactttggtttgtcaccagactgctattgatctgtaacttctcctgcctaggtgcagctctttattcccgtatttggcaccatacacacctgacaaagtctcctctttgtggtgatgtgacctcggatattaagtgcgaggagaaacgacgacgcttgtactgcatatgccgaccggaagaattgagagcgagaggcagtgcaatgatgctctgatgatggcggaatttatcgagcaagtaagacaattacttactgtaatctttattccatatctgattgttcattgaaagtaaccgaatctactagcgagcacaactgcgagatctcataatgcttgtgggcctcctggcccgcccaggtgtaagatgtggaacaccgtctagacgtcccaggacatactaagcataagcactagtaagtatttgagctgtcacttactctcggctgttcgctaaacatgaaggctgcctgccatccaatcagtgatcgtctatctgaaatgcagaaataaactagtcctacctgagtacgtattaatgatgcaggcgatcctctccaatgaacgtcagcgtggacatctgcacaaggctgttcatgcatgctggactagtacaccgcccagtcgcattgccttgcccccattcttgatactttaaagggctcccattcgacccccgctaacagagggaaagttgcctttgtcagatgtccagcagggatcaaccgcatttaaagaaaccctccacccatcatgatccactcagctccccatccgtcacaatggcgctcaacgttactacatacgcgaccatcgtgacagtcctgctggtacgatattctctcggcgttctcattagtactgctacctaattcgttccagctgcctgttctcctagcaataaaacggctctacttccatcctctctcccgctacgatggcccacggctctgggcgctgacgcgactcccttacatgctcgcctttcggtcgggtcggcttgctcacgacatcaaaagattccacgatatttatggcgatactgttcgtgtgggcccggatgaggtgtcattcttggatcccgattgcataaaagacatatacagccgtcgtcccaataacccacattacaaggcgctacccaaggatccaatccgccaaaagcctccacaacctggacagcctggcgacattcttgatgtggaagacgatgaccactcgcgtattcgaaaagcatatgcccccgcgtttagtacacaggccctaaacgcccaaaagccactggtaacgtcatatgtctgcaaaatggtcgcccagttgaagtcccgggccaatagcacggacccatctaagagaatagttgaccttcagcgttgggtcacgtactgcacgttcgacatcatctgctcactgagcttcggtgaagactttggctgcctggacaatgataattaccacgaatgggtcgggatggtagtcaactctgtgaaaggcaaagtgcagattgcggctttccgcttttatccatggctcttcaactacctagtcaagagtttacccaaatccgcccaattgatggtaaaaaggcatcaggccatgactaatgagaaggtccaaaagcgcctacatacagcagtagaccgaccggatttcttctcataccttctcaaatcgaagaacgagctcacagagcccgagatggagattaacgcggctacctttatcttcgcaggaagccatacacttcaatcctctctcacggggatcctgttccacttactcaagaaccctgaagcccttgcccgggtagcagaagaggttcggagtagtttccctgatgaggaggatctggatgcgaataagctatcgaaactgccactcttggacgcagccattaaggagggtatacgactaaccgcgcctgtgccgttgggaataacgagacttgtacccaggggaggacataccgtgtgtggacaatattttcccgagggtgtaagtgtacatgacgcttccgagaatctttcaggcacaaggctaatggaacaactatacagagcaaagtagcatacaatttatgggctgcgggcgtgtctccccgaaactttgccgaccctaccaagttccatttggagcgttggctgaaccccgatgagggtcgcttcgcaaacgaccggcgctctgctatacaaccattcttgcaggggccgcgggactgtattggtcagaatttggcacggttggagatgtcgctcgtaataggatacctggtttatcacttcgacttcgtgttgccgaatggacgagaggctctcggtgaatgggaagatcaagagacctatgctgtttggatgaagtcgccccttatggtggagttggttgcacgttgatttgactcaagacaaaggacaggggcggattggaaagtatagagctcaaaacgcacaaaggggtctacagttcgtcgtggtctaagggtatctaaatctcacctagattcgaaagagttcattcaccaggatgagctcaaaatatcttttctaaatggagggtctcttgatttaaagctttgatagttatcctaactagctcaatagcccaatgcaccctggcgtccttagaaaggtcaaagatggttgataagtagagtatgatattaactgagttcgattagttttacatattcttagatcacgatgagcttaggacatttgagatagatagataatctcctgatcaagagtatctagaagtaccccgactatcctattcaccctaattcacctgaaactcccaagtcaatcttgaaatggtggagaaatccgttgcagtatcaagggagtgggattgagttgtacacaccccctcgaccatgttgaggtattttcagaccacgttgagcttccacccgaacaagccccgagccattgataagtaagactgagtctctgagtccatgaataccgttggaagaaaggccgcagcgccagtaacatcctcttctcaggcttgacgcttgatctagtttgcatatgtagatgcggcagagactctcagcaagcatgcctcaaggttgttttccaggttctatagcacgcgaccgtgaaagacacttcgattcgatcttcctatgaagatggactgaacgactgagctttatcactcccgggtgatagctttccgtgcccatacaagctctggcccataatccggtcccgaacgatacaaagcaatgttcaccaaaaacgcaccccacccatccaaccaccaattctcagccatcagttccagtgcaacaccataatgagcgagaaccaccagtgccgtgggatgatttgcctgcaacagatccaggtacttcacactgaccacggcaggccacctcatcataatggagggaaccggatttgccacactgattgcctgttgcagcaggtcaaggaacttttgaacggattcttcaatcactaagctctcgctatcatagcagtccggccgagaagaccgtctcaaattgtcataaatgtccgatatgcgagtatataattcccgcgcacgcgttgtctttgattcctcacgtggctgctcgccgagtttcagtaaatctcgcatgccgcccgcttcaatccatgggcgagcctgtcccactattgaagctacaccccgaattaacatgaaaacctcaagaacagccgacaggcgcagagctcctgggtcggcctttggtccgtgcgcagcaaacgagaacataacgacgaagcaggagaatgcaaacaaagcatggcagtttcctgaagttacattatttagaagaggcttacacaaagatagcgaaatgttgttgtgcgtcatggcggcctcggtgtacttgtgtcttctctcgacggggccatggtgacttaggtgaagtgcggataaagccaatagactgtgcatcaaaaacggatgcgatagagcctcctgtgggacaaactcccgcagaaccttctctgtggatttgtcgtgtaccagtgtccgcacggtcgccacgtgccagtggttcaagagatccaagtccaacagtgggagttggaagccgtcatttctcggaatgagatcgacgcgggtaccggaagcagcaaagctgtgatgcgatatttggggtgtgatttggccctcaaatgaacatctgatgtgcttcttatggcaggagccgcaaataggccgaaactcgtcacattttatccgacgatgtttgcactgggcacagccgtgatgggatttagtgtgagaccgtcgagagggcatgccattcactttatctccctagaccatgcagataacaaccgtcgctctgagccgatatggtgcgctgttggaggcgaggcgaattctggggaaatcccagcgtctcggcgtgtgggacctgaggcagcaaatttaacccgtaaactatcctgtttacggaatggttttcgaaattggcctcggaaccaattcttcgcggctaatcagcaactgttgttggttccactcttcgattcttgttctctgggctgttctttcggaaggtgaacaatttgcataaccacggcagcccagcaacaatcgtcgatacgcctagatcactggctaataaggatgcaccatttcgagttcagtcttactttaatgactaagcgtatcgcctagagacattatgctcgaattgaggacacgtccagtgggacctgagggcctctgctatctcttggatagcgtttctctttctcaaaagggcatagttttcgaatgaaatgattatgcctagatcatattcgatacccgagacgatgccttttaaagctggcctgcccatgccccagacttctccgcgcttgaactgtagtcttgcccaaaggaaacttttagagaaaccaagggagaggagacttaaagctgcacacaatgggggttgcaattcgttcaggctttgaatattactattactacccctctctagcagcggcggtgatattcatcatctgtttcctgctaaccacgctcttgcacacgttccagctcgtccggacgaaaacatggttctttataccgttccttatcgggggctactgtgagtcaagacgaagattatacaaaatattgggcacttatttctaatgtgtttgtttcactgcagttgaatttgtaggctactgcgcccgtgccgtctctgccaatcaatcccccaattggaccatgggccctttcctgatcaactcgctccttcctctggttgcacctgcgctctttgcggctagtatatatatggaattggggagattgatcatcgttcttcatgctcaacaacacagcctcattcgagtgaaatggttgaccaagatcttcgtcaccggtgatgttctatcatttctgcttcaagctggaggtaaggagcacttgcagttgccgagaaatcgctacaaactcatgctaaatcctcaatcttcgacctgcaggggctggtctcatgggtagtcactctaaaagcggtactgaaaccgggtcgcatatcattgttggcggtctcgtcgtccagattgttttcttcggtttcttcatcataaccaccgcaattttccaccatcgcatgctacaaagtccgacaccatgctcccttgaaataaactggaaaaagctcatctgggtattgtactcagctagcgtgctcattcttgtgcggtcgatttaccgtcttatcgagtatatcgaagggtttgggggatatttgctttctcatgaggtgtacctctatgtatttgacgcgttgcttatgtttgcggtcatgctgatattccatgtcgttcacccgagcgagctcaatgcttggttgaagtcgggcgggctagttagcaaggggtttcggttcgaaaggctgaacgggaattcgatacccatcagctgagactatattcatcatatacccctttcttatgatttacttgcttcgctgtccaaatttactatgattctattccatccaggcttcgtgtggtaagccaggctttttaacggtccacaatggcacagcaagaaccgtattcattcggtgctgctgcatataacgcattaactgtcaaatcaaataatctcggttacatgcgttcaactaagagtcagctgatcagagcaaccttgaagcaatcagtctcgaatgcgacaatcgttacgcaaaccacacccactcatccctcccttcaacttgtgttacgccatttctgcttgagacaacgaaacgactctggttacagtggaatgatacttatatttctcagcattctttattccattctgttatttctctgctgacaagtcgtgcacttttatccaaagcgttgataacatcgcggatgtcgttatctgtggtctgtgggttgatggtacacattcggaggcagacaaccccgcgaatacgagtggtgaacacgactgcgatattctgagttgccagtctcttggagacaagactgttgatatcgtcgatagcttctgcactcattccaggcggattgaagcggaagttgataacagccatgctactaggtgtgacgatttcccaatcgctgagcttgctcacttcagtctcaacgagatcggacagttcaaacccgcgcaggatcatccggtcaatcatgtttgtcccgaggatgtgtaaagaaaaccagagcctcatatgacgagctggtcgtgtcaactcgatcccaaagttaaaaggattctcaatatatccgtcttcgacatcacgcaagaagtgcgcggttgtggcgaagctctcccttggacggaccctttctttgaaaaggacaacaccacagccataggtttggaagagccacttgtgaggatcccaggcgatgctgtcagcgcggcctatacctttcagaaggtccttgcgcgattcgcaaaaagcaactgatcctccataagcagcgtcgacgtgcatccacattctgtactctgctgctatatctgcgattgcatcaaggggatcaatactcccagtattggttgagccgcaggttacaattaccacatacggcttcaagccgttttcgatatcctgaatgatagcctggcgaagactccccagatccatttggaactccgcattgcagcgcacggtccttatctggtgctttagcaggcccgttatacggagtgctttggctacacagaagtgcgtctcctcggcgatatatgctgttgctcttgtgcgcatgtcatcttccacaagctgatcccgtgcaacagtcaatgcagtcaggcaagcaagggaagcaccggacacaaactgtccccctgctgatgggggcagttcgaacttttcagctacccagcgaatgatagattcttctaccgcgcagataccggaacccgactccgagctccctgcataattgttgaaggcggttgaaataacatctcctagccacgataaaggagaggctgccgagggtacaaaggcgaagaatcttgggtggttgacgctgtagcgaaaagagaggatatcttcgaattcttgcacaacatcttccaatgatcgcccttgctcaggaggagaagacttcaacaacttgaccagctgctcctttgttggacgtttgactagggctgcttgatcgcatagaagtttgtccccgacaatttctgaaagcccttggagtgtatctcgcacgatttcgtccatggcgtagatagcgaagggccactaagactgtatgtggcaaattctaagaataagtgtagcccagtatccatatagtaagtgcgctatgcaatctttgatgatgaatatcatcagtacccgcaggagcgagacatttttgaatatatagtgtgccacaattccaggggcaattcatccataagatatgcagaggagctaatgcgagcagccgtatccggagagtcatgggtgtccaccagcacattccacccgtcatctgggattgtctatcacctgcagggcattttacaattttagtgccggtcaaagcatagtagtcaacctttcgctgttagcttggggaaacgtaacaaggattgttggttaaggttcggcgagatgtccggctatcaaggttcttcttaacataacctggtcatgagtcatgctttgtcaggctaccggcaggctttcaggacattacgtagattatctaggataaacagtctatgtcaaccgcgagccagtcactgattgtaaacgtccttgtcgaacggtgcctgaacatgctcggaggctgatagagtaccgtatccgcttcttgtccctctcaactcattgtccagagcttcggaggactttattccgttttctataggaatacctttatttggcaacacatctagtatttccttgttgggagttgacttgcatagtttgggtgcaaacgatggttggtgtaacactcggggaaaccccccttgcaattaaaacatgtcactagcctttgtgctgtaaatgatgagcgcaatagataattaggtgtctgcaaccctggcacaacacaagcttggaaggatgtgtatacatcaggtgagatggtcaagattatgccatgatgatgtgtgcagtggatgacgatcgtcgtcgtggatttggctgcatctcatattatgaggatatatttcatcgttgccatcgatgaggcccgtgttcgattcacggatgatgcaatgtgatttatcttttgttttgtttcttttacctacccggcttactagacagcaccaatttggtcatcttcttttttcttggccttcctatcttatcgtcatttgtgttttcatccatagggctgtttactagtcccgtctattatatataagaaatagctttttgctgcattactatctataaccacactcttttgcttccgggtaatgaggataccctcactttctgccccattcacttcgccattctaaggctacaccggttggaagttactgatccctagcatacaaagaagctggcctgtgtaacattccacaccatcagcgcaagggctaggatacgcagttgactcgttgatactggtcaagccatgaacaagaatggtgatctgagaacgcggtcagaaacccataatgcgtaagactgaaattttggagagaaccggcattcatttccgaggatcgtaaaagtttagtacgcgctcggtcgggtggactggttgacttcataaatttgaatggttcgttatcttcaaggacatcattagattaattgcccttgcgatgcagcgaacaccgcaaagatcactgactacatgaagtgaggattcgttgttgggacaaagccaaggcaagatccatattggttgttcaacattatattcaactcctcagcatgacgccagccaggcgcatacatctgcagaaatggcgcgccatatggtgatataacctgagcatatacacatgacgaaagtagcactcggagttgcgccaagtagccagagctagctgttcatcatgatattgatattacgccctggaatactaaccagaggacggccacaacgtatctttccgatcggcgttttgtaggatatggaaatacctgttgatgtgaataccttcaaggcaaattaactactgcaatgcagtacaacttatcagattgaagtggggtctttcgagacttcaacttctttcatcagataagataggaagtaagctgtccatgaaatggatgaaagatggactttactcccgtcttttgggttttagctgatggtgggatgatgggcgctgacgttcctaccactgtcccacactctcttatcccctcgaatttccccactctcttttacaccactgctctgctttcagctccaaagttccctctggatatcaaacagaataagtaggtctgagctacaatgcccaacaataaggagagctctcatgctaccgaggctcacatttcagctcatgatgcacaaggccctggcgtgacatccgatactggaagtccaggcgtcaagcggatcgaggctctttcatctcacctacatatcctcgaccgtgtgttccttttctgtggagtcttcctcattgcctacgtctacggtctcgatggcctactgcggggcacttatcaggttggcctccatcagcatgtttactgaactattcattctcacggctatctagccatacgcaacggcgtcatatgggttacatagtgtgttatcaagtgtcgatatcctaagagcggttattgcagcagcagcgcaggtttgtggtctttttgtctcccagttcagcaactaatctgctttgtttcacagccaactgcagctaagatcgccgatgtttttgggagagtggaattgatcttggtctcaatattcttctatactcttggtactgagttcaatgcatctcgagctcgttatgttctaaccacctagttagggactatagttgaggcgtcctcgagtacggtcgagcagtttgctgcgggcgctgtgttgtatcaggtgagagttgagtccgatcccgcatttcaattcctgctacatttgggctaacgttttgatgaacaatagattggatacacggctattatcctactggtcgaggttctggttgcggacgtcacttcgcttcgctctcgtctgctgttctcatatattccaacacttccattcttggtaaggtggacagattgggaagttatatatttgtttctgacgctgatagatcaacacttggattagtggaaacataactggggctgttttgggagtgactacatggcgctggggaatcggcatgtttgcaataatctatccaagtaggacactgcccccctgaatcagataattgctgattatctctagtctgcacgctccctcttctcatggtactttatattgtgtaccacagggccaaaaaggatggtacagtagatcatatcgcaagctcctttcggactttgggtgttcgtcgcctggcgattgagttgttttggcagttggacgtgattggcattatcttgatgatcgctttccttgccatgattctggtacctctcacgatagctggcggcctggattcccagtggaagaaagcaaagattatcgtccctctcgttttggggctgtgttgcattccggcatgggttgtttgggagagagcttgcaagcatcccatggtcccattcaaggtaggaattcggcacattgttggtgctataatactaacgcatgtatagctactaaaggatagagcagtctggggtgccttggggatagctgttatgctaaacactggtaagcaggaacatgtccttctgatgccgtttctaaacgaggtgcagcatgggctcttcagagtgaatatctctacactgtcctcattgttagctttggcgagagtattacaagcgcaacgaggatcaggtccctttacaggtaagctacaaggaattcggtaattgtacagacgttgaccccattcttcacagctttgccagcgtcctcaccggttccattctaggtatcgtagtattcaaggtcaggcgtctcaaaccattcattgttggaggtacattgttgttcatggtagcctacggaatcttgatctattaccgcggagggcccacatcatccagtcattcggggataattggcggccaaatccttctgggtattggtaggtccagacgcaacacctctaattgaccgaaactaactaggaccttccagctggaggattgtttccctaccctgcgcaggccagcattcaggctgccaccaagcatgagcgtgagttattccaatacttttcttagaagttatttctgactttggaaagacctggctgtcgtcacaggattatttctagcctgctacaatattggcactgcagtaggaggaagcatttctggcgcggtctggacccagattctccccggagagctaaacagtagactcggcaacgccacattggccactcaagcgtataaggatccattcacattcagtgctacttacccaattgggactccggatcgcgatgccgtggtggctgcctacaagcatacacaaaggctactgtgcattaccggcatttgcttgaccgtgccgctggttgcattttctctctgcacccgcaacttggttctgacgaaagagcaaagtttcgcaaatgccgaagaggatagtgctgaagcttgatcatctatgacaacatactagtgcggggtcatagatggtaatttcggaattgtagcatgaagctgtggtttgcttagaagcatagtgctattgatgatatccggttattgagatatgatatgatatgatatcttgggaattcaccacattgtcttaattcactatcacagagcaattgtacagaactagagactgaacaatttgcactactggaacaaaattcaatctaagatggtttagttcgctggattacaggttgcgacttggttagtcagccatcttccatggaaacttcgccaacagttgctgtgatctgtgagcaacaaccaccacatacgcgcacatttggtcttgtaccaccaaactacaagagaatttgtctcatgtgggtgatgtcaagcttaagcattacatctcaacagaaattgaatatactgctacttcaagtgacattcatatcaaagagatggcctcatcacaacccctctcagtgtgttgagtaatcgatggtcttctgccctatcttcagttctatttaagtcctacttaagatcaaatcataaaagattcactgatcatgtccgctaattctgatgccatttgggaggaccttcttgcggatttgaaaacacttcctgctatctcgtttgatgggtttgcgcgccgaattcatttccgagctcgttggcatggagatttcgacagcctgaggaagtacattggcactgaccaaccgtaccctgctaatgatgaaagccatgaccaggtgcttgatggcatgtataccggggaagaattcaggaggcttgggaattggttccttgctgccgaattcattagcatcgatgatgatggcttgtggcaggtagctgaggcagcgcaacttgcagcggtctgttcattacttcattatggccctgaaatacttcagcaatagctaaccgtgagctcattaacctcagttccttttttatcctatatttactccagaagtactccggggcctcatgtcgatgtgtcttgccgagcatctcaacactaaattcaaaagcaatggccatcctagcctcatggagctagcaaatactaccgggttcgcggactactttatcaacagaatacaaaccaagtctttaattatcaaccttgccttaactgaacccacaaggtcagatcatttgtttagcatctcagtccttctcgttgcggactatctgaaatacaaaactgcatggcttgatatatggagacttctctcaaaagacagaccaagctttaaagcactacatgcttggtctcttgtgacatgggatgagcaggcacagcgcgatgaagtgaagatagacaacatcgtgaagaactgtggtatagctgcgacgatggcatattgttctgtgctaggctcgctgtcaactttcgacgcactagtcatcttctacaaagcagtaatagctgcgattgatacagactcgtttccagaacttcgcccgtacctcgatagcatccaagcaagtatgaagaggctgattgacgaagccgctatcatcaacgaatttgtaagctactctgaaaagctctacacgaccttctaccacaacatgtccgagaagtggcgcgatggtgtacgcaacgcgtggagagaacgtaatactggtgctcttacagactggatcaacaagggttaggctcgcccatcccggcgtactttcatgtgggcactatgaaacatgaagccaaaattaacattaataatatagctacatcctcgacttatattgaaccaaatcagccttggccagtggtatcacaatccagtcttttatgtgggacgaacctgaatctttctcaaggtaaatcaaaacagataaagggtgttacgaacaataatcgattccttgtgtccgcaaagccgccgcgatatagccacgaggggtatggaaccgtaacttccaagtctctgaaagtgtgctcggtcggattcagtaagctccgcatcattaacatattttgcccctcctaggttaaccgatgtaatgacagacggcgaaaagcccttcacaactccatcgcaagtattttacactaccactggacttcgagcggtagatccagattctgccaaaacgagttgtccactcgctcagatcggaccattgagaaggggacatgttatctatcgcctgaccggcaatccggatgactatatgtacgatgctgtggaaataaggtctatagaagtgggccatgaatcagagcagaccgtatacagcgtgtcgctgtgggcaggcgagcagtcgcatcatgcgaacggttaccttcttgccatcaataaccccaacgtaagttcaacccggatctaattaccatctttgatttgtacttatagattattcattagagagctgtcgaatccacggcccgtgcccttcgtgcccttcctccaaagaagcgactctcacttcttgcatcatttcacgagctcagttcgacgttcacgaagaacgacattcaagctatccacgagcgactgaactttgaactctttggtagttatgggaagagagaggaagacccaataacacggtccgagatcttcccggcccttgtctctccaagtgaccagctaaaggcgatgaaatataaccctcgacagctacccaatggcgtccctctggacagggtagagaggaggttctcgctacacgcaaagggagacggtaatttgccttcagcatacaagcttcctgagattagcgtcatagatggctgcattcttgtagatggagagccccagatgagatgcaagttgaattagcataggaggactctccaatggacgcgcaaagtccaagaaaatgtgttcgaacacggagttctgtccatctactatcatggactgtcgggtaagggtgtggtactcattactgccacagatgcaccacagaactgctccaagcaggacatccaagcattcgaagcaatgccaacaagcgtagcaggcaatgtcaaactgcttcattccaggcggcaaacaggcgaaagggacagcgacgatgaaggggaatatatacctcttatcaccgtctcgatgcaatacgacaagagcacatgggcaccgggtgaacctttagacaagcccaaagatcctatgtccggtatggacgtgcaatggggctttttgtacccacctgatggatctcagaccacagcaacgaggatacctattcttgacgatcttcgagatcaactcaatgaaaaatataatcgaaaattcgacaggctttatgatagctgggaaatagtgctagatgacggcaggatcagggcaaccgtggaattcaatcttgcaagcgtcgtgccatttatctccgatgccgggatggacgtcaacactctgaatgtgaatttcaagtcccagttggggatcgacatcacgcttcccgttcttttccagtcattctacatcgactacgatgttgacctccgtacggtaaagggcgccatcttcgactacaatcctctgatgcgtgacacgaaaggagataggtgggtcgctatcagtgagattggcgtctttctttgtgctcatatattacaggcggttcatttgtgggatttcagacatcgatgattccgagatttatgatatgcgattgagggcctctaaagcctatgcggactgtgcggatttgactgcgccgaccgcattcacttcggccctgcaaccagcggaagtgacagatcagttgcatctgctacaggagcctacggttgacgagcttcttgcaccacctggctatgatgaggttgcagtaagttacaattgcctataactaagtagagcgagtgacttcaataactgaccacgtatcgcggtccagatccataatatgtctcaagtgcttatcaaatcgatgatgttctaccacatggatgacgatcagcgcgaagacttgaccggtcagagcaagcccaaagatctacctttgagtttaggggcgaacctgccgacagacctgcagaaattctttcgagaaaagtacgcacccgcatttctatgtcagtctgtaatgcgctacgagaaatacgaagataatttcacagatcaggaaaagaagaacatgcgatactggtgggacggaaatgtgagtgttaagcgacatagcaaatccctgatgaatatgtggaagctaaccgtgctttctgtcatgtagggtgacaaatgccttgcaaagtcgaaggagtatgccgagatcaaccgccgggcttctgttgaagccgttagccaattcaatgcggatgtacttgacaaatatttcgacgacaacccgaaagaatgggcctgcactctttatgccgctttgaaggacaaaggtcgaatgttgacatatctagcacatcctatacagggcgtaagtaagaccattgcgcttatagcgggagcctatattaatgcgatgtttcgttcagaacgtcaatgtgatcaaccgcgagtgctgtatccttgacgcattggcaccatcggagggattagccgaccagtggttcgaatatttcgttggctttgccagtgagcgtcatcttcactatccatacattgacccggatgaagatctggctggtcaatggctacatgattcgatgagggatcttattcaacgtgttcttgaaggagatccgtccgtcgacgaagatgtgcgcaagggcctggaaaaggacatagaggagtttgaaaaggcgaatggactcgaccagactgcaactgccgaggccagggccagcaatatcgtggagaaaggggcgatatttttcggagaagcaaaaaagtggctgaccgcagttggtaaaggtcttgcggttgctttacagggcacgaggctgtttcaattggcggaagccagctttgaacaggtgacgaaagctatcggggacagcttgccagggattaagaagctgaaaccgctcgctacgataggcatggtatgtcgtggactcttgctctgcgattgtaccgggcattaacacgatcgctctgctttcgcaaacactcacggtgattttggacatcgtcgaagtgggctcatccattggactgtatacagtcacaggggtattcgccacagtactgcccgtcctcggggctgtgctcgccgttcttggcgttgtaatgatgctcatcaacctgttcgtgaacttgtttggtggctctccacctcccgacccggtgcaggagttcatcgaccatgtagccaaaggcctagtcgggggatttgaaaacgcgccgccgccgaaactcgactataccatccccagcgtcatctacgaatccggcgaagtgaccggcatcaccatcaaaggcgaaaacacaacgaacgatgagatcagcatccctaatgcccggattgtggtgaacagcggcagcgacgacgtctgtctgttctctacggatgatttcgaactggtggaggatacagacaccgacaaggattcggataaacatctctatgtaaccccgaacagcacagccgaggggacattgtccagtagtgttctgggcgacgagacagagtaccacgagtttgatctagtggtcggtgggaaaaagaggatacggagaacagtttgcacaaactgattttgcaggccaaggagagcttcacagcggtatggacggggcgaatcaacaaaagcggtcggagcgtggtcgagatcattgagaagtcggaccttgacaaatgccatgttcagtatacggtgttcagggtttgacagcccgactccgctatacttgcctgtttcagccaacagattgatcttaatattgatatggtgtgctttttagccaacagaatgaaacacggatggatggctttgataccggcacggggttatcctcgcgatcgtattcgccggtgccttgaaactgctaattaaaaatccctcagtaataattgggtgcttcgaagatactgcatcccggtagtcagacacagacttctcgtccgtggaagtgatgcgaccgtgatggagtcgatggaatagaaccatctagagccagttagtttagttcggttgggcagttagtagataactagatactactactactagcagacagtcagtcaggtgctgccggtcgggcgggccagaaacttcgtagttagttagcgtccggtcggacaaggcgagcgaagcagaaggagaaaaaaaatcagggcgagagcgtgatcaacagggggtgaggcagctgctagtctaagcattcatcacatcaacaccaccaccatcaccaacacacgtcgcctgatcggggcgcgtagatagtagtcctcccagcatcgttcatacgattctcaattaattaattattttcgaagatcatcatcaggactaaatagtagtcgtcatcaattgatcatccctttcaaacaatgatgtgaaagaaaacggtcgcatgccattgactggttacacagaaatgcccaggactgaggaattgagagggggagggaaagcagcatgtagcgatgtagcaacctgttacgaaacaagaaagcaagtaaactaagcaagaggcccgggcgcggcggaaatatccccgtgacaggaaacattctgcttggcgtggtgggtggtgccgatttgccgctgggttttgactttcacttaggagtataccacagtcatcaatttgttttgtatggttccatctaatcagcgggtgatggattgattcatgggattgattgattggattcgaggtgatgagtttacgttccgttccgttatccggattatcgtcgaccaactaatctaccactcttcgtgagttcggacctgaaatgatcggcaggcaagcattgctgctcggtaccaagtaatcctgatactcagatgggctagtatacattttttttccattgtggttctttttcatcctggaaatgactgaattgagtgaaaggacggatccttggcagatatcgtggtacatcatcgtgcctcgtcatcaatcatcatggaagaaaggattatggaatgaggagattgaccgttttttggctatatacgtgtacactttggtggtgtggaatgacgatcgcagagcaaatttggccaggcggtgtatgtgtatgatgggtgtggtatagtcatatgttgggatgtagttactgtgtgtgtgtgtgtgtgtatctatcacatctagacctcaaactaagaaatcaagccagaaaaagaatcggagaattattagagtttcagcgcggacatcaccagcggaaagttctccttcagctgccatggtacagagcttggacgggaaggggagaataatggatggggggtgaacccgatggccactctttccggtcgggatcccgtgttgcaacaacacctcgcattcctcattgactaagtgaagtgaagggggggtggttgggggttggaagaattacgtacaacttgggtcgaagtctgatgatctcgactgatctatggaagtaaatatgataatgataatggtaattgcaatggcgaaatctatcaacccaacgcgccgatttaaccgagtatttcactatcatgagaaatatcggtggtggtggtggttgggttgtgagtaatgagtaaactagtaagagtgttgggtaaacgagaaaagtttgtccttctagactaccgtcgacttagacttggaccttctatgcgtgatttgataagggtggcgttgcttgttgctttcccgtttttcgcacggactaaacccgaagcagagcagctaaccacgttctagtcctctgcaatcgcccgtcggatccaaagtgccgttcgggcttgattatttttggaatggggcctgggtgattttgctgttcgcatgatcagcaagaaaaaaaaaaaaaaaaaaaaaaaaaaaaaaaaaaaaaaaaggaaaaatcggatgggacaacaaaatagcgcaagtcaggaacaaggagtcatagagtacgtagtcgacaagagaaaaaaaagttatataaactcccttctggtaccgtcgatttgcaacttggaatcatcatcatccaacaaagcaaagcaaagcaagctagcttctctcttcttctctctacatcatcgcattccaaaacctccacacaactctcaagtctatatcccacgacttccctcttacaaccaattacaacccaataatccacattcctcaaaaccaccttcaaaatgactatcccttatcccttgatcggccctgagtcctacggccttggctccaagcaggcgcgccgcaaccgcagcacttgcagcacccctcgcagcgttgacagcatcgtcgtcgatgccgctttcgccaaggaaatccagtccaccaacgcctcccaggagcatttggattcttgtgctagcagcaacaagtctgagaagaagtggaaggctcgattctcgaggaagtatgttatcccttgagttcaccaatatcgaatataaaagagtgcgatgctaacgatgaaacttgaaggttcttccacttcccttgagaaattaccacaccacacactacactacactacactacgaacaaaaacgacaaacataatcgacaataataatgatcgctggacggaatatagcaaagcaaagcaaagcaaagcaaagcaaagcatgggtgttagatggattgcatagtcgggagcattggattttttttgcatcatgtcatgattgttatggataatttagataatacttaattaatacccgcgggatatgcacgcttctactacctatcttcctgatgtcttcactcaagtatagaatagacactgtgatacgaacacttattggtaccacatcggagaattaatcctatcctacatatactactactgtgtacactgcagaaaaacctgctagaagatatcaaataatccctgttgtcacacgcacatcacacacccacaaactataactcactactaactagataactaactagataaatgcaatgactcaaaccggtttcaattttctaaaacagcccagacacagactcccagataacactagcgacactagcggccagtaatatctcagagaagagaagaaaatctcctcttccctcccgacgctaacgattttagtcccgctcggatagaacggccctgccctgccacgccacgccactagatttcgactttacgccacggcgatccaatcagtcaggaggtggagatgatgctgaggaataggccaatcatgggggttagttttcgataatcggtagatactaagtagttaagtgtcaagggtgtttgctgatgggggtttatgatcgttctgcaggtgatgatggtggggactttgattatacgtagtatactagtttgtaggatggggaggtttggaattaagtaacttagttggtggatagtatgattgccatatgctatgctatcaggggtaggggtagtaagttgttcatttatcgctggtttggagctagagtgcaaagtaggtaaatcaggggcagcctcaccactttacttgcaaggcgatgcttactgtagtacaaagcactctgtagtgagcgatttattgcacagcactcttcaaagcacagtgtgtttcatcccatccccctggagttccttagtaattctgtcatggtgactggtggtttcatgttacactacggcgcttaatgtcatgtctgcttccggatactctatactacgtctaggacaattcttttttttttttcttttcgtaaatctcgttcattcatcgtaactgcatcgcatctatgtaatggtcggatgatgcctcgccctttccatgaccccttggatcacaatgacatactacccatgaacccacccacaggctgctatatttagcaagcaagtaagcaagcatgcacatcaaagtccatgatgccacgacctgtggagactcagggaacatgggaccctcctgaatatcactgcaacacaggacagacccacggataaggagcgatcagacagacagaaagaaagaaagacagggtgagagtgggtccagaagctccgatcaacccgaccggattcggtcggtcggtcggtcggttaagtcttggccatcagtatgacagcccaagacacagcttcccatcccagctcattctatctggaagagtcagatggtcccttgctgtcggattcttctttgtttccctgacgtctgttcctggcagattggccccaggtattcagctggttaatgttccttggggtggtgatgaagctagcttgcgcttcagtgatctgagcaccaccactacctccagatttcttgttgttgttattgttgttgttggtggagccggttctgtcagacattttggatatattgtaaaccgttagcaaactgcggtgggtatactatatgtcagtgttatcttgggttgtttgagtgagattctcgagaacaactgttcagatactgtctgggggagaagctggagctgtgaggctgtgaagaccgttgtgagcgatgatgaattcgagattggtgtggtttcttcatggtttatatagacaatgttcccttcatcttgacttttgtcatggatggattgaaatattcgtggactgctttttccggtgtcgtgagaaattcatcgcgagatttcatcttgcagcgtaggttgcagaggagtataccgtcgacgtaggagagtcactatgagcaatatgtatcagtaaactgtaatctatgagagcattcggaatatgtctggttattggaggaagatagagagtacatcgtaggatatgcttaacgggaccggaaacagattctgggagcactgcatctttggtcattaccgcaatatagccgtatatttctcatattgatgccggtgaggatttcagaagatggcgaggcagacctcgagatagaatatacaattaaccttgtgaaaacctgaaaacgctgcatctctggtttgtaccgcaatatcagcgtataagcctccttctaccatcaaagagcatccttaaaactcactctgcgaaagtttaaacgtctgttcaatgacttgttgtcgcaacttctcacagccacactactatgttcgctggagcaagccgtaacacccacagcttgcagagagacaagaactgtggcgctttcttgctgcagagcgatgtttgcgccttgttgattctagaacaattcgacaaagaaaaggaaggggacgaggctttgtgggtagaagcacgggaggaagaaatgaaaagaaagaggaaaaagaagcgacacggcataaactgacaatgggctcgtgacttgccaaaggagtatcacgactgaattttctcgtcggagcttacgcattagaaattgcaccttattccaggctttattgtcattctataactttcctgacagtctcgatcggttccggcttgcgtaggactgccccaaagtgaagtttaatatggtgcaatttgttcaaggagtgaccagtagatttgtaacggaagaatggtatgtctattgtctattttgattagaatgctggcattatacctaatcacagtgattgtccaattacgccgctctttgatcccctccacgtcttccacggcccctgccgcgcgtgctcttttgtctcttctcaaaaccacctctgccctcgcctggtccaccggcactggcatcgcgcttgccaccaggacgaccacgcggcgcagaagaagcacctcgaaccgagctacccccatttccataattgaatcccggaatacccttcaagcccatcttgccgacgatcttcttgtcgatgacaggaggctcgggacatgccataccttggatagccatgtcgttggccatctgaacaagacccgttttgtcgagacgaagttgcttcagaagtcccgatccagcaaagaaaccgatgaaagacgagtaggcgcgttgcttcttctcttcgtcaatcgtgtacatagcttctgcgacagtatctgcatatgaggcagccgcctcgatgatggcgtcggtctgggggtgaggctggatgggcaagtggcgattgtttctcaggaagaaagtctccgcttcggtaagaaggataatggcacggccatcattgccagcacgggctgtacggccgacacggtgaacgtattgttcaccgtttgtcggcaagccaacctggatgaccaagtcgacgttggggaaatccatgccacggccaatgacgtcggacgcaaagaggattccagcggcagcttccttgaactgagcggtagtcttggtgcgagcgctctgactgagtcgggaatggatctcaaacacactcaacttcgtcaagccccgagaaaaggcggccgcgaagagactgaccatgtttgccgtgacgccaaaaacgataatcttcgaactgttcttcgtttccaactggagaacggaggcaagagtggtaaaagaatctgccacagacggcatcagtacatgatactgggggactctctcatgcgttggggtttcgttttcatcaatagtagaaatgctactgtagcctggcttgagcacaacactgaccacatccctgactttggggggaagagtggcagagaagcacattccctgccatccggcgctcttgggaggaatgtgtctgataatgtgcttcacatcagctaggaagccactctcgagcatcgtatcagcctcgtccaggatcagggtcttgatgttagacagcttgatggccgcctcaggctcggacaggtaatctttcaaccgtcctggagttgctacaagaacagagggggcctctctcatgaagcgcgagaaagcagaagcccgagcggttccaccaacagcaatgtcgcacttcagaggtactgccatttgcgatgtcagttgatcacatgacttggcaatctgctgggccagttcacgcgtaggggtaacgatcaagacagcgacctggcctctgggcggtgccatagagccattaagaaggcagtgcaatgtgggcagcaggaaagccagcgttttgccggtaccagtcttagcctggacgaggcagtcactgcgccaatctggcagttcagttagcacccgttgctgaacgggcgtcatatgggtgaaccccaagacattcagagcttggagaagcttagagtccagctttccagccatggactcatacggcaccgtgccgacggtggtcccagaaacctgcatgatggatggttgagtttctatttttatagaataacctgcaattaattgctagaggaaatttttcgacaggtgaaaatattgatgacgcttgggcaaatggccgtttttacctgcaaaaagcaaggcaatggaacagtgagtgagtctgctcccttctcatttcccttttcactttggatatgatggtaatgattctgctggttggtaggtgtgaatcaaccgagtcgtgggtcactttcaatctcgtcgagatttgcctgccaagacaaaacttagtcagcgcgcaatgattggttgccttggacccacggccctggaatggagtgcgggccgcccatctttatcggaaagcgaataggaacttctctttgcgaagcttgtccatggcgctgacgggcatgctgaattttacatgcatggtgaattcagttttcattggtagatgtatcgaaggatcatggaatataagtggaacatcccggacttgaaaagattgctgattgcaaggaagagtcagacacactctcttaacatgtaaaagaagaaggctaatggaattacacggggataggacgccgtacgaaacctgcttttgaaactatagctcatatagacagggctagaccatccgtgtcccctagatactccgaaatgagtactgcagaatgacgggagctaccgcccatatgcatgatgctaatgtcacagactgctacaactagaccaaaaagagaattccctcgggtagtggtgtgcctcgatctaccgacatagtgtccaatttcagactacgaaggatactacgctgaatggcttgatgcactccaaatgaccagtacattggtaccaaacaactacctgtttcacatatcatacgactgctcagtatttacatgcacaatcgttcaatccacacatccaccgcttactgaacagtgatggacgaagatccactgctctggtaaccctcggtagccacgatctggtagttgtgagtacccaggttcattcccagcttagcccaagcattgaagtggttggaggtggtaacagttccgccaactctcttgttctggcggacggaccagtactgagtgaaggtagcggttccctgaatggaagcagcattggtacgggtagccgtgtagatatcgtaaacggatccgtccgaggtgacggtgcccttgtatgtgcctccactgccggggttgtagtcgccgtaggactcgacgatgtagtactcgatcagggggtcagtggtccagccatagacggagagatagccgttgccgctaggggtgaaggtgccgctgtaggtgatgtccctggagatgatgtgagtaatcgttttattggatcctttaaagagatagtgtgaggatgattaacttactgcgcacttccggggttccagccctttccaccgacaaagttgcccacgttggaccactcaacagtgtaggcaccagcatctccgttggtgtaggtcacgtcgccaccgccgtcggtccagaaggagtagtagaagccgttgttctcgccggtcgagctcggggtcgagcgctcagagagcatgtgcaaggcatccgaacgctgggcgacagagtcgtggggaacagccagagcagccttagccgcggcaaagcagaggagaaggttcttggtgagcatgattgttgattgatgatatagcttggaagatgattcacagaggctgggagtcagaagagaaggtctgcagagacggaggagacgttcctgatatatacccatgattctgcaggagtatttagcctttattaagaagggaccctgccgagaccctgcccaggcgctaaatgtgaacccctgttgtacctgaaacgtccactgtgatgggttttagcctagtcggtggagcgtccgtgagcgattgggaatgtcggattgatctcccgaatcagcctaaatcgccttccaaggtgctgcaggtgtcctggattattatgtctgttcgaataggcagtggagcttgaagggtatagacttgcttaggtgaacactgcaatccgcctgtagactataagctgactccattgttgtgctaaaaggcttcattatctattacgtaagacccatagttttggctatcacccaaacatcgagagcgctgtatactacttatcagtggaggtgccaatttgagctacttcgcatgaaactgttagtttgtatgaaaaaaggtgggggagaagcgtgtacagtaccggtcctatgacggtcaaatggaaaaggctaggcgccaaacactatcctgatattagcctgtggcttaaaaagatccgattgctcaggtaactgccctgtagcataggttgccaatagttgacatcttattttgaatataggcgacatactttgccgtgtagaaacaatgccacgcttctcgtcggtagtattatccgagggcttacgcagtgtagtatgatgaaaatatctatcattgagtgctgctaagtctgtaggcagctgagcaatagcgaacatcaaatgcatcattgtgatgcaaaaaacagcagcgacgatcaaaatatataagccaacccgtcatggcaaaatggaaaacaacaggctagtaataaaacaggctaacatcgagcatcacgttgatgaaagtattatagcaagcaaatccatctcatcatataaagctctatcacctcagcaatagtcatttgtatcgtattctggataaatgtgatcgaggctgcaaactgaattgccccccagatagaacgaggtaactatgatccaatcatcagtatgggtcacaacactcataatgacaacatcaacatgtaaagaaactcacgatcaacaggcagattgctgcttgggtttttgatcacgacctggctttcttcggccgaagtcaggctattctcgcatttcagctgctctgtgccgtaagtggttgagtttccccccaaccatacgtcgacgtgccaaatatggctcttccaatcttttgtgcactgttcgcaatagtcttcgttgatcagatatttctgtaggtatggtgagtagacgacctcgcatctgtcgaattcgccaggcgccgtggcgaaagtcagcggattctcgtgggtgccgataccgccagcagccatgccgcgaccacagtcttcggagatatctgaacccggagggtcattgtcgggatatccatagaaggtgtaagatactttgctgacaacatggcattccccatcctgggactggcttcctccctgtacgggctgtgtgtcagttacattgacaactccatttggccgctgagagtcctccccattagaagtagcacttggctgatgtggaacatcaccggtcggagtggcacccgtggtatgagtgccagttccattttgaacaccgcctccgttgtaagtgcttccatcgggatccaaggaatgggtgtcgtttccttgagtagtacttactccggtattatggttgcctccgtcgtggttattgtcgtgcttaagccttttagggagcaagactgagagacagacaactgcaacaattatagcgacgagggaaatggttccgagaaggatcgacaccaggtatttgcgtttgtatcttggacctttggttggctgcacattatttggagttgggagatagctggcagtttgatcggaagacattattaggcgtagatacgggaacgtagaaatttatttgtagtaaatcaagagcgtgtggtttgattgcagggtagacggtttgtgttgtggtggtttggaagagaacaaagagaaaaggggcttaaaaactcaggaacaacatattctcgataaactcatcgctgcgtctgcaggttgagtcacagaccggggtcagccacggtttagatctcaaccgtgagcaaacaccggggtaacccatgatgcgctacataaacagcaagtatgagtgtggctatgcaacatagatgcctgggaaaacagcccgtaataactgcgtagccgacgtgataaggttgagagaagaacattgtatcgccctttgaagtcgccgatatattgattgccaatatcctttccgtaaaggctccagttcagtattgttggatactggctgtcttcgactggtcggactatgttagaatatagatgaggacgccatcacgcaacttcaatgatacatcgctgacatgcaggatgtcggccaggggcctagcaccctcacgccgcattgatcccttctgaagtacttcagccccgggtttgtaaccagtgtatctgcatctaggcgtctcggcataaggcgcggcgtccgcgtggtgagcgacatacatcattcgaattaataacgacagaatagcgtaatagatatcccatacggtttgccacactatttctgcgatacatcttgctggtaaacattggttttatcgaggaagcatgtccgctatttgattatcgaagaactgagatagatccctccagactccatgctaagacatcctgactttaaaaacccagccttatccacgtggttaagtatttgtagagaggaataaggcttatggacgaggatattcagagataagctaagttcactgaatatccgtgctcatcattgcgtcttcgctataaacaggatcagccaggttcaagaaccaaatttaagcgctgtaccaacctagtatccatatcatcatcttcattaagcgagagatatatggtcgactggctgggtcccatccccccgggttgtccagcagcggcatttcgatagctgaccaagtcgccgcgtgcaatggccaggatagaagctgtaccataatccagtgggtgatagaccgcaagcagaacaccccgcatagtaggaggaatggctggattgtagtggtagatcgcgtaggtcaagctatctatgttctcaatagctctctgaaactgttcggctcggttctggtactcttctgtacacgggaaatatagccacgtcgtactaaactgccactgagaaacgtcaggatcatcagccatattgagtctcttaaagacggatattagggaggttgtaagagccagcgcgcgtctgaggaaatagagaagtcaaaagaagtgaggagttgacagaggtgaggttggaagaggatgccgtatttatatttctacctcctagcagtcactcatctctggaagtcgaattcaatatgattattcctctggccggtaaaacggcctgccgaacatatgatagccattcctacatatgtaagtttatgaatgcagatgtctgcgtatcttgaaattcacaaagggaggttgcctcagtgaagactcgtggcaacgctcatagatccgggcccagggcccgtttttttcctaaagaggtgttagtcaatttacgacaaggaaatgagagaagagtaactgtgaaacacctcatatctgactgtgtgggtgacatcatgcgatggccgtcaagagaaatgagccacagcaattaggcattcaggagtcctcgaatccaaggcgtataccatccacgaaagccctaagtatgagcactcacagtttggctcagataaggtgcactgatgctcggagatactggtcctccgaggtggagcccgaagggcatgtacgtgaaaacacgcactggcaaggttgcagcgtgactggaagacaagaaagcagtactcttataatctggatattggaacatgggctatattctcgtatagaccagcttggtcgtaattcaataagaacccctgctttagtggtcagctatatggggttaagctcagggagagatcgtattgggctgtttaaatggctccactaactctaaatcgtttttcaagctggataagcatttaaggttcaaactgatattatcgaggtgggtataatggtctatcccatctgtgtgatcaactactaatcttctgccttatgactctctttcaatcggtggggtaattggatgcaccacacaagagttgccatcatttcttgtcgcgacgcgcgtcaacttcatcgaatcagacggcccgacaggcaacagatagccactagtactccatagccatcacctcatcaatcagcacgaaggcgtcaccaccaagcttgatcggagtccactgagctgtggtgatgtatcgctagagaaatgtccgtgcgtcggctctcgcctacgataacaatttgggaccgtcgaaccagcgagcttctccccgtctagttggttgttggcaatcatatgaataacatgggctgatataaaagtattcctgccagtttatatccagcgaaattgcgcactcacagggcactcagcacgcaattgacgctaatagcatgtcaccatcagctcatcctggccgctcagcgaaggccatgggaagtcatggggagccccgatcgaagagatcacttatatctcaggctgagcctgtctttagtcgtcctgaaatgttccggagatttacttctgcatccatccacacataagccaacagcaccgttaccatggcgctttggaagtttcccaagctcaactccacgctagggacgctgagggcctatcacttggccgcaatcatattgtgagaggtgcccctgtttcctacttcttttacgtgatcactaacctcgagaccctttcagcgtctcttcgttcttggcaggttatgactccggcattgcgggcggaattttgagctacaagaccttcgaggatgactttcgttatactagcgcccacgagtctaaggtctcttccttaacggtcggcctggagcagctggggtccttcgtcgcatccctctttgcttattatctcaccgacaagtttgggcgcaaatgggttatcatcggctcaactgctgtattctgcatcggagtgatcattcaggtcatcaatacccactcgctcggtgcatggtatgcaggccgcattatcgctggtatcggtatgggaggtcaaagtgttgttgttcccatgtactccgccgagatgacgccgaaggaaatcagagggcgatgcggttccttctatcaatggctatacacatggggtatccttgcggcttattggatagactatgtacgtgtactggacagccgttacgccaggttattgactgacattgaaacgcatagggcgtcgcagcgagtgcaagtatatcgaaaacatcacgcgaatggcagatccccgtgggtctccagctggtctcgggaggaatcatggtaatcggagcatgtacactgcctgagtccgtacgttggctactaagccaaaacagagccgacgaagcttggaagtccttgacctggattcgcggtgacgaaggggagaaaaccatcgaagagtttaaagagacacagctcggcttgaaggcagaaaaggcagcgaaagagaacttttctcttcgtgagctgtgggaaccggctaatcgcctgcgtttctgcgtcgggcctatgctttttgtttttcaaaacgcaacgggaagcagtgcccttgctgtcttcgcaccagaatacttcaagctccttgtcggaagcggaggtaaccgtgatcttctgctcactggtctctttggtgctgtgaagttcattgcttgcacattcttcattctcttcctcgcagaacgattcggccgtcggattctgctcacaggcggatcagtcttcatggcgatttgtatgttgattaccgctttgattgtcaagtgtatcccgaccgagtcgaatacgtcagtcacatctgccggccgagccacggtcgccatgctctacttggatatcatggtaggcaactttcgtcttatagtcaagtgactcactgtctaacgtgctacactaggtttataattgctcatggggtccggtcccttgggcatatgtgccggagattttccccacgcgcattcgagccctgggactagcatgcagtatgttggctcactgggcgacatcattctgtttttcctttgctagtccctacatgattgacaacatcggagcaaacaccttcctgttgttcatggctttcgatattgccgctgcactcttctgctttgtctttgtccgtgaaactcgtggtcagaatctggaggttgccgcagggaccgagtgggacgtggttgaaaagtccgctgatgatctggcggcaagcgagaaaggcgaagtcgacattgataaaccttcagagattggagtggcacctgcggctggcaagcaactggaggtcgttgcggtgcacgatacttacggctcgaattttaagcggcggtcgtaaactaaccacatataattatcgatccgatccgataaatttatttacggagggctggtcatatgtcgtgaagggatgtgttgcaaacattttgtctgttgacagtataaatatacaagacgtgatcattgccatgcatttcgatccgctcttataattgctaggatataataggacttaccatttccttagaattttcttaattcaccagatgccattgggtttgatatatccaggcctctgaccacccaccacgacttgcccacaaaaggcccatcagggaatgaactcttcaaacaaaaatagagaaattttagatttatacttagagtagaaaagtcaaaaactgtccatcatcacttcctgattgcttcgcgtactgtagccattgaccctgtgaagtaagtactaaagtacagtcgtgaggctcggggtgattctcacgtggtccattccactctctagcgactgactgtccaactcaatctttgccgtcaacttcgccttccactccatgactgttgccttactattaaccacagtcatttcaggaggctacatccgctccatataatgctacgcagtcatccttggtcaagatcaagttttggctcaatgttgtcagggcaaatttaagatgcgacaatggggatgtttcgatttctttgaaggacttgctggaggtgtaaccacagcggtgagtacaagcatgcctgtctccctatattctttgtaatataaccccctgttgcaaagcctatctgatttttccgtcgaatcactatccagccaattattctgacgatcgtgactccatagagcatcccaggatagtcgaaagatacagtagcatcatatgtcatgagtcattgacgacagttgacatatatcagtcttagtcgtatttgattcatgccgggatcatctaaacttcaggccaagaaagcttaaagaaccaatgactttctagaagggtagccccgaaagcgcatacaccagaggcagatgatccatgatcgaaaagacgctacgcatttatcgcaaccccacgggttgctataagcaaaggaataagatttggtattttccagactgatcggaagatcgctcaactcgtggggtgcaaatctagttcgtcgatgatggttcgttaggatgcaggagaagctgtggcttaaaacccattggaggtcgtagtagagggctacttggcagctggcgatcgaaaggctactaaacatattctaaggttaaggatacgaaaccccggctaagccctttccccgtgagctacactttgagtattgtttacgactttacgttccattttcacattttttttcccccatcagcagactcatctttcccccacttcgccatcttaaaacgctcttgatcacctaatcttacgaccaggtgcctacagtggcgtctgggggcctaaacaacgtcgaactaggatatgaccccggtcaagggtcatttgcacagtcaactccttctgaaagaccatcgcaaagtggtgccgcatcaagagccgggcaatttgttagagttcggccgctgccgacggccgacagccgatgaaggcccagactcgcccgcacggcccgtgcccgactgtgcgatacggtgattggatacattgctcgcttcttttcacctcaattgcgagatctggagcaggaatcgtgttcataaccccgaagccacagtgcgacacgttgacaaccacgctaagctcaggcacgtgaggggtgacgccgccacgtggatctggccggttcctcttttgttcgccatgccgttgattgttcccagatttccccagatccccaaccaatcccccgtagggtaacgcaacgggacatttggggttgcagtaggaccctttgctgacatgcatcttcctcacatcgtgctctcgttcttttgggactcatgtccttgttctcctcctgtaagccacgtgctgcttaccacttccgaatgcgtctctttggtcaaaggaggccactaccagcgaagctaacggctcccgtatactatttccggggtaataccccgggtctactgagcccatggggtgagggtgtgtcacaggcggctaaagactagccggaaattttttttggtggcgttttccaccgtcctcgactggttctttcgctgggaaattgggagtcaggaccatcgcgctgaccctcgccagtggatgaacgctacgagtaagccagcatcttatcccgacaattgcccggaatggcttcttggctgttgggcctcagttcgtagccgagccctaaccaaacgccacaaaaatgctttgcgccagatgctgaggttcggggagagacggcgtgcttataatacacggcctccctcgtgttgctgtcgcttggcgaggcttgacttgactgttctcccgtttccctgcgtgattctgcctctgtgtaactctcttggcatctgaggtgaaagcttgtcaccatggtggtcagtcaatcagtcgttggtcgtaccaacgccgagaagcctcatggcttgatgggcatgctcaagaatccctatgtttttatgacatgtgcgttcgcctccctgggttgtatcatgtatggatatgatcagggtgtcatgagccccgtcctggtcatggaaaactttgagaaccattttccgtacttcatgggctcaaccgttcagggttggctggtcgcttctttggaactgggtgcctgggctggtgcactgttcaatggttaccttgcggatcgcatttctcgcaagtactctatgatggtggctgtggtgattttcactctgggctctagtcttcaggctggcgcccagaagccgtcgtacttctttgctggtcgtatcgttggcggtatcggcattggaatgttcagtcaggtaagctttctccctttaatattttttctcttgtgctaattcggtgtaggttattccactctatcaagctgagattgcgcctccagagctgagaggctcgctggtgtctctgcaacaactgtctatcaccatcggcacatcaatcgccttctggctggattatggtgcgcatttccttcattctccttccctaatacaccgttactaaccatgaatcaggaatgcaatacgtcggcggcactacctgcaaccccgaaggcatcgctaacccctacctcgccgatggcacctacaacgctgcgcagaaccacggacacacttgcttgggacagaagaccatcgcgtggcgcctgcccctcgccctgcagattttgtttgcctggatcctgttcttcggaatgttcttcttccccttctctcctcgctggctgatgtccaagcaccgcgaagaagaagcgacggccgcactctccaagctcagaagactgccgcccaatgatccccttttgcgcgctgagatcctcgaaatcaaggctgctgttctttttgatgaggaatctgaggctgaagccatccgtcagggtggcaagcttgctccctggaagatgctttttgctccgaacatgttcaagcgtcttgttctgggctgtggtatgtctatctcaccctttttctccctcgtctaccttttctaacaatagtattcgtggacaggagccatgatcttccaacaattcaccggaatcaatgctgtcctttactacgcccctcagatcttctcatctttcggtttctcctccactaaacaaaccctcctggccaccggtgtcaccggtatcctgcagatcatcttcaccctgcctgcggtgctcctgctcgataaatttggtcgtaagaccttcctgattaccggagccgtcggcatgttctgctgtcacattgtggtcgccatcgtggagggtctgtacgaagataactggaacctgaacatgggtctggataagccccagggatgggtcgcaatcgcgttcatctggctgtttgctgtcaacttcgcctactcttggggtacgtacataacccccctcccttccactgcctccatcataacccaatactaaccactatggaaatttaggtcccgtcacatgggtccttgcccaggaaatcttccccaacagcactcgctcccgcggtgtctccatcgtcgcctcgaccaactggatgttcaacttcgtcattggtctgaccaccaaggacatgctgaagtccatgaagtacggtacttatatcttctttgccatcttcagtgctctgggtggacttttcatctggaagttcgcccccgaaactaaggataagacgctcgaggaactggatatcttcttcggtggcggtatggatagtattgccgaggcggatcgtcagcgcatggagagaatctatgatagtctgggattgagtggtgttaaggaggtcggcgatttggtggtggagaaggagaagggagagatcacgggtgaggttgtggagatgtcgtagattgagttggctgcttacggcagacaatgagggggtacggtgaaagggagtgtttgcagttgaggtgtgtggtgtgtgaagtctttgtctgtggtaatgtgtttttaatgtgttgatggtttacgtgactgataacactgaaattgtgtagctattttggtaatgataattgcttatatgcacattatctctttctcctaggatatcacatgaagtatatattaacaccgaactcccacaatagtatagtatcctattctgtacaaagataccaaatgggctggacaaaccccaatatgttactagataactatactaactactatattacacccccgaatcaatctcattcacgaaaccacgattactaaaagccgtccaatcccgacaagtctgagccatagactccgggatcggaagtcgttcaatgtcatctggccgttcctgttccgcaagaaatcaaatccacattagcatccaccccaacagagagcacgaaactaagaaaggaaggaaggaaggaggggaaacaacttacaaccacattcaaaagcaacccgacactaacatgccaagacatatgacaatgaagaggccaaacgccgggattattcgcctgccattcgagcaccacatacgcgggactatcctccgtgcccggctggatgatgtgggtatcacgacgctgaggattcttcggattagtgacgactccatcccaggtccctcttccctgggctagcacccagtaattgtgaccgtggagatgaagcgggtgctgcatggagaagagattgtagatgatgagacggacggaggagttcgagccgaagttgtaaacgttcaggtctgggtccgggtctgagaagttgccggctttgcctaggaggaggagcggggtgttgtagtctgagcggaaggtgcnagttgttgacgtagaataaggtgtgnccggtagcgttttcgccnagggtgatttccatggtctgggtggtggcgggggtggaggggggtgtttgaaggtagtaggggatggtgaggttgaggggatcgttggcacagttgttgctcgaccaggttgtggtggtcgtggtggttggccaggttgctgtgtcggcgtcttcgtagtagatggcggctttgacggtggggatgctggccgtggcattgaggcaggtcatgtcgatggaggcgcgcatccagtatgactcggttgggttgccggtgncggttacgatgatgtcggtgcgttggccgacgccgagggtgacgacgtcggtggtgtagggttgtacggggacgaagtcgttggcgatcacggtcatgttgtggccatcgatggtgaacttctggttcgcgttggacccggtgttcatgagtcggagacggtgggttttgccagagtgaaagttgaagcgggctaggctggacgcggggctgcaggtggtagtggagctgctgttgcagttgtaggcaccgcggccgttgatcaggttgttgtcgacgttagggaagacgggggggatggagaagatgttttccaagacttcgaagtagcttaagtggctgtagtcggagataatgacggggcctaggtcgtagtcgtagctggcttcgggctggacagggccgtgaatgatcatgggcccgtatgcgccatcggtgtattgggcgctgtaatgggaatggtaccagctggtgccgtactgatctgcttggaatgtatacgtgaagcttccaccgggggcgattggacactgggtgatgccgggaactccgtcttcccagggagacttggcttgggtaagtccatgccagtgcagggtcaagccttctgcagtttcggttgtgatcatgttgttgactgtgaccgagatcatgtcgccccagtttgcttcgattaacgggccagggaattgcccgttgatgaggatgccgctcttctggtagccatccggggcggtgatgtcccgcgtgatggtgaagttgtagtgacgagtaacacctgtgtcagggggccctcctgagggagagatatccttccatggagggtgttcgaggttggaatgttgatattggttgttgttgctaccagacttcaagaaagggtccagatggtatgttggcaaaaggccgtaaggagaaagacctaaataagaggagtctaatcagcgagaggaaaacgaaacagacatgtagaggaataccatcagggagcaacgactccaaggggttgaaggaggcaaccgttcccaaaagtaggaaccaagactgccaatagaccatgacgatacgctattgtgttgtttccagatggctgcatattcggtcgagccccggcttaggtataagtagattttactcctgtatactaaaccagaatcctgcgaggaaaaggtttaattttagacttgcgaaggatcaatattttacgcccggtttgaggtcaacagttgatctgagtgggaacaagaggcttgcagacggctaaccacgtattcctgtgtatgtagtatgctggcttgttggatatcgtctatactactactgcttcatatatattcagttcacgaacttgaatcctgaatccagatagggatgttttccagaactctacggatctgcatcagcaacgtggtgcagctctgcagagcaacgatgatccttgaatatgagagccaactcgacctccaggtccgagatgaacaggatcatacttgatgcagacttagcgacggcccccaataagtgacccacttgcggataaagatttagaagatctatagttctgtaccccgtagatgttgattctgcatttggcccccacgatgctactgcttactactgtttactactagagactcacccgacccaactgcttgctattttgcatttctaaatgtgtttttaaccttttatttaaccgactttctggggatatacattcattatcacgtggcatgggtccaacagtccgtcaatttgagtggaaataaacctcgattttaaccattccatttttcagtaaatctactctctatgataactcctcagctcacacaccactttgatccaccgccataattaaagtagttcccaacttatcccaaaagatccaccaaatactgggccaaaaacccagccgacttactgccacccacaatatagaagcccatacggaaccaatacagacaactagcaggcttagtcaaatccaccgaataaatcataaccaccaacgaaagcgccgtgccaccacagccaacgagaaagtaaatgcccgacaagccagcaagaacacccacagcaaccatgagcccaaccatgaccacacccagcacggaggcaatgatcttagtggaatgtctataccgcaccgccatggacttcactcccgcttggacatcatgctgcacgtcctggtgtgcgtagatcgtctcataaatgatcgtccagatgaactcaaccatgaacaggcaagccgcaggagcagagaaggggtccacgcccatcccgacagcgggaaggatcatagtcacggagaagggcagacccaggaagacgggggtgaagtccatgaagcgtttacagagggggtagatggcgtggagcacgcccatggcgagactataagcatgacattgggcggggaggtggctcaggatccaggcggtgatggcgacttgagcaagggtgaagatgtggccttgcgtggtggagacggcaccgcgggcaatgggccgacagcgggtccggggcacttggcggtcgaactcttggtcgaggttgtcgttccaggtgcaggcagccccgcggatgaagttggtgacgaaccagaagaagaggaaggatttgaagaaatcaaggggggcgataggtggatcggcgagagtggcccccgcggagaggcccatcagggttggcatgaagaagccgaggaagcccggccggtcaagccgcattagttgcacgtaggggacccaggatgaagggactaatttggcaacgccttggattggcatttcgtttgtgacagggggttgagtctgggctttgaccccctcgtgatgggcggttatggccactttgtgcacggtttgtcgctgggtaagggtttccattatggcagactcagggggtgaaggatgatgataatgaaggatcgggaagctatgataggatagacactatgagctcagggtcaggaaggaaccgagagtggacttaaaggatgaaggatgattgacgatgaactattctgttgtattgtatgggaggattgtggccttatatcccttcgatttcaacgtatattgctcaaacacagtagttctagatacagatatagatccgagaacagatagatacacatgggctgagagattattctgccaagtcgttcccgcgagattgcaagctatactcgccctctagggacaggcagacttgagccatcgcagatgaagcaaagtggacgagtgaagatagtgggctgtgctcatggtggagctccctttttcaattaggctggggcccaaaatatggggccagtaaacaagcgagcctgcagcggttcaccttgagggggtcgtggtgcagaccgaatgcagtaagtgatatgcttgataaatgccttgtcagttatcctgacagtcatcctttgacttttgtggaagtcattcgctgcaaacaaggcagcgtcttgatacagacaaacgtgcatatccaaaagtctgtgaatttcacagcattagatttcgagcccatgggatcaaccgcatcagcggataagtatttaagcatcttcttggcaggtctccatctatcacttgtctagactactggcactccactgcaccaagtgtatgcggctgtaatcaagcgatatgcctgcaggcacaatctgacgtgagaaggaaaaacgtaaatctagaaaagagaaagaatgagtgaaaagaatgaataaatgagagagcagaaaatgctgcgctatttgcagggtaattactgtcacacaatacagcagcttaacaagaggtaataatctcggaaataagttctgtttccagcgaaactaactccagatctcggcttatcagagagcggctatagccccgccgaactaatagaaaggagccctatctccgatttgacatggagttgatacactagtaatatggtggaaattaaagccaacatgtaatttatttcttccactcagttaaactcatagtaccgtgcggcagcatgtatttctgcattatgccgcaacggcttcgataatgctatccttcaaactctccgtatacgtgtgtaccttgttaatcttcagccctgcgctctgtaacagcttgttccactgttcctgagttcgctcccgagcccccaaggccgccatcatgagcatgtctaattgggcctgctgccaatgaacgccaacattgggtaggaccatgtcatcaatcagaatataagagtctggggccatagcatccttgatattctgcaagatctccagacacttgtgatctggccaatcgtggaagatattccgcaaatagtagaatttcgcccctgtccgcctgtcaatgttgtatactacagggtaaggagttggaggaggtcgtacctttgactggctgcggagtgaaaaagtcgtacgccataaactctacgccaggatgctgcgtcgcgttggccgtagtcggggccaggtcctgaacaatcactcggccttcgagttggctgtacttttcccgaaaggaaatggcctgctgaccgaaccctccaccaatatccacgaaaagggctcgctcggcgcttaatccaccggccttttcgagggctgggaagacgtccaaaaatgtgggcatgccaaatcgattggttttcatgtgttcgttaaaaaatgccaaattttccgggtgttgttgcagccatagaaacgccggcaattccgtgttcatgaccttctggaaaggtgtctttacattgtcctgaatatcggggtatccgttctctttcaggaaggctgggagatcttggatggacggcccggcattgttaaagctgcatggcaaggctgtcattaactcaaatcctttgtgagagactcggggaggggggtactacatacaggtggccaacagcagcttggaatccacgctgggaaaatgttttagagatgttcgacgccgtgaaggtatcttgggcaacctcctggactgcgtggtaggaagccaaataacgcagtaaccggcctgttcggttagattaaaccgagacctcccacttgtgagggagtaagtacatacccataaacactggattggctcctgtcctcttactcagctggtccacagtgagggggccatcagcctgatttaagagctcgaatagctttagatcgattgcggtgcggatacaagccaattgcatattctggtgagggaatattgttaactatacttggcgaggaattgcaggtgcggtggcatacgtagaaggtgaagcgctgaacagtatcatctggagtctcgatagaagcatacagtttgctcagtgagtccaagatatccttgcgcgttttctcatcgccagacttggcctgtcttcggacttcttccactagggcctccatggctttccttgttcgctcgtatgttgctgggtttcggagttactggtggctgttcaatattgagaacctatggggtagaatgaggcctgagtagggcaggcttgatactatttaactacagtgaagatcgcactggacgcaaggtgcaaacatcacattgggcatcctggatgctggatttgtgctggaagacaaagagagaacctctaagcggttaatgtcaatgccgcctccagcaaggtacgtttggatttccagggtgcccctgcgacttccctggtagactaaactccaattgtaaaaccaagcatgaatctgtacggtggagtggacttgggggctgcaacagcactgacggcaaacgataatacagacgggataatccgatcgacggggggtggagaccctaagccacggaaagcaatgatgctgagcctttgcagccttgagttggccgctccgctacgcaaaatcccccctaattcatactaatttcttacgggcggagccttagaccacgtctgttcacggctcgcgctccagttgctggtctccagccagcgcagccactggggttgacgaacaacgaaccatattcactgaatgtcggcagacgacgagcagcccgctagtaaattagtgagaaaagcgtacagaagtatcagcagcacgctactgctgctgataatctcagcggtaatattccctcggctatcccgtcctgtgattaatcccttttcggaccaaacatgttcacagcaggtacttctcctcactttggcccccagacaggtacaagattgtacatgagtccgatacagccacagaagtcgatcggactcactaccacaaattgacgaggttgactgcatcttgcagctgcacgtctacgcctgtgggggcgccttgttcatggatgcatgcttatatgcgtgaaaacccctcctttcgctatgatgacaagccgagcccatatcagtcgcccctaccagccccggtcgcgaggcaggaagaaaagcattcagcatgagcgcaccaccggctggcggtgatcagaatcgcggccctgctctggtggccatttattgggccgaggcatctttcgccattttggcggtcgccctgcgactctatggccggaaactgatcaatggctttggcgctgatgactatatgatggtctttaccctggtatgcacaccatttccttcctatagcccttgtcgcactatactaatatgtctcctcttccctccttcagatcctattcatcactctggctgctttcgtgacctaccttgccgaccaaggaggttgccgacatctctactatttgacaaccgatcaacaactcttagtcgtgaagttcaactggatcactcaagtatggggtatctttggcttcgcgactggcaagagctcggtggccctacagattatgcggattctgggcccgaatgataactggatgaaatggctcttatggttcctaatggtctctaccaccatcttctgcggcttggactgcctcttcggcttcgtgcagtgtgatcctccccgcgcactatgggagccttggattccccatacctgctggaacacgaatgtacaggcgaactttgcgattttcatatcaggtatgttgccgataatgtcccaggaggttgtcgtcgtccgtaccattggactatttggctgatagcgctgcctacagcatggaatgtgctggtagaccttgtcctcgctgctctccccatcccgattatctggcggacgagtcttaccctcaagcagcggattgccacctgtacccttcttgggcttggaccattgttagtattctatagtttgatctctttctccttgatagatcatactaacttctttgttctagagctgcagcctttggccttgtcaaaatccaatacctcgctggattgaaagagcgttctgacctgacctgtacacctccctcccccttttcctaacctacctctttctctcggtagtcactgactctgactcctcacagggcaaacttacaacctgtatgtctggtccggatccgaactcttcgtgatcatcatctgcggctgcgtgccgccgatgcgtcctatattcacgaacctgttcggacgcaagagccagtttacaggctactacgagtcctcttctggatataagcgtcgacataattacaaactcagcactctgggatcatcgcagccggtccagagtcaggatgaggataccgaagcgctgcattctcgggtggaggggactggatcacatctgcctcagtcgcgttttagtgagaatgcgatttatcgggaggttaatatatcgatagagaatggtcctaagtgataacatacatattataaatgcttaatgatattggtacattgttatttctgttgtggttgttgatatccttcgtggtttataatatcctttgtctaagttacttttcttctagtaggatatgatattgatactatatattacacatataatcccactctctattaactatctaatatatatgtaggggaatactaacgctgagtataagaatgccatttccaaaaaataaatcaaaataaataagtaaataaataagtaaataaataagtaaataaataaaaacttacaacagcataagtatggcggtggctaccatatattctctcgtgagtactctgtcctctagttttatctcttttgcaattacttatctgtactaccttgactgtttgcatatatgtaattctttcaacaattttcagtagatttactctatttaaaagatctctttatatcaagagctgagcaatactcaatccaatctgattagacctcgaaacgttcacataaagcttgcagaatacaagctcttgagaaccagtggaagtagaaaagaagatcttcttagcaccttgctggcttgagggaagtgagggtgagtaagcgggtaaacatctaactacatgtgtattgtcccatgacgctctcctgggcaaatggtgcccacccgctgtattgactacaaccttgccgctaggattactggttccgacaagagatggaggaaacaatcgtcgagttccgcatcactccgagaaagagaaacaggcgcgagagagatggagtattatgaggaggaagaacggctggagagagaggaagtagagcgccttttagggagagccaatacggcgaaattgacctaacacactgatttgccttccagatcaaggtcatatctctctctgtaaaaggtctgagttgcggcgattacgatcctcacgatgcgggcactttattggcctgatcgcctattttggcgagcttggctggtcgtggttcctccatctggctcccaagtgatccattgtttcgtggccgaaccttacccagtttgatatccgtttgctctcggagcacgtcatagatgaactgaaattgcttcacgttgtaaaccatcatcatgcgttgctcgcgcatctggttaaccgtgtcaaagacagggtcggcttcgggatcggctagctgcagcaactggcccgattcaagctcttggaggagatgctcaagggcgatgaaagttcccgtgcggccgactcctgagctgcagtggaccacacgtggattctgaggccccgatttggaagctgataatctgatcaattcaaggagcgcctcgcaatcgtcgccttcgggcttggaatattctggccagcctgcaaagagaaaatgccacacgattttcgtctctgagccgatagttaactcgagcttgcgaatctccgagcgagacttgacatcaaacgttgactctaacaaggtaattttgccagtattgtcggggggttcctcctggctgtttggatcagtcactaatgcacctgactcctgagcagtagtgtttctgtttgactcctttggagattcctcgttgacagtcacctcagcaacagggtaaccaacaatggtggatccagaagttccttccgcctctgctgtctcaattttctcggccgcgggagtcgaagtcatctccgtggtggcctcggatacttcttcgaaggcagtgtcctcggcgtcacgctggtcaacagcagcaggctcagcgggggtgacctctttagcctgtattgtttccgccttcccctctggaaatgggttttcagtagacttctcacccaggaacatcgaagcctggtccaggtgcagaggaaagtactgtgcacatttttcccgtccagcctcgaaggtctgcgtcaacatgacaatgacagccacatctttgctttcatggaaaaccatatgccaaaagtgcgagagatagccaattataggggcctgccgagtgacaaagaggtcatttttagcattgcgagaaagaggcatttaaatgctcgcctagagcaagctcatcaagcatgccaatgaatttgccaacgtacctgcgtcgcaatgtatgtcctctcctcttgcgtgaccgagtccctcagtatgatcggtgaggcgttgataaaatcacattcgccctcgggcacccgcagatgaatgcgggagttggcccatgcctgtacattgtcatatcgattgcgggcgctgacttcgggatcttgttcaagggcgtagggatgggcaggatcgttggtcagcatgccttcattcagacgcaccctttcctcccattcgagttcctcaaacttgtcgtaaatctctacaaatcaggaatcgatcagtcaactggcttcccatatgtgcgaggcgctcccctgcctcgtttccccttattcctctaatgcgacatcggtcttatgttctccgctgcctcacttacctgagtctgattggcacagaaacggcgggacatcatccgtaatctcatcaaacaaccttgggtttccctcctcgtcaaacatctcaacaatctttagactgccttctctagctgtgtcttgtagtacacccgcgctgtcttcgctgctcctgtccagctcgggtgccgtagcctgttccttctcggagctctgccccctgcaagacatgatatcagtagaagtacagtgcaataatttagcactgaaggtcatacgtatctaagtcattactacccctggaaaatcatcagtaccagtaccctagtttcagtttgattacatacacaacggcgccttctgtggtcaccttcgcttgcattccagattgagcgatgaagtggcgaagtgtcaaatccagtgatggatcgtcctgtggtttttggactttctgccacaaggcataaatcagctcctcatctgcatctggaatcacctcacctgatatggaggcgagatattcagtctcatcgtcatctctaaattccgagtgtaatcgttccggaagagatccgatactggctggaagcgaacttgagtccctgcttgatccggaccatgctgattgcgaccgcccgtcatctatatgtcctgcaagagagatttgtgccagcgaaataaggtggtttgcgacatgatttatcatatccttcggctttagttctagtttctgcactgtaggacagaaagggcattcccgtatgatgatatcgtcgggtagtttttgatagcatgcggtcgcgatatcatcgatatcgtcgtcgtcgaattggtcttcatggtattgatgcaaatgctccctgaagccagactctgactgaaagaagaatgtcgtatcgtgtgtgctatcgacacaggtccaaccactgacagggtgctggttcttcatgtgactcaaccagtccttgcccgactcaaaaagagaatttggggtaggacaaggctccaggacacaaatatatggcatgaggtcctgaataatgtggtgcctttcgcaacggttagctagtgattctgctctttgggctaggagagcacccacttccaccttcttccgctcagctcttctttagaacaagccagaaagcagtatggacactctgactccttgcggttgccagacacgtttggtggtggagggatatccgcatcattacaatccacatcataggtctgctgttcatgggccgactttacagagtaagccttaggaattcgatcgggttgagctgttgtcgctgtcatgatagacgggccaggccttcgcataggtgatgattgctgtctcgcagctccttgtgccttcgacgtaagggaacccgtaacgctggctgtggccctgagtgctgaccttggagtggattgatggctctggtcagcccctgatattggagcgtttgtggccttcttggctttcaggtaagaaaaatattgctggcgtaaacagacggtattgataatgcgttcacgcaggccattgctcgacttggattccttcatgcggaactctatgagcgtctttacaccgtttctaaacgcttctgtcagatttacgccattctcatcaaactcaacatagttcccaactttgacgtatctgcggagaattcccgagcgacggatggcgcgagacaagcggaaaaggccatccagcgtctcactgacagcatgaaggggaagttcatatagcattccagtaggaatggtggaattgaatggaaaattagactggtctgggatatattgatattaaaaagacatcgaatcaggatgaagctctaggcatatgacatactgataaggtcagctttcaagtcatccagcaactcggccatcgtcgattgcagtaatggggcattccgcaatctccagtccatcgaagctcgacctggggtcagtatgaaattatttgctgcccacaggttgaaccggaagatttcgttttccatgtcctgcttgagcagctcgtccccgtccagtgtcctcgcatacttgtcgaataattgggcgcattcggcagccctggatgcaattgccattgtgactgagtgatttaatgtcgtatattggcggcgtcgctcggtatattgctccagattttgagaggaataagatcaaactaatgggggaagggagtgggggatgtcgtctgccaatatgagagtcaggaagcacggaccaattgggcgtctactcgtcaaagcgctaaacccgaaagggcaaagaatccttttagatgaggggttaaagaggccaggatctttgcagtttagttaacgttaacagtcacctgtaaagctgacaaatcctaagtgttcactgacaacaacacactacactattcagcgacattcgctaaggtatacctcccacaatggctcatcgctcagcagacatcgacctggtctgtttagtctcagatgtcattacagcgttaggggggaccttcagacactccccccgattgtaccgcgacctgaaggtatcactggctataatggctctggagatacacaatgtagatatttctgtggccctctccgaagagccaaacttacggcggacattcgagaacatggcggaagcgttggacagggctttccgcaaggacttcgtgaacacaaagtatcagcagttaaaggcaggagaagaaacgcaacctcctaggctctccaagtggtggcctcggttgttcaccagttggaccgacagcccgaaagtgtatatgaagaattggacacaaacttcttacccatatcttggactggtgtctgagcttcttcaaagttctttacaacgagagctacggataggagagctcataattgatgattatcgagttattcgagatctgaccaacttggccaataagctggtagaacaactcgatcgcggtcaatcttttgatgatgacgaagacttcactgaaaaggcacagccgaacccgtcgatcagcgaggcggccattcgtggtgagaccagcattcactatctgtcgcagaatctctaccacacactgcacgagaattggccttgtcaattggaagggcatgagcatggcagaaaactaggccattgtgtggaagcaaaattctgccttgacccccagtggagctctcgagatccggatccgtcgcgcgatagctttttcatcctgttggcgggttcagatatcattcaggagtgccgggttcgttggcttcctaccgagttcgatagcccttgccttctcagaaaagtcagtagctaacacaaatccagtgttatgattgaaacgaacacccttgcgtgccttgtagatcacgaagcctcgaaagacgtctgcttacaactggcgaaggacgacaataaccgactttggggtctggaattagggcagccacttgaggtcctacagctggcggaagagtgtactggaagatctcttgaaagccttcgaaagttgctggagattgtgaagcccacatatgcagcaaagcgagttctggggctgacattagcgcggtctcttctgcaccttctggaagggccatgggtcagttcgtatctatccatcgatgatatcttcatcttctgcaaagtacagaatggctacccatacccattgtttgacaaagtattcctctcgacggcttttaagacaattgatagcgaatgcggtccccaggctagccgacggcctccttacagtattcacccgtttccgacaatccttgccctcggaatcgcgctagccgaaatggagctaggagacgagcttcatgacatctacggtcagccatctttcgctggactgaggaacaagccatctaggcttgcaaaaaagctgtgggaagagtgtgagcgtcggttccatttggggactggtttaatgcggaccgtcaggttttgtacggatcaaacgtcattccttcgcttcgccgacatgggcaaagaaactgttttcacggattcggaatttgtggatgtctattgcaagaatgctatcagaccgttagaagaagaccttgtgaatggggcaaagtggacgtgggatgaagtaaataggctccagcgccgcgaccttgtcgatcagggagtctgcaaaatcatcaagttgaaaattgaccccccttcaaatgaaatcagtgaacgaatgcggaatacagaaccaaagtggagcaaaccaccaggacatgtgtcaagcttagtcacaataccagaggccaatggttccgtggaatattcccagcagaatctctctagcgacgaaaccctgcgtatcaatgacaaggcaagtcattgtcaaccatccgacacgcaagagcctgtgagaccgaagactagagatggcttcgacgtagccatcatttgtgcactccctatagaagccgatgcagttttgtctgctttcgaccatcattgggacaaagaattgtacggcaaggcaacgaatgatcccaacttttactctgtgggcgttatgcgtggtcgaaatgttgttttggttcatcctccacgctctggcaaagcacctgccgccaacgtcgctaccgcgtgtgccatgagttttaccaaggtgacgctggctctcattgttggggtgtgcgggggcgttccattcaaacacaacaaggaggagatcctacttggtgatgttgtgattagcaaaggagtcatacaatatgatcatggacgacagtactcggacggatttaaacggaagattgaaatggaagcagcattaggtagaccgaacccacaaattggctcggttttggcggcactagaaactcagtttcaccgagagaacgcccagcataagataaccgccttcctcgacaacttggacgacgatgtgacatcctatcctggacatgtggaagataggttgttcccatcatggtatcgtcataaacaccacaatcaccaggtatgtcgagtgtgtgcagattgctggaataatgacgactccgtctgcgacattgccccggaattgaactgtcaagcgaccggctgcgaggatatacgcatcgtaaaacgacataggcaaaatcaaaggaaccaaccgtttgttcatgtcggtctcatagcatctggagatagcgttctcaagtccgctacacatcgggaccagattgcagagaacgagaatgtcattgcatttgagatggaaggagcaggtgcttgggatgccctaccttgtgttgttattaagggagtctgtgactacgctgatagtcataagaataaattatggcagaaatatgcagcaattactgcggcggcttgtgctagggaattcatccagcactggtagtggcgccggaatcaacaggctggtcaatctgaaacagcttccagggcccgctcccacctgtactactacaagttccagttcactcggaatcaccaaaatggcactgatcacaaaatataagcggcccatagaaacgcgcgaggtatggttcatactagtaaacccaacaaagaacagagaaatcaaacagtgcaaaaaacatacagaatagtataagggatatctttccaactagagaattttactattcgttgttaaaatcaaggaacacttaccctatgtgcagcggtgatcttctaggaacaggataaaagttgaaagcatgagtacgggtttcataaattctgctcggcgctgccttacttgcgagccttcgatgccggaaatacacgacacactaatctgagaatagttagatctgtatttcagatgtgttccgaggttgactgaaatcaagcctagcaataataagacctagtaagatatttgtccatgtattgttacagacctcaaaataaatcgcgcccactatggcgtcgtacaactcaaccccttccgctcaagcgccaacaactactggaaagcgggcgcgtctgtggccctgaaacgcagaaaagcaaattggaaagaccacaaaaaaaaagagttgaatttgtgagctcagaccaagggtgcatccataacgacgtgtgatcaatgaaagaggctggtcaacacggaccgaactttcacgtggcgcttctcgtagtatttgacacaattttaacataggtggcactgcgatactggccaatcgcttagtagttttgcgatcagtaagccaatctcctttgagaatgaagtcccctacgtcctacttaccagaatattttctacatttgtagctccaatacgataatccagaatttggtagccccatggaaagaacacatgtggttccttggttaccaaatatgtatgactacatggaactgtctagattctcgtaatctaaaaaggcttgtactatggctgcaccatattaacttgatcaggatcccatgcaaatatagagcggcgcccggtagaagcttcacagttttgtctgaaaacatacttgtcgcttgttatcagtggccgtttagtgtgtttaaacatgttgattttctactccttgacatattataaaagtcatcccgaggtctgcttatatacgttatggctgacaccgccgcgatagtcattgcagtgatctctctggtaggatcaatcatgtcagcagggatcacagccatagtcacacttcatagtgaccgattgaaacggcactccgagtcggaaaaattagtggcggaatatcgtgatccccttttgctggcatcgatggaactgcaatcgagactctacaacattctcgagcaagactttctctgctactatgagaacaaagctcggagagacttggttgatgtctacactgcatttttgattggccagtttttttcttggacatatatccttcgtcggcaagtccaattccttcgtttttcatcaaacaaaagcaaccagaaactctcacgtgccatcgaagctattcagaagtcattcagcaccgatatgtacggaaaggatgatagtgacttcatgctatggcgcggggagcaattggccattggggagataatgactgtctctgatgatggagagcttttttgcttacaatattcacaatttatccaaaagttcaagtctgcagatgctccttttaaggactacttcaatcctatcacagaaggaattactgcacttgtgaacagaagatctacccatcatccctctcagcatctacctgcaggtagattgcgtcgtgtgcagcattttatcctggatctaattgatgttttggaccctcactacttgggaaaagcgtccgcaaggagccaacgagtttactctgcaccatgctgtgattgttcggaatgccgaagggaagctggatcgtatgggacagattctggtacttcctgaattgatacgaaacaggcatctagttgtcgggaacttggtgtttggtccccaccccgactatattatcgtttcccatggagtgctgtctctcagagcaaaatgtatggtggtgttcaccaggcgctgcgtgggcggcttgccgctctatatagtctttcttcaggacaattcaggccgttgtttacccaaccgatactatatacccgagctagtaggaagtcatatttgtgcaaataaaaccaagaagatgtaccaacccccttcccgcataagtgtagggatttttctctctcggggtagtcagccttctcttgttataatagttataataatatcagacagtaccagggtgatctgagttcacggctttcatatctctctttctcgcctcacgtgtctcgagataccgctcagctcccttgctatgtgctcccgcccatacggatgatcagattctttgatagtgacgatgtgattgagaagatcgaaagtcactttaataatagtaactcaactgcggcgctccgctcgctggctctataacatgggagggattaggaagagctatatcaccgtgaaatacttagagaagaatctagtaaccaaagaataaaatactatcttctgggttaaggctgaaaaattctgtctctccagcagagtattacggagattactctcaaccaactttcctagatcatcaggcatgtccgctcggagtgattattatacacatccccagctctggctaaatttaaccaacccactaacccattacggagtagatgcaataactagccaggcttgattgctggagcccccctgccccatttgggcgggtctaaccttataatcccaaattaggttattaagctgtcggcttcattagaacgtttaatttgccaccgccactgactactacttactcccttctccactactcataacgtcctgattttgcatggcagatttgagcgagtgtgggttgctgtagtcagccccaatgacatttaagccttaagggaaaaaaaatgccgggagagaaaggtgactggaaatggagaggagcgtgatatcttggacaacgacggtgggcccaagatttcccgcctgggccaatcccgtgccactgtagtagaaacctccacttttctcaacagccctctctcggtatgatgaataaacagataaagacatcgataactaatgatttttaatcgcagagtaaaaggcactcaattacgggtgtagagagctataagtacccggtatcaattacttccctgtgcagtcaatagtagtttctgaccactctgtatcattcctaacttcttaaaccctgtttatcagtcgcgccggaccgagcatctcttaacttcccccgattccgtcgccaccccattaccatgacgactcctaccgacaataagttcaaggatgctcaagcatatttggccaaacatcaaggggacagttatcttaagggctgggacctcctctgggacaaaggtgattatctgccctgggatcgaggcttccccaaccccgcgctagaagacaccctggtcgagcgagctggcaccattggtgggcccatcggcccggatggtaagaggcggaaggtcctagtcccgggctgtggacgtggagtcgacgtgctcttattcgcgagctttgggtatgacgcctatggcctggagtgcagcgccgcggctgtcgaagcgtgcaagaaggaggaggagaaggtgaacaatatccagtaccgcgtgcgagatgagaaagttggcaaagggaagattactttcgtccagggggatttctttgatgacgcctggttgaaggaaattggagtacctcgaaatggttttgatgttatttatgattacacggtatgtatagggctccattccgtcattgctattgttttctctctctccacttgtactctgcgtcctacagacggaaccgcaagatggttccctctttcttgtctttctggactttccttctaataattatctagtttttctgtgctctgaacccagagctccgtcctaaatgggctctgcgacacaccgagctccttgctcccttccctgcaggcaatctgatctgtctggagtctcctcgtcatagggaccccctggcccccggccctccatttgcctctccctccgaggcctatatggagcatctgagccaccccggtgaggagatctcctacaacgataagggtcttgttgacgcggacccgttgcgagagcccagcaaggcgggcctggagagagtggcgtactggcagccagagcgcacacacactgtgggcaaggataagaatggggtgatccaagacagagtctctatttggcgtcgacgtgactagaaatgtgcctgcgcatttgtgtgacccaaaaagggagaaaacgtcaatggaaaatatcgctgattttggagtccggcccctggattttaaaggccagtccctagacgctaaagtgaaagtcgaaatgaattgctgggatgcaaaagggcacctttttaaaaaggaatttcgcggacatggagatcatatgcaatggcaggatttcctcaattccatagcgggatcctggttctaatcgtcgcatcatgcaaagtaagcggagattatatctctggtagacaaatattgttattatacataagtgatggtatttcgcatatagggttgaacgcccaaggatcattaagagttgcaaggcgaatggcattctcaacatcgcgctttcggaacgctggcccgcgaccgagacagatagtacagagggaaagatctacgacaaggtcagtaaatgcacggacaagaagacacaaaaaaccattgatctcggcattactcacatttagtgaagctcactgcgttgagctgtggagccgaattaaacgggagactggagaggggcgagctcgggtcctgaaaacgaatccctcgctgctgtagcagcctttgcacaccactcgcatccatccactcatcagcacttgactcattgacaatttgccacgtacgagaggaaagggcgagtcgttcaggcgagtagctgtccctccttgaattaagaacttttgtcctcaactcgatcgtgtctcctatgtcgtcgtgcatgacggcgtcgaatccggagatcaaacagttgcgctcgttaatggccaattgtttgccgaagattgctttgacccttgaatcgtctccaggtaagcttgttaatagatagtatccagtctcgcagcattgtcggactagaaggtgcgagagtgtccagcgcccttgctttaaggaatcgtcggacgacagtatggtcggggaattcaaggcaggagcaggactagcgatggatgagaaggagatgttcggaggcgacaaggctaatccgaacggcagaattgcttgttcttgggagggtggcgtagagggtagttgtgataatccagaccattgagccgcgaggtccgacaagaacgggaaagtatcaccgattattggcaatgaatcaagttgcgttatgagcatattggaatttgagattgtatcttgtgtatcagtaagcgtggaagatattggcggcgacatatccgccggggctgcaggttgttcggcctcgtcgcagccccttctggcaagcgacacatattgctgtgtaattttttgcagagcagctgtgacacgaggctgattttgaagtatcccagcctcgaacagaagattactgaaggaaaggaacgactcgctgagctcttcgatgcctgactcgagttcctgtacgcgagattgcagattggcgatcgtggtttcttttctcctacgatatgcttcctgcgcgacgcgaagctgccttcgacgtcgctggattccttgagtcagttcgaacttgctctgtatttgcggggatgtgcccacctcgggagcttgctgatcgtccgtcgcatttcgtggccgacctctcttgcgaggcgcgggcgcgtcattcattgctttgaccatggtgtagtattactcttggggcccctttaccatcttgaatacatgctgtgatgtaatggagaatctgaggatgcgaaaaggacgtgacggcgttgctctactcatcggggtcggggcgtcgggattgttgaataatcgaaaaatcggtggacagccacgattggcccggactgtcctgctctgtccgaactccgaacgtcatccactcatcatcaagaccgagcgcgccgcaacgaggaaaataaatagattcatcgaggtcagcttagtccataattctccgtctccaatgctccgaattaccttcatgcgtagcgcacagcgtacagctctcgcaacatgtcttcattcactcagccagtgccagtagttgcctgcggcagaatacccacgatggggaaatcaatctcccagcacctactgccggaataccaaggttccagatatacaatcctgaaataaaccaagcatggacctaatgctcctcagtcatccacttcatcctgtcatatgaggctgcagaggctgagctcccgcatctgcttgcaggtcgcgatcctcagtctcggagtcccaatgaaatcggaacccacgattacagccagcctcctcgcgcggtaatcttcggtcgcggctatgagcctcagcaggttgaagaacttaagaagaaattcgcgggtgttcccaaagaacctgttgcttgggtgagggggaacccagcggacttgcctgccggggccgctgggcctgagtatgctcagaatgtcgcggcggatatgaagaaggtgcttcaaaaatggagggacgggggaggaaaggatgaggaggttttggtgtactagttgctttgtcaggagaggttatctaataccttactttttgccagttcgagtctccctaacacaaaatgattgaagggccgatatcaaggatatttgtaagtagtttaggtatagtaacgttcatttcttacacctcatttagaacatttagaacaattagaacgcgggttaatttaccgcggccacggacccgctctctctttcggcaaataggaaagaccctggaattatatactccacctcgcaagatggatcgaaaattatataaaggctgtcttttggttagtggaactttgctgtttgtcttttttcctattgtgtctcttcactttatagacaaaagactgtgtcagaccattttcttgctctgaagcatctatttagaagctcattcgctgcgagtttccatcattatgcattcaagagtggcacagtcatagaggcaaacacccggccagcagcgaacatattattaggaaattgtagtaagtgcaatatatacattattcttaagtacctcttccgatgggctagctggtgcgcctttccgaacttggcacacttaatagcatccaatccatgtttactttaattcaccaatcacatggaaatgagaggtgtgtattctagctgccgaagtgccgtttgtttcagtgatactgttagttcttcgagccagaatgtaggtcaggcctctcaagacggctgagaagcggaggcgtcaagtagagttagagctgcctacatcaaagagtatctacgcggtgtctcgttaaccctcgaggtggggcttggtcgtcatcaggtgggacagaccctcgcgatctgcccagatacggaaaacatatagtggagaagttccaaggttcctatggacacagccactagttaaccgaatatgcattcatatagctagtgctatgctattatcattattattgagcctaggttgccaatgttgcaatcagctacgggcagaatgagtggctcgagatacgtgtggttatctcccattttgtattagtcattattatgcccacataaagtgccagccttcgcctttataacaattcaagacttgttgatatcctattggtgcacccgttgatccactagcagtctttccggctgctatcattcaacctcaggcctggctggttcacattacttttccatttgcttatcgcgatctttcaacagcagcaacgcgaaactgggtgttcggtaatataggagaatggaaccctttgctgctctgctttcttcagccctaggcgagggcgaaacaaacagagtcggtgatcacaccactcaactcgatgccgaggctgaggccgagatgacggccaagatgcagcacaggaagattcaaaaccggaagaaccaaagagcacgccgtgagtctgttccttattgcctcacccactgccgagctcataagctttgaaggactgcggattaaggagcaagacccgggatctactcagacgtcccgcccgtccctcccgttccaagttaggcgctggcgccttgatgaacctgatgtttgtccctcccaggacaacgcggtagcatccgaaggcgcaaccgtcatgtacagctcccctgcacggtctcacgttcacgactcacgcccctcacgatcactgtctccgatcctaaacctacgtgggccctgccccgctgcgagggggatgatgagggtgaggtaactgcggggcacaagggactcattgtttggggcgagccatacgacatgcagaactgggaggccacccccggcttccttgccaagtggtcgtgggccgtggatggatgccacgatctggttgaatgtagtaaccgctggaggcggatgagaggagaggagcctattcgtctcgctgaatcattggaaggaagcaggccatggagatgcaggcttgccacttaatgggagagacggaaccctgtaggaggagggcttcggcggcagaaaggacgaaccccggtctttcttgcaacatctctacctgccgccaagacaatttttcgcctgggaccttgacgttgtttcgtaaacgaatctgtggatttgggtcgcatgatctcaacctcctgcgcaaaacagttcagtgccgtccctctacgcttcagggatgaagtcggggacaacgaaggtgtctagggcccgtgtgacgtgacattgaagctttctatggcaagatttagggcggtaatgagtccttctaatgattgactggacgtgagctattaagaagtagaaaatcatgaattatacgtctttcttgatatctacttgaaggaaattgtgtagcctgatagtatactgaagagcctcgggcctctcttgattccctactcctcatcccgcaaccctacaagttcgagcgagtcgatccaaagcctcttcgccttctcgacgtcataggcgtatggggaatatccaggcgcagtgaacttgtcgtctccttccgcatacggctctgctacggcacagtcaacaaggtacttgccgccctcatgtttccaagccttgccaacggctccccagaccgatgttgccgcaccctgctcaacgctcttcatgatggggtacaagtgccccattcccttgaaggcatccgggggcatatgttgggccagcccggtctgcacaaggccgggatggacgctcgtggagtgtaggtggcgcgagccatagcggcgctcgatttcgttcgccatgtaaatgttggccgtcttggattgtccgtaggccacactggggtcgtagccgcctttctggaagttgtagttgtcggtgtcattgatcccgtggacgttgtgggctgaggaagcgagattgacgactcgggacgggaggtcggcggaggcggcagccaggagagcgggctccaagagcttgtagaacaggaaatgcgaaaggtagttggtgcagaattggagttcgtggccatcagcggttaggcgcaggtcgggaatggccatgatgccggcgttgttcacgagaaggtgaatcttggaggtttcggcgagaatggctgcagctgcgatgcgaaccgaagagagagaggcctggtccatctcaataatcttcatgcgggaaggttcaaagataccagcgagggcggattgggccttggtgacgtctcgggccgtgagaaagagagtggcacccgtggtggccagggcgcgagtggtttcgatgccgatgccagaagacgtaccggtgatgacgatgacctcgcccttgagcttgccttcaacgccctcgtccttgatgatttccagggccgtcgggcgagcatcgccagggccgttcggcttggcgtgggcttcagcgtaacgtgacatgattgcgctggcgagggatttctgaaagctgatgatgaggagcaagactttgcttaggtagcacgaggaggaagggtgtgatattgatctctggaggagttggatactgaggtcgaggcagaagaagcaaggtggttcatttatatagtcaactcactgaaagtctccaatgcgccgtgggctcgttgcaggtgagcattacttagggagactacctatgacttaccaatcgccattgaagatgctttctggcgataggttcagctggccgaaagctaatatcgcctcttctcctgcatatttttccaattaaaatcaagtaatctgatggcatgttctgtcctttcctcggtttttactattatattctactagtaatccctgatccatgacccactgtgatgacactttttccctatttggattactcactctctctatccccatgggacccacctaaacttactgattatcaagtccaactattatgtaaaggcccgggactccggagttatcttgtgggactagagtcagcgactggggctaagataaagccacgggagatccggaatcagttggttaactttagtgagacgcgcactaggccgaaaagggggaaaatgtcattataaataggtaggaagcctcgcggggcatgtctacaattctttttcctgctattcgggcactcactgtcttcaaattcacctactcgactttctgaagaatcccaacagctcgcttcatcatgtcctcctcgatgaacttaagacagtgcatagaggctacagcacgagccttcctatccgcgtacgaagagggctcggtccagaacgacgcctccatcatcaaccgcaacgtcacagcggactgcagacggtacctgcttccctcgtccgtaccccatgcctttggcctaccggcggacttctttttcgacacggcaaagtatcaggagatgtttgggaaggacatcaaggtgttgaaattcacaaacaacatcatggcgaacctgatcatcgataccgaagcccgccgggccgcttttacgtctgtcgcagaggtgcacgccaataacggagaaacgtacccggcagagatggcttggttcttgtactttaatgaggatgggtctaaagtcaagaaggtggttgagttctgcgacaaggatgtgatcttgaggatggcaaacacggctgcttagttcggctctgaagcatacagaatgtggagggatatccagacgaggtttgattcaacatcaacccaagatacagacgttttccctgattcgtagctgcaatattgttattgaaaattacgcaagtagcattagttaggttgcttctctacaatgttcttgttcttggtgtcgatagagtgcttatcaaagaaggaatggcgaaacagtcagaagaggtcaaggagactagcagagtcaatagaaaaagctatctagaagcctcttttacgggcgcacttgataccatgcctgaatcaacaaaaggagcatctaggtcggatgaagccttggtgcaagtgtctggaaatgaacatcaccgcccaaagttggagaatcataccgctagatattagatgtatggggtaataatcgaacgtaacgcactgccgatcttcaagtttctcgaatagttacggtttagattcctcatacttggtatatataatcgttttgaatgcctgactctgtgtataatgaacagcttaatagaacgacccactttggctatactccgtacaatcatacccatggctgttggcccacatcgggatccgcccattttccattttagaccagaacgcgagattttaactttctctacttccatccagcctcctgtgctctgtgagtgagatatcctatggtctttccagggaaaaaaaagaagcgcgaggataaatctgcctagtcacacgaccggtcatttgccgagacctctgacgcagcatcataaataatataactgttatattcactctttgcagcgatgagacgtttggacctttgataggatcgaaaaaaaaaaaaaaaaaaaaaaaaaaaaaaaaaaaaaaaaaatttgacggaatctgctagccccatctcagccatggtcagatgtcccatatgccaggaacatgttgctctgtccgacatcaacggacacctcgactctggctgccagacattcatcgcaacccagctacagagtccagcatcttctactttaaacgaaactgactgcgagcaacgtgagagtcgtgccattgctcaaggaacaacggaacaacatcacctgaagaataactataattcaacagtcccgctcgatgtggacagaaataaaaagaggtcctttaataggaacccaacaccgcgcgcaagaaaccagatacgggattaccatcgactaagcttataacggagcaactacatcttcgcgttgcgacctttagctgaacatgtccagctgcggtgctttgatgacatgattagtcaagaactattgatcgggcccaatagtacactcagacggttgattaagctagataatcttccgaatctgattttatagaggcccccaggaagcggtaaaactacgattacaagaattatcgcgcctatgataagaataaaattctattaaatcagtagctcgactacatcgacgatagaatattaaagtatcgttaggaaggctacataggatgtatacaaggatcaaaaaacatctattatattttgcgatgagatatattaaatcatatattcccaacagaatatatttcttaatgccgtgcggagaaatagcattatactcatcggcgtgaaacagagaatccgtcattgaatattcgctatacttttatatataaatgcaggatttttactgtcacgaagctaaccaccaatgatataacagctattcttcattgttcggtggaatcccagacgctgaagtcattccagcttctggacgataattttctttaatacataaccagcttcgcggatagtgacagtagaatcgcactgaatattattgagattgctgcggatatatgcaggtgactgaacatgactatagagaagttaaagcatttattaactaagagtttactctacaactattcaggtgaccagtattatgacaccatttcagtattccataagttacttcggggcagtgatccggatgctgcgctatactatcttattcgaatgctccagtctggcgagaactcctgatttattgcttgccgttttattgtggcgacgtcggaagatattggacttgccaataatgcaatgactttctcctgagtggaatcatttctgaaagtcactgagaggtgattgtagggtgcttaatgggaatgttcaatagaaaattcaataataatattatatccatctggaatatggtatatccagtgcgaaaaaaatatatatatattctagatggcttctcttgtttttctcttttagtatccttttattgttactttataagtagaatcctacagcttgtaaattgcgcctcaaagaaaaaggataagaataatactgctaataaagtataatatcctatatataaagatagaaactctcctatatcccattgcatataatacaaaaacatcttgaccttttagataatccatacatactatgtctactgggatacattctccgagaatattcattgtcagactgttaagtgacggccgcaacgggatggatgtggttaattataaaataaatagagatatgttagccggcggggtaactgggtgagttatagtcttataggcgggcttgcaggtgatgttcaggcggagggatgttcagggctgaagggactgaagggactgaatgtcagggtagcaagatgcgctaaatccaataaatcaaaaaaaaggtggtgagcaaaaaacatacaacagaagggattcgctggtggtcacccacccaactactaacctcccggcgtgtggcttaagtacggctgagcggacgggaagccctgttttccacaccctgtggtcgtatgtgcttgttctttctttggaatggatgatatagagcaagtggttttatatttgcatcccattttggttccaatatacccctgtgttgaaaatgattgaagtattactaggctagctcatggtagaagtcatcccgatcagcttgagtcaggggccccaccgcgggagaatctgttggctcaccaattctccgagccataatggtgcctgaggcattagttcattcaatatatagtcacgggaaatgcgacaaatcagaccaggattcggttcagtgtattttccttctgtctatgtctgggcggcttcattattgctggactccaatgctgattttgttgcttctgcgatagtaactagatcatcagctagtgtgcccaattcgtcgcgctctttgcgcatctgcctgagctcatctgaaagcgccttgtctgcgccgccttgcagctgcgagacttggagctccagcagtgccaggcagtccttggtgcgttggcgagtagcgcgttgcgcatttcgatcctgaggtctcttcttatcgcgttttgggataactcgcgacattgtgttgatgcattttgatgaaaaactgagaagtagtcatggatattttgctgtgggctgttttggcgggacatgtgctgactgcttagtgagccgccatggaaatgaatccctccacttagaaggagcgccgtctgaaaatggtatgagaattatttattgagggctttctatgcatacattgttataacgctctctcatgtcctcctttcttatctgtccactggagaaacgaatgaggtacctcgaagaggtccgggttaagctctggaactatggcatcatcgatggaggctcgcacggtacactccccgcccaagatatgctcgatattccccagggtgctgtacatcaccccagaagaatgagacatctgacgatcaacggcttcttggtcgttatcggaggaatattcttctcttctgccgcgtttccatcttccaactagcgacgggtaagacgagtagcactccaatgagccattgtgacagagttcactaaggaggtttggaaaatccagattgtcatcgtctgtgagccgtgtcaaagcagcgaggatcttctgggacgcgccgtaggtaatcgcgtacgctgcactacatgccgccttctctattatgcagctcatgcggacattgttcccagttccggctggggcgtcatataaataaggcggaaggtagcgagaaggcattgctgttatgtcgtgaggcatcacctgaacaggtgaagagctgttgcacttcataccacagtgaccaatccaaagaacgtcccagctgtctccgtatggagaatctgtggtcgcattcctttccggggcgttgatcttcggtatttgctgagagcctagggcgagtcccttcaattgcatcttgagatttatatcccagtcaacgtcgtcctcaagtattaatgcacttgcgatcccatctgcgacaattctatagattttattagatgatgtgaacgaacagtatgtgacacgagacgctacctctgcacagcattcgcatgcgggcgggaaacaggaactgtttcagagtcctttgaatcgttcaattcctaccacaaatcgtgagctaaatattcatcgtgggttccaggttgacggaccttggcgctgtcttcgtcaaggattaacccgtcaatgaagtcgacatgaaatcctgtagctgaggatgcaagtacaatcgcatcgcgtctgtctaaacgctgtgctgggctaatcgcaaatatcttctcaaactatactatatcagtatctatgtgcggatggtcagcggggtgatggagtagcatacacctaatgtgttgtttacgatcgcgtctaaggggtcccggatgtcgtcgagcgtaacatgtaggccgcgcccaatattttgatgaataactaaagaccaaagtaaagctatgatgacgagcagtaagatgaccagatttgaagatcgacggcgcggtccagggcccaacctgaccggagacccgggagtcatcatagcagccatgttcattagtgggatgatcagaaatgcgagcgcagaccccgcctcttttaagaccccaatgattaccttatgaaatctccacaccttgtttgattgatgcaatgcattgtgaccaaacagcgtgtgacaggcaggacagtgtccagtcaaatgctttggttagacgccgtcgttgcgggtcttcaccagaactagcaatcggctaagggattggcccagtttacccgcatgagcatagccagtaagcactaatcaggcctttgcctaagctgtaatcgtacaaaggtacagggtcgtctccattccacgtgtgatgtctgaataagatggcttcaagtataaacgtcctgacagtttataaggtatacattcagtcgcagtgcatgtgctggtcggtctttcaggtgggaggcaggcacgtgccagttgtagcttgtttaagctctgagaagccgcaacagtcaggcttggcctcactgtggtctaattttcacaggccattgtttacttatggggcccctaactgacaaaccagaagagtggctccaaaattcgttcacgaaccgcaattccgaagatggcacattagatatgcagccaacgcgagaagcgtagcgctactcaggatttctcgggcgtcgttattgatgatgtagacaaagttgacgcagatgcatatggcggcgggctagcgtcctccgcaacgtgcccttcgaagctttgagtagctttttctggttcccaagagtttgccaatagctccacagggagatcgggaacatcaaaggtacttgtttttcctgcacattcaaacgaaaatgacgcgcacaaccgatacgtcctgctgatgttgaatgtgcggaaagaaacatctgtatgcctgattctaagatgtccaaaagcctgcgctaagtccactttacccaaaactcgcataccgagtgacgtccgtgatagtatttcaatccgctcgtcaacttggcccgataatgctcccattaaagacggagcggcccgagcggcagtttgactgaccatgaagatggacaaagattgcatcacaatgtccggaggtgaaataacagaagagtcctccataaaaggcgtaatgtctaaaaagcatgggatcggtgcagattgtatcatgcgtgtggggtaggaaaaagacgctttaaagctgaaccgaggcagctgaccaggtgatagccatgactggatcttctcctgcaccttcaggcttcttcccttattttccgggagtagaagcatgcttcgtatattgaacaactgctccttctgttgctgatatgtcgcagggtagctgtctgtgcttttcaaatcccatctagcttcaagcggtaaaaagttcaaatgtacgacctcagagaacaaaggtgactttctccctaagattcctcgctgcggtctgaatacttgggcgtggactcggtactcgatggtgcactccagcttccgtaaagaatcatgagtttcggctgcaaaggtgggtggcagggggtgattcgcgtcgctgcggaaaggcaaagtttcgggccatcttgacgaggcggcctgggcatgtgacggaaagacgaattcgaacggccattcatacgtgtcaggggcaactgtatcgccattcgggtgccatagtattctctccttttcgaaaaggatacatttgctacgatagctggcggcaggggctgcagatcccttggtcttctgcacctttgcctttgcgcgcccggagaatgtcactcgaatatcctgaatctctgttggggtaggacattgaaagataacacgacctctgattcggtcatttccagcgtaacactgctgctgattgaccaacgacacggtgataggcattgtaaggaatagtacacgacccagacttgggtggcttcaatgacaaaagagctgctgggaagggattgcagaaagaaaatgcaggggaacggcgggatggcacacctttgtaccactgtctagtggcttgtcccacatatttttcatctgaaagcattgtccaggatatataaataggatgattgtcgaagcttttaccagacccattaatacgtagtcgatgatgtctgtgacagtgggggggcgcccctagcaattcgcgaatgaggcgcacaaccgtaaacgaatacgcggagacttcctgatccggaaggggtggcgttccactttcgctccactcaaccttcacaattcagtacaacatcctcgcttccactacccatgcttgcatgggtaaagatttagttttaaatctctagtacctgtttcatacaaatataatgctgaaatatctcttatcatggcgccccatgattatctagctatatgatctacttactactagcaagtgaggcaatacatgcagttagctagtcctcttaataagcaagatctctctctaccttgccatcgcctgtgtaaatgcatgaagggtatctctacatatattatccaagacatcttttcagttcgatgcatcctgatatgtaattggccgagttatgagcagacaaatgctttctacttaccgccttccgtagctgttgttgtatctacttgctagggatcctgtctcggatcctggtgtttaaacaccaggatcatgcagctaacattgttttcattatttccagtggtctcgattatctaaagaatgggtatatcggtggatcaaaggaaagcgacagttgttgctcaggtgccggattattccgtgacgcgccataataataagcctttcaagttcctgacaaaaaaaaaggcacaaagtaagatctgcgcacagaccaggatttcggctccatgtgtgactatggactatgtatggagtactccactggaagatccagtagtacgcatggaagatggacctcgtaccaacgcgccacaaccaaatcgtctcacagaaaattctatagatgttgcgttttaaagatgaatcataaaacagagtgttgtgagatcgcaggtcattcaaaatcaaactattgtttgtgcaaacatccggtagcttgcgatactactaatgcctctttattcataaatgtccagattccccaacataatcaaataaccattgttgtacctactcctacataaatggtttcgagttggttcatgctcacctcttcacccctcccatctcccttgtagtcgagttcgaagtagattctcgttcaaatcatccacagtaagtaacgtgatctgctagtctccccttgcaatgacttacggccacaggaacacccaacagccttatcagctacatactgaccacaaatatagtacctacagttagcttttgacaagactttaaacaaacgctacaaattactggagccatcaacggtctccagctttatcagcgatctttattttatcctacagggattactgttgcctttccattctgaatgtgtacctgataaccccgccttatttccacagccgagccttgcacggaaaaccgacccgttgcatttcctcattctgcgcccttacctctcaccttctgtcagacgtcttcacccgcttctctgttaatctcaacggataggcctggtccatcctcagcaagtcagcatgccttggaaactcttccgcaaagatctttccgacgtatgcctccgagggagatttccccgtctaagccacctcaggctcggtgacgaagacagtaccatcgcctttacctacagcttccagcccagcatgcacattgaatttatggtctccattcttggtatgtgagaaccttcatgatgtgttattcatctggtttactaaccgcgtgatagatgccaccgaataccccgataatcacagttactttgcgttcgctgtcacggacaatatccccccggctgtttccgccattctggagacagtacaatgcaagttcaatggttgctctctagagacattcctagaaggcttctgtaattaccttgaccaagctgccctcgggagagaaccgcgggcaagttctcctatagatgacgacttcgatgccatctcagatggtgaagatatggactgggacgagtaccccgatgccccacagatggaccattccgtggatatgaagcaactgcggactgatcttcgagcagctaaaagcgcaggattcaaggttggctatcttggtgacctggagggctcgttcattgtgtctatttcctgccgcattgctagcctaggcatttcacaggatgccatgcaaatgtgggatgtctgccccacacactttatagtgttgcttctttattacccaagggggtatcggagactagaccacattgtatcccagtcccagacagctccttcgccagtcaggatgtatgtcggtttttgcgataggtacaagcccacggcggtgtctatcccagagacgcaccaggaattctccggcctcggtgtatcaagctcaactcccaaatcggctttaaaatcttcgttcatcaccgacccgttagagacccttctcaacgatcgcttcctcagtattgtacaagatcgactcagacacggtttctcatggaccggggcagaaattttctacaatgacgctcagggtaagaagctagataccaaagattctaagcttcccaaatactttgttccagaagaatgggccaagttcacacccggcttcgttaaagcagacgatctgtcacagcatacagcacatcagctgtcccttcctctcattgccatgcagtatactctgcgacgttttgttaagtgcacggaattctgtctgaactgtcattgcaagatagacgccggttttgaggctctaaagccttatgtttgttccagtccgttatgcctctatcaatatatgcaacttgggatgggtcccaagctagaatgggagatagtcacacagccgtatgtggtagacatgctcgttagctttgcttatgctcgggctgcacaagggcaactgactgaccttccctctggactcggcatgaaggttgcctctactggatcaactctgccatcatggactgcgaggctggatgctgccaagatgacactattagcccaaaagcctcataatctcaaagttggtgaatggattctaataaagctagccaatgcgtctgatctaccatcgactgtttcatcgctctgcagtactgtgctccaagtgcatgaccagtcacttgtcgagatctcgcagcctatctctgtaggctattgggctgacccacaagactcgctttctgacgggctagacgtgcaagttgtacccttccgtgttgactttgatagtttagctggagatttgaaacagaaagcagtcatgctactccttgacacattacccgatgtcttttcgatgaaatatttcatcgagagcagtgcgcctgagcacaaagcgctcgcctcgtggcatggcacaatctgcccatcagctctatatgtactacgatggattcttgcttcaaacagatcgtgcatcgtacacgacgataatcctgaacatcaggtgacaggaatgcacaactacatgcaattcaggctagcgcaggggtctccagacaaagaagctcggttcgtccaggaactcaataacagctcaaatacggagttccccacgcttttcgcttggcacggaagcccaatttataattggcacagcatactgagagaaggtttaaactttgctcaacagctgaatggccgtgcttatggagatggtgtttatatggcgaaagatcttgaggtttctcgcatatactgctctcgtggtagtatgtctggagccaagtggtcacgaagcaagttagacatcacttctgctatctcgctgaatgaagttgtcaattcaccgacaaaattcaaactgaccaagccctattacgttgttactcaactagactggattcagtcgcggtacctgtttatctcagggggtggtatcaaagctcaaggagaaaacaagaacaaaccctcaaaggtttacaaacagcatccggattggacggcacgtggccctggtaatgagcctgtttccattcctatatcggcccttggcactcggcagagccagagccacaagaacaaagatgattcgaatgggctagccacaggtcatagacaaaagaaaaggaaggcatctacgaagggggtatgtggtccgtctgagagctcatcgaccactgatcctaacgacgatacggagattgaggatcttcgcttacttgattcggactcggatggcgatgtcattggaaaatcaagacgtgtcgatgcatcaaagtccagtcataatctgacacgcgggtccaaaaccgacttccagcccggcacattgcaagctcattctttcaagctccttggaccaccaagctacgcgaccacaaccgcgacaaagtcactacagcgtcatctcaaggcaacattacgcatccaggaccgagagcctctacatgagatcggttggtatgtcgaccccacacttatcaacaacgtttatcagtggatcgtcgagttccacagcttcgatccctctcttcctttggcacaggatctcaagcagaaaggtctcacgagcgttgttatggaaatgcgctttccgccgcagtttccgatgtctccgccttttatccgcgttgttcgaccccgatttatgtccttccaacaacgcggtggtggccatgtgaccgctggtggcgccatgtgcatggagctactcacaagctcaggctggcttccgacgagctccatagacagtgtgtttctacaggtacgtatggcactctgctcaacagagccttggcctgcacggattgaacgcgatggcgattacccgttcagtgaagctgtgagtgcctacaggcgagcttgtcaagcacatggttggaaggtgcctgatgattttaatcgcatcgaggcggcatgatatcagttttcagtcaagccgatcattttttttttctctaatatttccttcatattatgtcagtgggtggccatatctaatgcggcgaagttatgcatcaaaactctattctctcaagacgtctgtcccggtagatcacgataatttgaagcatcagttaccattcagataaaagactgcagaaattgtgaaccatcaaggggctttaacatttccccaagtaatcgatatagatggatatagatatttgagggaatactccgtgtattgaccctctaacctcacccagggagagcactggtcgatctccatgaccattcctccaaacatcagccccatatttccggtaggcgagtatgaaaccaatatagttgatgttgtgtttgtatacatcattccttgacatctatagtttgggcacaagctcgcgcatcctggcaaactcatgcagaaattgatgattgcaaaaggccagccttcctcagcgccggaatcgccttgtcaaccacccactcagtgcacttcaccaacggtcgtctttcctcaccggcctcatagaactctagaggcgacagcctcttgaaaggctcagtcttcattcgtttaacgttgaatgccttttgttgtgggggagctggaatctctcgtagaacgttgtcccaagagttgggatagtgtgctgcatccgtcataccaagcagtgttcgagaaaagaagttctcgacggactctggttgaggggcgagtttagattcgtagtacatcccctctggtgaggtgatatccccggtcacttcgtggatggttccagagccagtcactgggtctgtttcaacgaagatcgcagtgtgatagcgcggagaaggaaggtcggggcctggcattgccaaatgggttcggattatgtagacagggtagtgagtcatgccggagttgtactttggtatggcagttgctgatgggaatattgtaaggcgggggaatgaggcagtgaagtcggcaaggagctcatttagcagtcatgtgtctttggcggccacggcatttgtctgcctggtgtctaccttcatcctacaacactctcactcaatttctagactctatatctctacattggtaaatgctatggcacgggtatctcaaatacatggtaatatggagagaaatctctcacagccaccgcatacctccgcacacatcacaatgaccacaccacagatatgcagtgcgcaattcactacgcgcacaaaggtagccccaaccctacaatgcaaaactgcagaagcgatatagcaaactggcgtcaccgccttcagagtcgtgattctgcctgaatacttgtttatgtgttgctcgaagagagtgaattaagatggctggaagaagacttctctctctactgatttctctcttctctttcctgtgttcatcttcttttccatccaaaccgcatctcaaaccatcgtttctcgtgcatcatgtcgagcgatatggacacccaggtctcgagcggaacggagatgggagtctcattaccgttcctgcaagcagcacgccagctgaattacgaccgtttgagtttgttgatcgctgaaggtcatcatcccaacagacgcgatgaaaatggctatacggctttgcatcgggctatacttgaatgccctgaagacctaactactgttgccatgctgctgacgtacggagcaaacccacatgctgttttcaaggatcggaacagcttacgcgaaataacacccttacattatgctgccataaggggagatgttgggctggtgtccctctttctccatcatggaaaaagtgacccggcccctcgaagcctcaaatattggaccacccccctcgaggatgccatcagcaatggtcatctcacggtggtggcaagatttattgagttcttctcgagcagtcagctgctgaacaagccgtcccgcggaatagatgaatctatcatattgtccgcgagactctggtactcgaaggcattgtcgctgctacttgagtacaagaagcaccacttattccccagtcctcatgggcccgacgttctcaagcatgccttttgcgaagctatccgatctgaagcttgcaactccagcgtccagggcattggtgagcgagctggaggtcccggagataatactccttctaaatgcgcaaacctccttcttcaagccggagtacgcttcagggacgatgaaatggatcgacttctcagcataacctgcagcaacgcccatctgatcggtgttacccgcctgcttttgaacctgggccccaaggtgaccgcccatcacattacccgcgccatagagagccagagttatcacatggtgaaaatcgttaccaaatatgtcatcaccagtgccggagaagacgcaatcaaacgcgacagtgagcctgacctcatccagtacgctgcaagtcacggcagcctcgacaccttcgaatacctggccacggagctcggtacagcttcatctcagagccaacctatcgccacgaccgagagccgcaaaactcctcttatccattacgctgtgtggggcctccgcatcgacgttgtccagcatcttctctccacgcaaggcgcaaacgtcaacgagcaagacgaatatggccactcaccactgatgtatgctttcgacatcgcacaagcaagcgacgagaacccgtgcctggctataattcagctcctgatgcagtacggtgtcgatgtgaaagccagttcgatcgagggtctcactgctctgcatctcgccgtcagactaggaatcaccccggctgtccagctcctcctctcgaatgggtgtgatcccaatgctaaaacaaccaccggcagcgatctgtatctcagacggagccccagctcttggagcccagagactaccgcacgcaaccgaaccccattgcattgggctgttgatcggttggcgaatgtttcctatgatgttgttagacttttgctccattacggtgctgatatgaatgctgaggacggaaatggtgtcacgcctttgaaccttctactcggcgagggatggtgcattaatagagcttgggagtctcgtatggcggttgttaacctcttcctgacctttggtgcaaacattgacatcaaagatatgagcggaatcacggcacgtcagaggatccgtcagcgagaggcggagttgtgtgcccctgttgttgactagatgagttgagggccgggttaccttggtctttctttggcttaaggttgatgctctggtctctcttgaatatgtctcatgatttgctgcttgacctttcgatcttgccttacaaaagagggttgttttacatacggtcattgggttgatatcgcctgatttttcttcattttacatgatttgttgcttgatctttcgatcttgccatagggaggggttggtttttacatcggctcttggagttgagtttgcctgatttcttcgtttacttcaacatatgttgcttggtatttatgagatgatgccatattggggacgtcgattacatcaggagtttgtggatctacgcgcatgttcacgccttttacaatctgttgttggggtagaagagggagggatatcgagctggtgatgggagaaaggaatttgacaagaagatgaaagaagacagaaaagaaaatgaaaatgaaaggaaacaggaatcaaaaaaaaaaaaaaaaagaagaagaagaagaacaaaaaatcaatggaaagacataaatgaaaagaagaaaaaatgaaacaaaaaaaagaaagaaaaatacggaagcaagaaaaaaatgaggaaagagcgaaagtgcaaaaagagtggatgggccgtgtaatatcacgaccatactttaatgtttctagtgctttacgatagtgatgatagcaatgccaccacttgattaatatctgagcatatcttcagtagatgcgagatgagaatatagagatagtagaaatgatcggagccgtacgcaaccaacaccagctatcgtcctccggtatgacaagaattttgtaacggaaattgttgcgaatagcttcaaatttctactttgtggtatctaacatgacaaattgccattttaccaaacctccccttctttcgactctttcgaaacggtgtggccatctattatgaccatcttcgaccgataccagatatggtagtctgtagaagacacactgagtggtcgttgaaacggggctggtgaacgggtcaaccactgctgatcccctcaatacgcatcgtgcaagtgccctctccgtcaggaggaccttgtaggcgtatgtgaccctgtgtcctgcggctcccgagtgctcgacgcctccgatcctcgaagtcctgatcgcatccggagagcgtcatggcaggcccaaatgattcgcgacatgctccgtaggcagcctcaaggtgataacataatcccagtaaacatcacccagcttcttcaatcactcccagcctcttcctcaccaccatccgcttcatcttcaacatccagttccggcaacgtgaactgcgtactaggcccagcttcggcctgctgagtattcgcagccgaccgtctagccctctgtgcagccggatcagacatagtaatcgcgcgctcaccaacgaatcgatcacccggccacgcactcttgcacacaggacagctttcagcctgttgcatacgaaagaaattccgcatgcagtgatcgtgcaatcgtccggtacaatcgcggtctccgcatcgttggccctaaacacaatcacagaatcattagccaacaagcccgcatagcaaggaatactctccaactcacagcagtaatgatatccctacacgcagcacagaacttaatcttcctaatcccctcatcattatacgccgccaccaaccaccccctcaactccatcaacccgcgcggactcaaccgataataccccttcctgctcttctcaaaccacccctgctcgacaagctgcttcagcatcgtctccgcctgcgtcatagtcaacgactgtgccgcgcctccctgcgtcgcttgctgctgtgttcctgactcccgtctatttgcgtcccctgcaccagccttggccagctgcaatgcctgcatactacttatgaccattgcttcctggcggcgggtattgtatgtgtcgaacatggcgtcgaggatgcgcttcacgaaggcgatttcgtcggcggagtatgttgttgcgagctgggtgagggcgtcgctggttgtgttgacgagggcgtagactcgttccggagctgggggagggtcattgttgttgttgatttcaatctggggtagtatgctccggatttcgaggtcgaagggggatatggcgctgttggcggcggcgatgtaggtttggaggtcgtcttccgttatgtcttctggggaaacttgttcgtcgtctatattgatccggatttagtttggtgttttggtgtatgagtagagtatagaggattacctctgatggagaatatagcagccagaacgggctttgcttgtgtaaaggtcatggtggaccgcgccatgaaggcttggagaaatgcgcggttgctgtcatcgtagcggtcgtggtcttctgcgtatcggggcattttgtatgtaggttggttggactttgagggagagggtgtcgtaggttaagtggttatatggtgagattatgcattgcggtttctcttgtagattggagggaatttgatgtctcctttatgcggggagtatatgaatagatggaccggacaaagaaattggatgcgacggacgacgcgatggacgcgccggcggccccgcgtttattggttctggatgccaagactggaggttctttgtgtcgtccaatgtttatttatgtcttcgaggatcgattgggatgtaagtaggttctagcagcatggatttttatagcagaaaccattattaaaaattagtatcactataagataagaattgtttcattccttaacacaatccagaaccatattgcggatatcgcaaatgcagttgatatcatagcgtaaagaaactagaatagaaatacagctgacagatgatggtcattctcccccaacgccgcatatagaacaacacaaaggacaatccaaatcacagagccctcctagtacctcctccgggtcggctccggactaggactgcggctgacacttctcgcatccctgccacgctccttcagccacttcttcgtactgagacgaagatcccgatccaattcattgctggggtccttccgatgaatgaagttgcagaatccaccacgtacacacccctcgccgctatttaaccgacaacaagcttctcgaaaatctgtaaccggtgataattcacaatatataggtcgtgccgcgtaccaccgtgaattcaaagcgtcgcaggcggcctgggcatcttcttcgtatttgaagcgcgcgtagacgtttccaatgaggtctattagagaagaagcaactctatgttagcctatatcttaccactatccggggaagggatatgaatggatgcgacgcacggtcattgttgttatcgcagacaaccaattcctccaactcgccgtacttgcacatctcgcaccacacatcctcgtagaaagcatcaaagtggttctgtagctgactggggttcatcttgctcttcgggtcgtacgcgggattctggtacatgttcggcatcaggatcgtctgagagtatgacggcttaacgtgctttcgagagcagcggtcgccatgtctgcaagctccgattttgtagtagaaggagcagttgaccttgtcctgctctgtaccgaagatggaggcgagatagttggccatggtggaacgtgttgcgccaagctcggttcgcggagaaggactgctgaacggtaataagatatgaatataggtggaaaggtcgaggatctagaggagatgaagagtacgcgaaggctgcaacagcgcagagcaaatacgttagcacgacgtggtttccccagctcttgattgcagattctggagagcttcgatctcgtggcggccgcgctgactaatctcggagaagcttctggtgcctgaggcgtccatcttcagcatgtaccttactcagctctttcttcgtagtgaacttttgggctagattgctattggtgtatagtctatatgttaggggaacagtctaagttattattctattgaggaaagttaactgatctaagcggtttgatgatgcaaagccgactatatacgttccaagcctctacgggtcacacccagcccgctgatatctactgcaggctgaaccccttccaccagatcggcaataacctttccagttccaagagcaagcgagatgccccaaggaccgtggcccgaagcgacaaataccccacccttcctgcttcctgtggcggtcttgatgccctctcccaacaagctgtcgtcaattctccccacaaaaggtgtgccacgatctgaagcaggacggaaacaaaggccttcacggactatcttcaggtcgttcaggttcggggtttcgtcacttgattccgttttgccctcggcaagcttcccaagcaggcgaacagacgctgccttcagtctatccatctccttttggtccactgaattatgggagtcgtctgctcgttccggaagtgggattgtcttggtattcaaacccgcaatgtagatttctctcccttcccgagagaacaattccgggctaaagccgcaggatggtggccatgtcgtgaacaaagcatgggtctcaccatgatactttttctgctcgtgttccagagtatgtcttggggagtgaagtaccaaagaatacccagcgagcggatatatagggagtgcaactttggagaacgggaacaggtcacggaagacctgcggtgtccacggtccagcgcagacaactagattcgtacaggggatagtagattcggatttcgtattcaagttcacaattctgacgccggtaatggtaccggcctcattcctgacaagtgatgaagcctttgttggacagtggagcttgacacctcgtgacgtgcagctgtccatgaggaacctgcacaacctcaagggatcactaatgataatcagcatatttgcttcattgcgcaagaattcagtcggccttacacttgaccagtcgtatccttatcactgatctgctctaccttcgccccctgctgctgcgtcaaccattctgggacctgaggttccccgtactggcttgtgcctgcagccgtctctgcgcgactggtacctgcacgaagccaatcatcgccacgagcacctcctttgttgctcacagagcctaagctcagcgccacacctttcatataaccccatttctgccgtcctccgtgctcagcagcaagggactcgtgtaaattgaatgacagctcgcccaatggcgcgagagaaggcgcaaaccaatccttagctaagaagccagcagcatagccagaggcagagcagaacagctcggatgccgattcaatgacatgaatttcttcttgcggttgactttgagagaggtaataggcaattgaggagccaatgatacctcctccaagaatgacggttggcatgttggaattggagctatgacttgtctgagcgttctcgggtaacaatggcgctcaagttcatagaatcacaatgcaatttctgatgcggatagggaattttgtctctcagcactgtcgtcttgggtcgctgtcaaatttatataaataggagtgggtatctccagagctccaaacaaaagtggcggggtagatccgggaaagtcgattcgatgaacagagtggatcgcgcccttcgaatgatgatttccggatgaggtacctactactactttgcaccctgctgctgcatttgcccttatcaaccggtacccttcccgagttgaccgggccggttgaccttgtaccaacaagcatcaggatgtcccttgttgataatgtatcttggacctctgatagagcaaccaaccttgctcccttgcgtgatgttgttgctcagagatagcgttccgaactcggacacccagccgattccggaggtccagacgtttccgggtcttcgtccatcccctgacaattagcggaataaacgttctaaagaagaaatacgtgcttatgagataacactagaattcctataatcaatttcttggtatcagaagcaggggttgagagttactctcgattcgagtggtagacccatatgcactactaagagtaccggggaacggcttccccacggacttcatgatattcagtggattcgctccagatctccaaggtacttggcaagggttctagaactttccaatacattttccttgtagggaatggcatttagactcgaagtactcagtagacttacgttcatgaaaatgaattgatctctgatatccgcagggtatagccgtaccagctcccatctacgatggcacttcatatctgttgctttgatattgacaacgccataaaagtcggtcagtggaatataaattccgcacataaacaaagactcaagttaatgatgataatactgagcgctatccctctccaccaactccactcgaccagcatatcttttccgcggaaaagtcaaatcctcgtggtatggttaccccggaacctagatttctaatgagttgaagtgatgtgacacgttgtaaatcatacatgtattaatctaggtggactataacagtcgaaacaataaacatggtgccatattaagacacagttttacatgaagatatagtattagcgggttcaggatgtctacgctgctaggtaatgcagtgatctagcgacataaaccaccagtccaatgttccagatgtttgtcttgttattgaaagggaattatcgattctcattgctatatacctacaccctaataatggtgtgttcatcctactgctcgatcttcaatatggcggatgaaacagcgcgaggaattgccggcaagcaccccacgttcccctcattacatcacccgccaaagccggcgataactcaaccttattcccctcttcgtacaattcagccactatcgttgtgcaaccagaccatatagtaccacaaccctgtcctaccatctccgccgtaccaatcaaagcacaatgtccaagaccatcatcgttaccggtgcctcgagaggtaatcctatccagcccgtccacgattccattgcaaactcaactctacgagcaagccactgatcaggcacacacaatcaggaatcggcctcgccatcacgaaatacctcctcacggcaccccaatcccacaatgttgtcgtgatcgcccgcagccgtgaacctctcgagaagcttaaggagcaatacagcaagcaagtcgaggtgctcaatggcgacctggctgacttctccatcggtcagaaggccgtggacctggctctcaggtccttcggtcgtctggacggcatggtcctcaaccacggcatgcttggacaagtaggcaaggtcaaggacgcggatttcgagcagtggaagcacggattcgacgtgaactttatcagtcttgttgcttttgtgagtacgagtctttcaaacttatggcggatagcggtacatgactgggacctggatagctgacgcattgggtgtttgttatctgcttagatcaaggccggtcttcccgccctccgtgaatccaagggaaaaatcatcttcacttcgtcgggtgctgccgtctctgcctacaggggctgggctctctacggtgcgacgaaggcggccatgaaccatctcgccttgagcttgggagaggaagaacccgaggttactacaatttcgatcaggcctggcatggttgacaccgagatgcagcgggagctacgcgaggaccatgctacgaccttggagccgcagatgcatgccaagtttacgacggtccacaaggagggcaagctcctcaagccagagcagccgggtcatgttatggccaagctggttttggacgctcctaacgagcttactgggaagttcttcacgtgagtgatttggaaaatttcttcatttcaggcaaaaaagctaacaggtataactaggtggaacgacaaggctctggaggcattccaggcgtagattacaactagatgattcttatgaagacagtcagtatataccgtcaacaagactcaatatagaacgtattgcaagatagaatacataatcagccgaaagatgaaaagcaggttacatttcggaagcattaggcgttaaccttcatacttagcatggaatgtaatgtgatcatcatgtaaacaattgtggacgcatagaaaaaattatcacgcataccttacggatatccaaatgaggtattgtgtggtcgcgtaaatttgttgtttgaaaaattgcacctagattctttgaataagtcagcaatgtacaatacaatgactgattggcaaattccgatagtgaggaaatatttcagtggtccgtttggcttggacagtgtacgtcaccatagatggtatgataggggcgacaacgatgttcatcatgataattgaaaggaagtgaaatgtgtgaaatacataccattgaagttagttccttgaagaatttcaagaattgagcaagcaaaacatgaaaagtgaagccatttttcactttctgttgtgcgaagagcactgcatgagtgaagaaatcatgaaccgaaaaaaagctgtgaaccgagattaaaaaccccagaggcggtatgtttctgccgggcggttcttccgttccgtgacgagtccctccgcgccgggatttaatcgcagctatttataccaaccagttgctccccgcgcaccgtctcaatacatactttcgaatctggagtcaacatccaccagtgtgcagaacgcgcgtttcgtatattcccttccttgtcgcccatcatgtcagatcgcgaatttagtggtaagttctttgccagattacttcctggcgcgatattatgatgtcaagctaacttgcgattttcctagcgaacgacgacttgtcgctacctaaaggtatgtcgccttccgccgtgttgtcgcgtcgcatcgactcccccacttttgagggcagtgggactcgtcgccctttgctttgcctccctcggactcagtataaaatataatcaaatatccatcatatactaaatcgcaaaccatactcacagcgacggtccaaaagatcatcaccgagatcctacctccttcatccggccagacattctccaaagatgctcgcgatctcctcatggaatgctgcgttgaattcatcactttgatctcttccgaagcaaacgatatcagtgaaaaggaagccaagaagaccatcgcctgcgaacatgtcgagcgcgccctccgtgatctcggtttcagcgactacatccccgatgtccttgctgtcgcggaggaacacaaagagcagttgaaggtatgtggctgttaccattacctcttttgtggcattgtccggctaacatggatcggttacactagtcgcgagagaagaagcagagcaagatggagcagagcgggttgtccgaggaggagcttctacggcagcaacaggagttgttccgctcagctactgagaagtatcacgctgctccggagtgaaggttacgagtttaatatccgggaaggctaaaaaagtaatgcggttagtctcatgctggtcatagagggtctggttccggagttcttgagacgtttcctacgacggggatttggagttcgggtggttctggtattatacgctttatacgctttgtgggaaggatttttatcactatactttttcttctatattctcctggctgaggcagtctttctggttcgttatattatttattgatgtgcatggcggtataacgcaatcctctgatcagaggatatggttcatgttctagtagtgcttatacccatggtagtgactatggttgacgtccgggaaataccaacagcgacaacgaaacatggtatctagatatcttggcagcatgatagttcgtctaggtgtatagttaagaggttgcacggagttatcctgacctagtaccgcttacattctaagttaatcgcttcctgcaagtctgtttgcttattctttttctgaaaacgtagatcagaaataatcggtacaatatgtccatccgatcgcttttgcgtttccggatctttatagtatatccttatcccgactcactgtgagatgaattaaacacaactacttcctgctttcagccaaccatggtcttcgtactgactagcggcgcaccgtgactacacttcttctggctacaaaaaaaataaaaacaaggagcatactgactatgctagcagcagttgagagggaaaaaagaaacgaaaaacatacaacagaagggattcgctggtggtcacccacccaactactaacctcccggcgtgtggcttaagtacggctgagcggacgggaagccctgttttccacaccctgtggtcgtatgtaccagacctttctatgcaaagggttataacgtactctattgtatgtttaaaatccacttaattggcgccttcttgtccgcgggtcgccaacgacgaagaagtccagaagaggtgttggaggtcttatggtgcgggttagctggttactgcgcgagctggggtgtatgcagacgattagtatctgcttcgagagcagttattcactcaggggttgtactagtttctagtactgagtactagtagtactatatgatgatggctggggtttatcctcgggatcatacacccgtgatatatatatgggtagggcatccattcctagtcaagaactatttctcttgattcgcttcgacattggggaagaaaaataatattcccctaattatagtcaacaacaaggaaaaagcacagaaacaatgaaaataatacttatcgcgactgtctgcttcaaaagcagagaaatatggttctccatgctgtcacaggtacgtgaacaccgcctgcggagtgaatcaatttgcccggaatatccttattcggccaagttcttctccaccttaccatctatgccttctcgagacagccaaatcacaccatgtgatacgacatgcaaaggcctggataataaaggaacccaagtgtgctgtcatgcaggaatgttcaccatgccgtttacactcgtgattgacaaatcgttgacacctgccaattcatgaagcactactccaactcccaccccctcgcctcctgcatcgtggcataccaatgcttcacataattcaggcccgtgtggggtccatatggctcagcttcccatggcgggattggggcagcaagccccgtctcttgtaaacatgacacctgcagctcgtccagactgcctccgcggtcatagatgctgccatctgtcacaaggctccgcatatctgccctcaactcttctgtttccagagtacagaccataccatctgtatcgagcaaaacaccatatccgttgcgtgcaccctccaacgtcaccagttttcgacggacatccatcgcaacccgctcagcgggtcgagtgagaggatcgcccaatccaccacctccccatgttacccattccaacaaatcccccggactaacacgcacatggtcgcattttgacggcaggacctccatcactggacgatcggcaccgcgaggataccgatacaagatcttccgcgaacgttgtcccggcttcccccctttgagaccccatggttcgtgaaccaccgatcatcatgcaggctgatctctcctttcgccaggaatcgatacagggttcgttgcgcattgcctcctcggaagtatcccgggccaccactgtctgcgacactttcgttcgcctcaatccgaagggggtaattcagctcgatgctctccgttggaatcgacttgatggcggggaacaagcaatgacagtccagtccgtcgcctgctgcgcgggccggaaccccaccaaatccaatctgatatagttgataccattctccagagggatagtatccggagtagaagaaatggggcgagtcgctgaatccagctgccgctacataggcttcgttcttctgcccgatcagcgcttggatcacgtccatggttcgacctaggaagtgagtgcgacaggaaattgcagcagggcggactggctttagaacggtgccctcggggatacgcacttcaatgaggtcgtggaacccgttgttgatgacggttcccggggcggcagcggcaatgaggtagtatccgacgagcatcttgaacatggtctcggagaggtaaaagttgatgctgtgctcgctctggggcgaagtaccactccagtcgaactttaaccctcccgcactggtcttctgcattgagcatgttacggcccagggtccaacgccgtggccgtcgtcatcgacaaagtcggtaaatgtgctgagttgatcgtcgaactgacgctctacaatcttggctagacccgttcgattccgaagtaggagctcctgacaggcagctagatacacctcggttccgaagcgggtggccagctcggagatgcgcgttgctgccatgcgacatgccgtcaccagagccgtcagatccgatcgataccatgccggttgacgggagtttcgacatagcagatcgactaggtcactgttcatcacccctcgggagtagagcttgatacatggaatctggactccatcgtcatagatggaggtggcgttgatggacaggcttcccggaaccatgccgccgacatcggtcaggtgtccaaattgagaagcccagccgatcaaccgatgttcatgaaagatgggaaggatgataatcacatcgttcaagtgactgacagcccctttgaccatgtatgtgtcattggtaatgaacacatcgccttcttcgatacttcccgtccacacctcaaggaactccttgatgaagctgccgaattggcctacgagcatcttgccctctgcagttgtgatgacattgaattcgtcttgctgttcgcggatagcaggggacatgctgcagcgaagcatcaatttgtccatttcgccacggatgcatgccagtgaagaggctaccagagttgcgatgagcgggttactgtgcatcaagtctgctgctgagtctgaggtatgctgcgtcgttggggatggttgctttgcaatcggctggatgagaatattgccgagccgatcgatctcacctgaatagcctggaagaatcagtgtgttgctgtccatttccgtgatgatgcagggtcctgtaacccggatgccttcgagcgtgatcttctctcgctcccacaccgtcgctacctgttcttggccctcgatgataataatctgcgtgccaatgacggccgaggatgtaggctcgctagattccgctttagggactactggcagctccacatctgaggagccgtccacgagggttacgccgatacgcatcagctcgagttcaaagtcgggaagacaatagccaaattgctgttgatgctttttgttgaatgcgtcttgtaaaacgcaacgccaagcctgatcatctagttggatttcgtcgggcaagaggttgatggtgatggttagagcctgtcctttgtatcggacatcgacctcgtacgtggcaaccaatggcataggccagtctgaaccacaagactctcgcattatctgttcgcagtgtttttccagttcatccacctgacgttgcagttcctccgacgaggtatctctcacaagccgagtaaaggtcacggactgctcatgactcaacttggttgtcagatcgccctgtgcacacagaatgcctggagacggagggacaatgacgggccacgcgcctagaagctttcctacagcattggcatgcaggggtccagcaccaccaaaggcaacgagtgcaaagtctcttggatcatatccctgttcaacagagaccaatcgaacagcaccatacattgtttcattgacaatgttaattatgttctctgccgtttgtctgagaggaagatccattgccgtggcaagcttctgaatcgcggtctttgctgcctcggtatccaagcagaattcaccatccaatagagtatgaggcaaatatcccaagacgagatttgcatcggtgaccgtcgcttctgttcccccttttccataacaggctggacctggtgctgccccagcactctctggcccaacccgcaaggtctcagtgagctccatatatgtcgcgattgagccacctccagcaccaacggtatgaatatctacggccggtgcacgaactgttagggtatcgacaacagtatctcgacggatacgtggcttcccatccaaaatgagcgcacagtccgtcgaagtccctcccatgtcgagagtaatgaggtttttgtacggggtgcttcgagcgaccgcatcagccactcctttggctcctccagccggtccagacatcaagatattcacggggaatttcccagccaggccgacactcgtcaagccaccatcactcttcaacacccgaatcgcctcggtctccgacgccaactgctcggacagctcgcgcagataattctgcatcaccggcttcaccaaagcattgtacacgtcgtgactgttcgctcatactcgcccacctcccgcaacacttcactcgagcaattgaccgacacccccggcccacatacctctcgaattatcttcgcaacagcctcctcatgagcaggatttttatacgaactcagcaacgaaactgccaccgcctcaggcctctcccgctccatcaactctagcaaatcccccttcagcctctcgccatccacctccaccaccgtctccccactaaccgacattctctccgcacactgaaccaccctctccagcggcaccggcggctcaggaggggtgtaataaagccacgctccaaggcccccaggaatctgcgagcgcctcacagccagaatatctttatgcccagccgtgaccaccagggcagtccgcgcccctttgccttctaacacggcattcgtcgccgtggtggtaccatgatgaatgaacctaaatgtcccatcccagttataccgctccttgagaacccgtcgcactttcgcgatcccgtgtctaatcccgatcgtttggttgggcgtggtggggactttggcgcggactgtctccccgttcggagtgaagacgcacacgtcagtgaaggtaccgccgacgtcgactccaaggcggaattcgttggtcgatgccatgatttgaaccaattcgacagtcgttgtctagatgatgtcgtaaatgtagggagttagggagttaataggagttgggaatgggcataagcataggcagcttatctcaactcatgaggggtatgtcgagatcggcggaatagtcatctcttggctgcagatacgtgtgccgtgtatgatgtattcaggactttgatgggttcaacggaccggtttcttgaatgtcggatgtacttattgacgaatagggtcgatggtaagcatgcataagtctcggaattaagctactttataaggtaaggtgccgcaatgtagatcgttaccgctgctagagaccttaacaggaccatgcggcttagatagagagggtatgaaagtagtttcgcatatcatctcttatctatgaagggactgcgcttttcgaccagtcgatgaaaatatgttctggcccgggatgcaaacaaccctcactctttcccaggttgtagatccttgctaactcgaggacatcatagaaaccttaacgaaattagcttataaagttacactaaactctctataaaaataatcccaaggaagggaatagagcattcgaccacagagtgtggtcaccatcattcaagatcgttagtatcctagagtttctggtgctaaacgcttctatacttctatcgtattggatatccagtaggaattttcactcgtctccaccagcagtcgtaaatctggaactgtaatttctcgagtgcatcgttgcaattcccccgatagtaaaacaagtcttcctggtttaccctacgccccgagtcatgtcagtccggaagcgagaaatgcaagtcagcgatgtgaagcccacttctcgtccattcagttctcaacactccagccgtcgaaactcattccctccgatctcggcagaccctttcaacgtacgtgacttgctcagagcggtggaccagagagccctgctcaagcctttatacctgacgatcaaaaggatccgactaaggatcgtatcattaaactggaatccccgattcgaagtcaggaaaaggttaccttggtaatatttccggagaaaaaaggtcgccagacaaatgtgagtatcttcttaagatgtgtgctgtttatgaatatatcatccttttccaagagaagtacggctttggagtggtcagtaactttgaatatagcctcgagttgttgttcgagcgcattggaattgccgtggtcaacaaaaagctcacctgcagagatccgaggaagtcagcgaggtcacaattagcgtcatgtgtggctcttattgaatatagttaggggcagcttgatatattctgctgttgcttcaactgtagatgtcttcccgataccagttggccaatagtatgggttaaaatagaaatattgttatgcgaacaataaagtcaactcgctagtatatttacaaaattattgagcccttgcccttatccgtcaatcatgtcgtcgaagaacactgtcggtatcagacccaagcgggtctttgccatggataagacgagtatcttgttctcagccggaatttgcaggaagtcaactgattcagtcgaccagtcctgctgcaacatcgaggagagatgccacgagatagctgcatatgcgtgctcgaggtggtcgatgcgcaggcggagatccgcacgtgccgattcgaggtcggagccaatgtccttgttgcctgcatagctctcaagctcagggaggaaatgaaaaaaaaaaaaaaaaaaaaaaaaaaaaaaaaaaaaaaaaaaaaaaagatattttgttcgatctatttcatcccggttctaaatggtatgctagtggaaagagctcccaccctgtgcactctcgagtgtgacatttctcaaattcgactacttttgttaaaccaatttgcaatggatgctatccagcaatttctctacgtattccctgagccagctccacacaagggcaccgagcctgtcgaggagctatgtttaggcttgccacgcacagggatcgaatcgctaagcgtgggtttacaaaaactaggccttgacacgtaccatggttgggacctggtcttcgagcctcatggccgcaagttacaatgttgccacgaactagtgaaacggaatcaccacggtacgcgcgacggcgacatgcaggtcagcagcgccgagttcgaccgtctcataggcgacaggctgtgattgactccctgtccatgctgttagccccagaactattggtcgcttaccccggtgctaaagtgatcctcaacggacgtcgtgacgtgtcacagatcgttcgtgtaagcccgtagccctgtacttagcgagtcctcttgtggaggctattgcggccggccgtgtcaaccagcacggtcgtctcagctgcttgtccgctgccgttccgttagttggctgtcgtactcggttacggagcagcttgtagaagaggtagtagggttgtgcggcgttaagagagatgggtgggtgggtgggtggcgtaggggggtacagccgcattccagtgtccggcgcgaggctgtcgtcggggtcggggaggagagctggggcggcagccttgtggtactagccaagtcacctggcgcaggctggtgtgatctggtggcagggacggacggattccggagaacacaacgtggctgaatgatttagttgggggatctacccagagggttggcctttgaacattcaagctcaaatgctgagacgttttaaatgtagatttaaaacaaatttcactccctaaaactcgaacctgactgagatgccattgacccgtcaccttccaaggatcgcgacatctttcacactaggcattgattacctacgacgctagtatttgtttgttttgctcttacaggacgctagctaactgtctagctagctaggtacctagtatagtggggactgttcgagttcaagtgtcccatgtccgcgaatcatagagggcaggaccacgcacgggcacagtagtgggagatggagagggagacctagagcaggtggcctgatatgtgaatctacgcccaggtgctagatacgccttagtactccgcgcactgattagcattgtatccattgcatacacctgcccaggtgggtagtatcacaccgctagccctttaacactagttcaaattttagagagcctctgtcagagtatcccccatatagttacttcacccactggaatgtatcccaatgttgaaccccaaaactttgaagactgggaccaggggaactttcaaggttgtggaaattgtgccggtgtggagcccgagcatccttcggtggatctatgtataattgtattttacttctctacatatgtatgcaagtgagttctttttattggacaatcatagcttgcgtttgtcggagatatcgcaataacgacaataccgtatgggtacgtcacatactggagcctcttccaaggttctccactacactaggtaccccgggtcctgagtcctttaaaatccatctcatagaccaggtccgtttggtgctcttctactctcacatccctcagaattcacagctgaatcaatctttgagttggaccatccaaaatcatgccatttgtgcagactaagcccggccagtacgaccggccattggatgacctggaaatcttccatcgaaccatcggcgccacgggggcctgtttccaaaaggaacatatttcaccattagtactcttaagcttcgaaataagcccgagatacccgatttgaaacaagcgtggaaggctctgcggcacctccatccacgactcgcaagcgttatcgacgagacaggtactctatgcagatatacagtgcctactccagaagatattgatcaatggctcgaggagacttttatcgtccacccagaagctgaatacaatgtcacttccgctgagaaattggctcttagtcttcccccctctccgtttttcaaactccattgggtccctgcatcgcgagagcttatcttccggacaccgcattggcgcacagatggagcgggtttgatgatgttgcaagatgctttcttgacacttctgtcctcaccagccgaagaaatcaattttgatggatctgaaatctcgcgtcttcctccgacaatgaatgagttgttttgttctggttttgaggctacagaagagactaaaaaggcgtttgatggcgagtggcaagcggtttttgatcccagcctgaagccactgagttgggtcaaacacgctttgcctggcacaatcccaggatcgacagttcggctcagccacaaattctctaaagatgagactaagcagcttatcactgagatcaagaaacgcgggattaccgttacgaatggtatggcgagtgctttcatggttacagcagccaatcatgcgacccccgcagatggccgctttattttattgaaccctttcaatgtgcggagatatctcccagccccttggaatggcacagcgggtgcaggtgctacgtaccatacaggtcgactgcagagtttcaacctagaagacgggaaggattacgagtctgcttgtcgggccgtgaccgaattctataatcggggcattaaagatgcattcagctttatgccgttgcttatccaagctgctacttctttggtggacactcccgctgaggttgccaattcaggaaatgggtcagcatctgtagatctgagccagcttggcctcgttgacgatctacttcagacgcgttacgaagggccaagatatacgctcgagattgaggactggtggacgggtgttgaatttgtgaccaagaaactgcaaggatatacatggactcgtgatggtcagctacacctcactcttcatttcaatgaagcattctatccatccgaggctattgagaaattccttgaagagtggaggtcaattgttgtcaaggaatttcttcatcaatgagtatcacggtcaatacttgaatactgcatgtggagggatatttgaaagctctgccaagtttatgctgcttcataggtttatcttagcacatgattttctagtcataaagaggaattgaataggcaacaaactggtggctaaggaacaagaaacaagacggttaaaagcggccatcgggcaaatgcaattctttggtgtttactaccggcagtatgagtaggaagtccgattagatcatgtattacagtattagcttatctaatatatcttgtatagttaacgttaaagctgtatatatagcattagatagcttgtttaactttgctatgcaggtaattatcaattctaaatattataaaaacatataaatcttatccagaatatcgtatatagatatcctatatgttagaggcacaagcgcgacccgggaggggagaatcgagtcacatgaccaaagccgtgtcatgtgaccccctacttcgcacctcgctggagttcaaagcagaacggtagctagcaccttcgcatacaatcaaccttatcacgtctcctatccatcccctaacactatataactaaaatacagatatatattgacattaagaaaataagtgaaattatacttatctatataatttttatatataaataaatagcttatagtctagtaataatcagtatctacggagtactacagacctatctaaaggatccacgtatttcctatttaggaagtttgcttccctttgacaactttgtcaattgtatttatttttatttatatgatatctagcttcctaatttggactattattacccttttaggcttagtgacattttatctattcacttcctgattcacctcatttaccctaaccggcctagccccgctagatcaccttccattttcggactaacgttcctgggccggcccgacaactagaggatcctgtgaaaggcttttgcagaagactcttagttgaccttacccaatcttaccgagtgtactagaccgccttcataatttgcctagtacctttgacctcccgacatctattttataaaattaaaatatatactgattatatttactgtatttctccatatataataaggatatttttagtcataaagatatcaaataatcaactaatgcaaggatagcagatagctctacaaaagatataggtatattatataataagatctgatagtataacagtaattactttttgcagtttgaaagcttgttcattagtgaagattaatacacaataagcgctgacaactgacaagtagagaatttgattctgtaaacataataagcccgggaagtcccggagcatggagatatataatataaaatttgtttgggattattagtaatctgcgagctggagcagactagatttctaagagtagctataagctagcagcccctgtataacatgcggccatgcctcacttgatcaataaattatatattctaatattcagatcttgtcacaacaaataaaatgattacttgatagtgagtattctcagacttcaagaaagccaatggctggttatataataaataatcttacttggtagtattataatagcataaatcataatattatctagataaataattaatagtgacttgctagcttagtgcaataatctgaaaagaaaagaagaattatcatggtatatttacaggcgagaataatctacttacttttattcctgataatctttcccaattcctccagtaccatctcagcaacactcaacaccgacgttgccgtatccattaatgtcagaaacgggacatctacacccatcgaattaaagatatactgtcttagctccgctgataacatactatccatgccatagtcactcagcggcaacttcaaatccagcttcggcagcggcaatagaataatattcgacattttcttcgctattgcttgaatcaccgcttcgcgtagctgcttctcgtcgcctgacgccaacacagtttgaatgactgacgcaggggtgttaatcccgctttcggactgggatgcctgccgctgcagggcgttaataagtactgagaagcgggtattgtctagattgtgccagaaacccgtgaagccttgtttgcggtggtcttggagtttggtgtcttcgatgccagttaggatgtggcactgcgctagacgatctcgggggaccgtttgctgctggtcaatatcagatgataaagcaaagtcgacgatttgaaggacttcgttctcgggaaggggacggatgcctttgcggaggaggagttcaccgatttcgctgtgctcgtggagatacccgacctccgatatggtgcccaatccgagggagatggcgcgcagcccgaggctctggcgatagcgcgcaaacacgtccagaaagtggttcgcagcgcaatagttgccctcagtggccatgccgatctgtccagtgacggagctagtcaaaagcaagaaatccagagcggattcgcacttgagtttgcccagggcttggtggatattccatgttccacgcaccttggcttgcgtgcctgtaagccagtactcacgaggcatgtgactgaaaatggcttcgtggaggcccattgcggcctgaatcactccacccagaggcgcatcagcaactgccgctgctactgcgcgctccacgtcctcgtacgtagtaacgtcgccggttacgattgtacagcgtgccccagcctgttttagctcctggacaaaatgcctggcagctggtttggctagacctgtgcggctgaggaatatgaagtgacgggctccgcggttcatcatccaccgtgatagacttcgaccaagaccgcctagacagccgaccattaggtaggatttatttgggtttagaacggtagagtagagcacaggaaccgtggggacgatttgcgtctggtcttcaaaggaaattacgatcttacccatccgcttggcgttgttgaagtggttgcaggctgcacttagttctgagacggggaagacggccaagggctggacgggctgaacgtgtccggcgcggaccagctgcaacaaacgcgcaagaattgtacgctttaactggcgggccgcttcgggcgtgtcgagttcattcagcatgtttaggtcgaacgacgtgaaagtagttccgcgcgcaaaggtggacatattgagcttaccgcagtcgagaatatcgcgtttaccaatctcgacaaagcgtccccagtccgctaggcaatcccagctttcgtggaggaggtctcccaccaaggagttcagaatgacattgacaccgcgtcctctagtttggactttaatcttctctgcgaacctggtatcatgcgaggaaaagatgttctcggaacggagcccgaaatgctcgaccagataccgcttcttctcttcgttgcccacggtggcgtaaatgtcgcccaccccaaggtgttgagcaagttggatcgttgcaatgccaacagcaccagcagcagagtgaatgagaagcgattcaccgggctcgagacgtgcgcggtattcgagcgcgtacacggctgtaaagaagacgactagaacacccgccatgctaaccaagtcctcatgctcctctagcctgatacagctccaccaaggtactgtctcgtaggtgccaaagtggccgttatgcatgactgccactcgatcaccgaccttgaatgattgcacgtcggcacccaactccacaatttgccccgtgaactcagaactgcaagtggcattttttgtggatactcgaccggccatcacataaacatctttagcattgaggcccatacatgcaaccttaacaagaacatggtcggcgggcagcgtgggcgatgatggtcgttgcacaaaccttgctgagttcagttggcctggttccggaactaacaaataggcgttgtcaacctgagctagcggcttgggcatggggatgctgttgtgtcgtctcctgaattcacggttcaatcgctcgtcgggtacgacgcggctaatcaggagctgcgagccgtcgcgaatgtactcatagtctacttcattcttctgctgcaaaatttggcagacatcccgggaaaccactgacatttcagttgctgggtcaatttccagcgagaagattctggtagagggctgctcgacgatgagagcccgagccagaccggtaaagatagaccgtgtgggatcgaatccgttgtgaacaccactaccgctaatccagaagatatgggcagcatgctcgatcactttcttgattgcgtcatactcctctgccgttgggtctgacagcagggatttgtgcaattctagcaccgacacgaccagggtttggggcagaatgggtgagtggggaatatcgcgtagcgtcaatgcctgcacgggcatgtccaattctttgctcaaatgactagctagctttgagtccatgaaggaagcctcgaccagaagaacatggttgaactgtgaggtgaacttggggttgggacgtagaacgtgtacaccgtgatcgcgatccgtcagttgcaaatgcgacgagggcactggggctgggaattgagtgcaagggcccagaaagaacgtgcactcattggtatgcttcttcaggtggcctaccactgcctggctggttccctgccccaaaatgcacacgccgtactggtcatccgaggtggccttgcggtaagccatagagccaaggcctaaaggcacagtataattgcggacttctgcaacctccagcgctccatcgggacctattcttcccaaggagaatgtctcgaaacgtcggtagactacgggggcctccaggacctccaagcaggccaaggccacaaaggacaggtctgntgcgagacacagaatcctggaatcaggcttcttgtgaacaatcatatccagggcagctagcagccgcgagcgtgacccaaacgccccgagatcagtcacagagagcacatgagcaagggctgaagaaaagacggcatcttcggatattcgcgtgatgtcgggcttccggtgcacgcgtcccatgggatggcggacctcctccgtacgttcctgtgcgctgaaggcggtcatttcaacattttcaaactgtaccacaggctgttggttctgattcaacaagtatgtgctcgccctgtgcttctgaagtccgaccaccgaagccttggcacgaatgatgccagtctcgccaggagcatgcggggccaagctcatgctgacctccccgaggagagtcgggacccgggccaccagcccattatggaatccaccactgcatgcaatgagggcaagctgaagaacggtgtccagtagggtcgggtgcaggaagtatctaggatatagttgagcgccggtggggacttctggggcgaatgaactggtcgaagtttcggcatataaggttcctttgctttctggcgtgtagacctcttgtatgcgttggaacgccgaataatacttgaggccgcctcgagcaataacatcataccaaacgtgtttgcttcggccggtcagtcgacagttaggggatgggactgcgtgcgaagtaccgtcggggccgcaatccaaccggatcattcccttggcgtgaagtgtgtaggtacttccgtccaacacggtgaatatttggaattcccaccagtgttgcgaatcacggacgttagaaatgggaagcggacgaagctcggtaaacagctcaatcgagtcgtcgtctttcaaaggaagcgcttttagcaaggccacttgacgaaggatgacgcgtttgctagttagatcggtgcctgagggcaaagccttttgtatcagagcctccactgccatggcagtatatcctgcggcggggaagacaggggtatcgcccagtcggtggtcccggagccaaggtacatgatcgaggtgcaaaaggttgcgccacgcaaaggatgccgggcttcctccaggcacttctgtcccaagcaactcatgcctaggattctggcgataccggctctcccggctcgttcttgattcattccagaggggtttctcatagtgccaggcgtaagttgggaggtcgtagatgaatttagcgggagattcgttgcggtagctgcgcagtagcttcgagaagtccagcctgaagccatggacgaaaagatatccaaggaagctgagtagtgtcactgatccatcttgccctcgctttagtgtgccgtggtaaggtgtcgactgtccaagcgtttgaatgatggggagtttcagggctgtgtgcggtcccatttcgatccacaagttgggagctatccactcagacagccccttcagaccttcggagaaccgcacaggcgactccaggttgagtcgccagtaccccgtagtgcgagccatctgacgcttcaagggcttacagatgaccgtcgagtacatatgagtgttaaggggggcagtgtcagggacgatatctttggcaaaaatgccagccttatccaggaggctttggtagagcttacccacgctgaccatgtggtgagaatgataggctttcccatcagttttcaatatccgagcaaatacgccttttgcctggagggcggtaaccacaatctcaatactcccgcggtcaccactgatggtcacactagatggtgaattgatgcacgctactttaacgttgtcagcgaggtctagcctggtgatccagtcgaaagccgcatcagagctcaggccgacggctgccatggcgcctgcggttgatgcttgtctcgtaaccgcgtaccccctgtaatatgcaagaacgattgcctcgctcgcagagagcagaccagctacgtatgctgctccaatctcacccgaggagtgcccaatcactccttcggccaaaattgaccaagatcgcagcagcgccaccaatccaatctgaacggcggtggtgatcggttgtgcgaacactgcctggttgatggggcaggtgtcggactcgtccattataatatcgaggattttccattgaggggcgtgtggaagacccttcagttccacgtcgagctgatggattgtgctggcaaacgtagggtagtgtagcagctgccgagccatgccttgccactgagcgccctgaccggtgaatacaaatgctagtctgctactacctaactcaaggttggaggtagaaacttgtaggtttgccaccgtgatatcttgtgccaaggtctcttgtcgggtaatcacgtagccccgacaggcaaactgagatcgtctctgtcctagagtataggcgaggtcgctgactgagaggcacgaaagatcccgattggatagccgttccactcgacccttgagagattgaaggcgatttgcagagaagggaagtagatacggcagctgtgatactcgagccgtcttatgaatttccgcaccagttcccccagtccttattgaaacttgattctttttgtggtccgcttcctctataatgacgtgggcatttgcaccaccataaccaaacgagtttacactgatgcgatttggaccaccgcgggcggataatgggaagggggtcatccgggtaacgacatcaacaccccattcctcagtcttgatcttggggttaatgttcttgacgctgatagtcgctggaatctgtccgtgctccaacgccagggtagctttgatgagactagacaacccgctagacgcctcaccgtgcccgaggtttggcttaactgagccaatcaaagttgcggacgcccgttgctctttgcgaaagacacgcgacagggcctctacttccattggatcgccgaccttggtaccagtgccatgagcttcgacgtacgctgtttctgcgggatccagtccagcgcgtgcataggccttgcggatcacggccacctgaccgtcgatgctcggctgcgctatacctggtgtgcggccgttactgttcactgcggtgccacgaatgattgaccgaatagcatcctgattacggatagcatcttctagtcgtttaatgtagatggcattaacaccgtctgctcgtgcgtaccttaaagttttcgttccgcgtcagtcataggaatgagttaccggtgatgatgggatcggaagattggactcacccatcagcggaagtatcaaaggtatggcagaaagatgttggcgataggaacccaccctgggatactgtggcatgtagctcaggggactgaatcaggttgacgcccgccacgatggctgaatcgcactcgccattctgtaatgcgttacaagcaaggtggagtgcgtagaaagaggacgagcaacctgtgtctactgtacaacttggccctttcaggttgaagacatgactgatgcggttcccgaggatagtggcccccattcccaggttactataccgcgtcaagctctctgggtctttcgtctgcatggcaatgtaatctggtgtgaatgatgccactgttcttatggtaagtcaattgactcttgagtaagatcattacttggcaggcgacgtactataaaccccgacattggcaccggatacttcatccagggttacgccggcgctctcaaaggtctcaaatactacctctagcaccctcctctgctgggggtccataacagctgcatctcgattattgatgccgaagaactggttgtcgaagttgcggatgtcatcctgaagaaagtatccgcccaatggtagagtcgtgcccggctcatccttgctgcccctatagctatggatgttgaagcgatccttagggacctcactcacacccgagcggcattctctcaagaaatcccagagctgagcgggactggaaacatcgccgggaagccggcagcctagacaatactgattataatctcgttcaaacgcctgactttatcgacaatggtgataaggtcgaaacttaccaattccgacaaccgccataggcatgcttgtttgctgcgcagcggcaggagccaccggcagtcctggaactgccacggtgtctggcaattgcatagtaatagtcgaatctctatgccgtgctgtacactatatgccgctttcgaagggagggcttgaggagattgactacttacctactcaggttataactaagaggaaacttccgggctgattcctaggcacataaggcttgatatatatacatcaatcactgtggctccggaacgcaatgtaagaataatactagtttaccagtgcagtactacgcctagaagggtcagcattgatgtctggggcattggtttgcttccaaggcactgggagaagacgctcggagcgagaagtggcccgcccactgtgaatcgttcacatgtattagtcgggagccgggttgtcggtgcaagggacacagccgtgggttgtagaatgttactgcgtgagcactctagggagaccggggagacccactggcgcagcgcagtcagcccagtcatagatagtaatacggagcgtgaaatccgaaatggggtgattgattactgcttttgaccgccgacagtagtgcgccaccgcggatgcgcccgcgcacgcccccctctcttagccccattgcatgtcatgcgttttgaccagccgccggatattcctactccccctgtttcaacaacaactctctaacttaaattcctttatgaccgaccccttacctatccattttaccgaccaaccgacgtacttcacctactgaaattgacaaacgttgtagcaattcgaaaggtcgaatggtgatgttgtagctatagttatgggattctggtattactctgtttgagaacagcgttcgctagctcaataccttgaggtagaaacgaggattttgccagcagtctagggcgctcggaaggagcggttgaagatagagatcctcataattacgtagtatcgcctactagtgaactactaactgccagtcttgcgtgggggtcccagttgtgatgggttcaggaataaatgacccattactagcgtggtttgggcaattcccagggtttctcgcttatttgtttgtttttgtttgtttttttttttttctttcctttctttttttttgatgcattttatatgtcgctcagtcacgtgaacgggctcattcggtggcaagatttctctaaatatgactgcactgattggtatgtagctcaacgcggtctgataccctcctactatttactaattctgatcgcaccttgtgagagagccctcttaatatttcaagactagttacagagtatatattaatttgagacactagtacggagtacccctccgacggagcgcaacgggacgtagaaagtatagtcttaatctaaataaacgaatcaggtacgggtaagcatgcattcatctaggtgggcctctttcacggacgtctttgttgaaagtatccactgagaggtgcttttcgtaaatctctagactttaaagacaaggcaaagggagagtagtggactctactgcttgaaagttgaaagcctactatgtgggtccatggccacgctaagagacagtactagacagaaaccgcctgaacatcattactagaataggaaggagtattcaacccaagatgggggcggatatcttaaaaaagcaatcctatgaagcaaacagtacggccatctcttcgcttactgggtaaggaccaacaggaaagcctactataaatcgaattggaggcgggggggcggcggcgctcagatggacggaaaatatccctgtcatttcctataactaacgatgtctgcatgtcgcaagtgcaaaaggaggtttcattttctccaccttagtttgctaatagctcctttgtgagaaccgtcacaatttcctgcaggtactgagagatatgctctggctcatggtacgcgtcattgaagctgtacacaagctgcagttggtcccggaaggtggagatagacaacatattcatgcccatcacaacgtcgactccgagcatgaaatcgcgaacgatcactttgttggttccgtaagaccgtcgcatgtggttctcaatgattcccaggctactggggattgcgtctcttgggaaaggccccttttggtactccgggttctgagtgacagcaaacagaaggtcggtcatatgcggcaccaagggcagcttactgggatcatcggcgaaagtcgttcggtaaaactggttaagagcctgtgccgtgggaccgaacgaagatggagactccaggtgcacgggaaacaaggtgtaaccaagcgaggcagtgtactgcgacccatgtttgggcaggtaggggcggagattaaactgtgcagtattgacataatggcacgatggatgatcgggatcggcgtgcttcttgatcgtctcaatgtaggctgcatggaccgcggaagtaacagtgatgtttttcgctttgcaggcctggatgatggcctcagtggttcgtgtggggacatccagcctcgcatgctgcgactggccggccggacgattgccgaggttagagacaggccctatgccaggagcatgatcaatgtaaggcttccaaagtgccatcattctgtctgattcctcgggggtcggttgctcagccaccccaagaatttcacgaagggtaggtgccaatcgggagggttcatcgccgaatgtgatcttctccgcgggtggagacactaggatgcttagcagccggtccaacaaccgaatgaccccgataccatcaatagtatcgtgaggggtacgtaaaaccaattgagacgaggcagggaggtagtatagtgtagcctgcgcaataggtgtgatactggcgtacaggtcctccgcgttggcagctgcagatatgatcacggttgaggcaatccaagcctgcaaggctgtgtcgtcgggcacctcatagactttggtcgtgccgttgtggactgtggctatctggggctgttcataccgcagctgcacccaggccttcttcaacgagcactccacctcagttgccggcatgtccaactcaagctggagtttggtgaaaatggtgtaatgacgcctgccatcgtaggcagcggcagaaagagatgcggtaagggcaaagtagttctcaagaccatcgcctgggcgctcccagcggtgggctgacacttgtgaccaggtcatacctgcggtaattggtggtgagaaagggaagagaggagttttggggcgatgtgactgaagcgattgtgctgagagtgagaatgaaacccctccggtcacctttttaaagaacaccgccccctcagaagtaaattgcgggctgttgggagataggggcgaaagggcgctgtttcatgcaggcttagcggaagagactgtcgtaaagtttgactaacacccatctgagtcctactgatccttgttctttcagttctgacctgatgccttggggcttctccacccagccccctcagcgtcttttccctctccttcccctctttgctttagctgattgctgcgtaatttcattcggcctttcatactgccgtcagcattttggaaccgtaacgagaccagggtcccctgaggctgacagggaaacagacggtggaaacaaggcgcagctgcctccaacttcattcactccggcccgtccctgttattgacgacaaggccaggtcctacaccgtatcttatttattggctcccagcaaccttcacttttgtccttcgtcctcctggtcacaaagttcacattatttgccttagcttgctttactgtgctcttcatggcactagacatccctaaagatactcccgactgcggagaagggattttaatcacatcaatctttcttattattcttattataatatttacagtgcttcgggttgtcagtaagtttgttactcatcaagactggtggtgggatgacttcttcgctctccttgcattagtatgtatacttcaatcaacagaaaacatattacgcgtttctgactatattattctacgcagccgttcgagttaatcgtcctctccctcgtggtggcgtggagacaaatcggcctcggttatcatatggaggtagtggccgcaataaacccagaatatcttcttaccggcgcccgttatctctacgtggcaatttttttcttcgacggctcagtctgtttgccaaagatttcggccttgttcttctatgcccgcatatttcgaacaaataaccgcaccttccgcatacatctctggatcgtgggtggacttacatctacatggctcttggcagcctggatctctaccggtcttgaatgtcagcccattgcaaaggcctggaatactgtattaccaggaacatgcattgcccagtttcaatggtatttatcaacggccgctctctcgtgtatgattgacttctacatcttgttcctcccgattcccatgatttggggtctgcaagccagtctgaagcgccgtgtatatctcctgattgccttcatgatggcttactcagtcgtggtgttatcccttggccgcctcgttgctgtcatccaattcattcctatcatgaatcaggacctcacttggcactttgttaaatatggctactggtctattctcgagggatcgatctctatcatctccatcagtgttcctagttgccttgccttagcgaaggctctacggaatacttcagatccaaagatttatttggatagtaataaagctagtacaaactctcctagctatattagctcccatttcggtgagcaaaaggatactgtctcctggcagaatgggcactcgggttgcggcagtgtcgacaagctcgtttcagatatccatgtcagcccgggtgagtatgggcatcaccggaacttggatatcccacttggcgcggtccgcattgaaaccgatatcgaggtgagcaggcatgtatgatattacttgatacctgtacatacacaaatgggaatagtatgcaatttggatatattgttactactttgccaaatgacctcaaggctaggtaattgagttggcatcgccgattaggtacaggctaatataaccccgactctactactgtatttatgcgttgcggaatgtggccgttcaaaatgtggagagactccgatagattgatcgccatattgctgtactcagttgacctagcagatctagatatattaccagctcatgcttgagccatcaacgagacgtagtggcaaagatgaatagcggtagttaaatccactcctctttgccaaggttacgatattgaaaattgagatatgtaattactgtactgtctttcgagccttcagcaggtcttcagcttagcgggggtcgtttcgataggaatgatatgggaataagccagtatcttcttaacttattgacaacatgctctcagattttacccggttactatgaggaagtaagtgcaggcaggtagggaggcccaaacctcaattcgaagttacgaattgtatcgaaagactttcctgatccaacccataagtcttgactttgcgcggctctactagaatcttgtgagtattcaatctaattcaattcataatctcatacctgatcgagcccgctaagtaagaagctagctatgctggtactttattatttaaagcagtaatataacccgaacactgttgaattccccaagcttgcagtaaacacgtaaagcaacacatgctgtattatgttgagacatttgagtcacccctgctgcttagtagctattgatatatcgtttcagtctacttagcagatatctgttttgacaatttattttatattttttttattatttaagagtctgatacaggtagtattatataagttttcctgattttatgtaagattataccggaatatgggttcatatagttttctataatgatttaatctaattaatatactgttaattataagagtttatatttctataatcctttcaatataaaatcttataaaaaatatttatattagtggtaattctgttatcaaaatctgggtgaatttgaaactaagccccacaccagatagtttagcgcggtgagtgaattactaatgtacctttcatcatgattccctttcaaggttgttagggtcgctattattacccgcagagctatatgaggagtccagcccccctatctcaaacctccacaagtgcaccaagtgctggatcaatcctcatgccttccaaggcttttacctttttctacaccgcgtacaccctcgtcactgccccggtatggctggcggccgcggcgatttacaacatcccaaaattcctccggcccaatgctgcttggtcatggaaaacagcaattacgtccagtcaatcgactatgacaatgatttatttgacgactattcagagagcctggccaaagtcactggaagcaggcccattggggaatcaattcattgtgctcaaaccccaaaagaccatcaccacgaagaccaaagaaggccaaggatcaactcaatttgaagtctacaagggaatcacttgctcagtaccgggagtggagcccctacccgttggggctgtctggttcccggaggccccagctgaacctccacggcgactcatcattcacttctacgggagtgcgtatgtgatgttcggtagtcgtcccggggaaactggtgaagtaggtatcaatgaactcagtaaaatgtccggatggccagcgcttgccattcaatatcgcttatctcgggataagaaaaccacattccctgcggcactccaggatggaatcactgcctacgtttatgctctcgaggtacttaagatcccagcatctcagatcgtattcgctggcgactcggcaggcggcaatctcgtggtggcactgctccgctacatcaacgaggagaacccggcgcttccgttgcctcgctgtgcaattctgtcgtctccttgggtcgacctgagcactaaatccattgagaatgtgccccggaaccgcaattacaacgccgactatgtcacacaggattttcttgactggggccggaaggcctacacacctgaggggtgggatagcaataactcctggattacatttctaggaaacgagactcagctgggtaccccggtctttgtcaatgctggtacatcggaagtcctttatgatgatatcatgaagtttgcagagaacttgaggaagaagggtaatgaggttgaagtgctcgaaactcctaactcatgccatgttccttatcggcttggtaaggattgggacctggaagaagagcaggctatttgcttggcgactatgactaaatttcttgagaaaaccggtgcttgagtgggcagctgtatataggtcttctcgaagtgctcgagatagacccgtcacctgatcgaaatacattatctagatgagttggaacatttgtgcaacaccttatgtctccaatctatagagaatccatgcaaccttggaaacatcaaagtgcagacttcaaattgttcaagttgatatttgaggttacagagacttgtgttcatctatcccgcacatcggactgtctagtgggaacttttagccctctggatgatgcacaattagtcccaaagtccttcagcagagcgctatggtactgtaactaggctgtaggcaaacctaattgtctgggctcaccctacctcacttagcaactccattcattgctgggtctacctgtgataggactggacaccaaccaagccttcccagatgccatcaacttctgcaagaaccaatccagctccagcaaatcgtcggtaactgccttgagactccagagcgagacggagaacatccgaattgaaggagttaaaacagcgccgcgaaacatcgtcaaggcttttgtggaccgagaccaagatgtgaagctactccgggaacgatcggaatcgctgcaggctctcccgggagtgaagctccagcgagaacaatggtatcctatcaaattggatgcagtccggacaaccgacgtctttgacgacctgggaaaggagaagagcgacttctaggaaaatttcgctacaaagaacagaggttcttagattagattaatccagtggctgagcggtggaaaagcatacaggtcaatggcggtctatctggcgaaggaaagcgaggccatggcactcttagccacagactggtctatatcggtggcgaagtagtcttctccaaagtctttcaacaccagctccgaccagtgcgccgccacaactgccaacagtacggacatgaagcagccagatgtcgtcgcaatcgcatacggcacacagttccgcttctccgtcaactcccggccgtccgggccccgccaaaaaagcacactttcccttcctggtaaccaagatttgtcattttgcgcatacgccagcgctgataataactgatacgtgagcaattggtaatatggagcttctggaacgtgttcaactcacaacgtacaattaaccacatacctaattgggttagattagccctatataggaatagcgcataagaattgtctcaatatctcgctatatccaatgatgtgcttccaaacctttgtcgattttgcctcgtcaaaagcgtcaaatctcgttgattttatcatgcaataaccctgccaaatcttggataattttattcgatcatagactgttcaaagccttataaaatgctgattcttatagtgctattcttaatgattttatctgaggatccgctaataaattcgccatagagatcaatcggttttgatagtcagtataaacaggtgttctaggctcatgacaaatatgcgatcgacctccgtccagagataacccagaatggaagttcttgcgatgtcgtgattattcgctcacaataatgtgggtcgggtagtatataagaagattgaaaaatgcattctctaaaggacaattagaaggaacccaagttggctcatatcctcgctcctcgcctttatcgattagcccaacaacaaccatgaagaccttcacttctgccttgatcggtgctgctgcattggcacagaacgtcaattcctctcttctttctggccctgctggtctggaattccccaatgtgaccgggttgatgaatcataccgtccacgtttccaacggcggatcagcccattgcatctccggtatcgttaaagtcaatgcaacaaccgacaaaaacctcaagttcgcgtacaacttgccctctaatcagtcgcaagtaactcggacactcgtcagcctgtggtcgtcaggcggggatggctacgtgaaatccctcacgagcggcacccaacggatcaccggcagctacgatatcgaggcgacatattgtctgcctgcaggcgaaaactcaaagacaaccaaggtccagctcctcacgcacggtattggcgtggaccgccactactgggactttgcctcgggatatagctacgtcgacaccgccgcggccgcagggtatgccacattcctgtacaaccgtctcggcgttggcgcatcgtcgaaggaagacccattgaatgccgtgcaatcgccacttgagctggagattctcgaggcactggcaagcaagcttcgccaaggtacccttggtgaccgcgcctttacgactgtcgtgggtgtaggccactcgtttgggagcatcctgacccagggtgtcaccgcggcttacccaaagaccctcgacgccgcagtgttgacaggatttacactcaattcgaacggtctgcctggttttggcctgggtcttaatgcagccattgcctcggaaacccagccgtaccgcttcagtgggctctctactggataccttgtcgctgggacgcccgtgtcgaatcagattgcgtttttctacgaccctggttttgaccccgaaatcctatcgctggcagatgccaccaagggaagcttcacgctgggtgaacttttcacgttaacgcacgttatcaatgcaacgagcgaattccaaggtcccgttgcggtcgttgctggaaatgaagatttgcctttctgtaacgggaactgcagttctccgtccaatattttggctggtcttgtgcctgcgctgtatccggaagtatcagaggagaatactgctacctacgtggctcctgctgtaggtcacgccttgaacttgcattatgcggcgccgggtgcttttaacttcattcaggactttctcaagaagcacaatgtgtaagggtcgaagattgaggtttcatacaatcatgtaatatttcacgctgtgaccatctttactaattcacccccttgtcaaatttgatgtacatatgcgcgttcttcggagtagggttagcctaccacgtgcagccgacatcagttcatatcaattcacatacatgtatcagacaatgccattcaatctatttatccctaaacttacttgatactctgtgttctaaaacaggattgatcagtaaaccacagcggattatacaggtatagcagaagattttggattatattattattatataatccaaaattagatataatatctgcaacaagctcttctcatgtaaattgcacctccaacggcatgcatttgatatgcatgtgaccgtgacatgagttcgctctccacaaccacagtctcgttcccagtgaatcagatgcattggacacttttctttgaatcataccggcatgctttctttgcattattattctcgagtcacataacagatcgggacgaacagctaggctcttcgttaaggagtcttaagtgcaatttgcgggctggcatctcgataaatcataatgatcgtttcattaagctttcaataagaagcgccttagggcggtaaaaagtatccatcataatgctacccaattatcatgagtaagacatgttgccacggggaacgagagcttctgactgactaacacccagtatcatgcaatccaggacggttgaattcattatcggcaaaaaccgaaactgcttctcgattcacgctgcgttggcaagcttttcttccccaggaagatattcaattttcctatcaataccgaagtagatgatgccgacttaggccgttgctgtgaattcgtatttgtggtgattactccgttccgttgccaacttccgaactccatcaaacggatgtcaacgaacccacctggactccagtgagacggtggaaccctgcgaacgtttccaagaatatttccatccaatgtcaattgatgattacaaatctgacttggttgaataacctaactggtcgacctgtattggagaaaaaaaagccgcatcacttatcttgattcatttgcctgaagtgttcaaggagacggacggacggctcacatacccttcgattttcgcccaactattcacgcttgaagcagaaagatcaaccccaacgcagagtttatataacgacagacgacaacgacaaagctttatctgtatttccacttgaccttccataacttcgccatagacaaattaaatattaatttgcgaatcaaagacttggctggctgccaaccagtctattcgcgtacctactatccctagactccgtcaccaggcaggactaacgacttcataccaacacaacccaagcacagcacctagcacaattgcaaccgcaggcgggaccttgaaccatgcactctgggcatatgtaacagcggcaataacaacccaccagggctccttcgccagactctgcccatcacgatcctgcggagttagatatccgatttcccaaagccggtacacagctgtaaacactaatccaacagctgatgcattcacgcctcggaggaagtcaacaatatacttgtttccgcagaacacgccaaaaggactggattgcgacggcgagggtaattccaggaaagaagatccctagcccacagaggaaggcaccgaagactgtcgggtaggatgttgttcggacggcaagagcaccgagaaagactgcaaagttgaagtttgggccggggaaggcctgaatgattgcaaggccgatgaggaagtctcgactggaaacccaacccgggtctacgacgtatgaccggagcaaggggataacgacggggccgccgccgaagatcacagtgccagctaagtacatattcgcgaagagttcgagagatagaggcggtgcggagagtttggctcttgtgacaagaatggcgatgaaggacgctatggttcagggtcagccttcattcagcgataatgcaaattctcacacggaagcttaccaaagaagaagataagaattgcagcccctacacggatccgaatgatatgctcccatgcaggtgcggcttcccctccttccggggcctggatattggttgagttcgggggggatgcctctgcacctgacttcctcatccgtagcatctctattctagcaccctgttctgggctttgcatggacgaactctcgcggcctgccgatccaggctcgtcaccctccggttcgggctgccgattcctatttttccaagccatccttgccctgagaatttgttgatatatccaaccatcccacagtgccgtagtaacaccacccgcaaccataagaactgggaaataccagagcgcgctatagcagaggcctgcgcatgcaccgaaaataaccaggatgcgggcaatcttatcacggatggccttttcagctagctggacggcagcgagggcaacaatgcctactgtcgaggcatttagaccggagagaagagcgtagactgccgcgggcagtgtttcgtcgatccgttgcacgccgagagagagggcatacataccgactgcgccgggaagactagtaaaactgatcagcccatcattccgaatggcaagggacgcaattaaagcagtagacataccaccataggacaaatgccagtatggccgggatgaaaccggcgtgaagctacgtcaagcagaatagcatcttggtcgaacccggtcccggcaggccctgacagatagcgaaaagttcttggtacttttacctgttagcgcctgacgatcctggacgttattcatgcatccctaccgtctgctcatcaacccacttttcctgttcgacaaaccgcgcgtgaaaaatctggaaatgaaccggcggacccccaaaagacgtaaatcccagataccaggtatgtcgcacgacctcgcccaagcgttcaagaaggggctcttctgcgcgtgccgggtcggttgcgccggcatggctgcgccagctccgatgcagggcccgtaaggacgagataggccgcgaatgtgtcaggagcagcattttatattgggttacaactcgacatacggtaatcaacttcttcaaagcatgaggaaacacgaaccgaccgtcgttcaagaggagatcgagattatatcgacctctaggatagtgagctaattcagttgaacaaagaatttaaggttggaaatccacccgacatggatccaatacgaggtcggcaactgttcacatgtacttaacatacataagtactaggtccgcggtctgtcaccgcgagcttctaattggctgttgcttttcggggaactgttcgcgtttagttaaagaggccaaacttagtagaaaaggtgggccacgggttgtctgactgagaaggaccaatttgcttcctcacctgttcctaagtcgtcatcgttgcggacggatcaacgcgccatcagttgaacccatgatatagttctcagaatttattgagtcccacagcaaatatcgacagtcccgcaagaatcgggcgcaacactaggttcgagataagagatacctcgacggcgccaagaaaatgttctccatctgaatggccaatggtttcatccaggggggagctagtcgataagtaggttcctgggagggtccaacccatccaaagttctctcagtcttcctggtcaacagagctgataatcatagcgctgctccgagagaaatatgtcacgcaatacggcacagaaattaccacttcggcccgagatttgccgaggggtaattgagctgtatttagagctagcaagaccctggatggacagatagttagcacttttgttcctcaacatggccttgaaggtccatctcgtccgccacgccgaatcggtccacaatgtcactcatgacttctctcagttggatcctgagttgacccctcttggccttcagcaagctacagggctcggccagctattcccctacgccccccaggtgggtgttatcatcacctctccactcaaacgagctatccaaaccaccctcacggctttttcccatattcttgataaacggtatttcgaccccgactctggggacggagtggagaatggcgcagtccttttcttggaaccggatttgcaagagagaagtgcccttccctgtgatacggggtccccaactagggtcctggaagcggcttttccgagactaggtttccaggatttggctgagggttggcaagtgaaagaggacttctattctcccgccgacgaagctgtggaggagcgggcacagaggatgagatctcgtattgccgcagtttgcgaggatctgcaacaccaaggacggacagacgttgtggttgtaactcacggggtgttcatgaaattcttgtcgggagacccagacattgatctgccgaaagcaggctggaggagctatgctgttggaactggaaccgtcttctcgaagtgctcgtgatagacccgttaactcatcgaaatatattatctacacgagttggaacatttgtgcaacaccttatgactccagtttatgcggaagccatgcaaccttgaattgcaattaaatgaagtgacaccgcagcgtctaaaattatcatgagggccaaactcctcctagtaaacttagaataaaagaaaagagcatactctgctgagttattattgactaacagctgaataaaaataaaaaaacaaaaacatacaacagaagggattcgctggtggtcacccacccaactactaacctcccggcgtgtggcttaagtacggctgagcggacgggaagccctgttttccacaccctgtggtcgtatgtgcttgataaatagtatgtctgggttatatcatgcaaaaggatggtacacaagaacaataggaataatcatcagcacaatgaggttccctagcagggggccagaatcactgtaagttccgataacaaaacgtcctcatccgctcccacatatcaatgagatgtctcctttcaacaataaaatgcccttctcgaggataagtcaccatctcaacaggtacattgttgtggacacatgcgcgatagaacgcgatggcctgttctaaaggcacacgctcgtcgtcctccccatgaagaatcagaatgggagttttcacattacgcatgtgccataatgcgcttcccctccgaccattggtgtcgccaatccatcttttctcggggcttgtaattgagtcttcttcaccgggctttaaattcgtatcaacatcccatggggcaccgccaaccacctcaccctgcatccaatatgcatcgctcatcattgccatagagttccattctgatatacctgccccgcatatggctcctctgaattggaactcctcgcgagtgactgcaaaataggatagaaatcctccctgtgaccaaccagctattgccactcgcgcagggtctacgctgcccctagcgatactgtattggagcaggtcaatgcagtcagtgtagtcaactgtgccaactcctccgcgagcgtaagctgcatgagcttcacccctaccgctcccaccacggtagttggggcaaagaacggcatagcccattgatactaataccggaacctcgagacaatggcacacagcaaaaccggtagttacccgccagtatggtcctccgtgcgggatgagaatagtggggagcggcccatcctcaaatttgtatgcggagggaacatacatcattccgtcaaggtagtatccatctctcgcgtaatttgaaattgaccacgacttggatatttctagagcggcgatggaggaattatgggctgacaatttgactggaccggtagatttcgagatggagaagacttcttcaggatttgacccgtcacccctcgttattgcaatgatatcactactgtccgtagtttttaggacgtcaaatgagctcatctcacacttttcgctataggccttcgtacgagtgccatcatcactgatcgagaagaactcatcattaagatacctctggacacggtaggataggcaagattgatttttgcggagagtgatgcaacagtgtgcttcatcgccatcttttcgctctgtatatgaaccgtattcgatattaagttcgtatagggaaagggatgttaggcagtgcgtcgggacatgacctgcaatgaagaagacaccacagtttccccatgcgatctggctgattggtccggggaactgggcgactagtttctcctccgatccggagatcgatgtaatcaggatttctgcaccataaaagccagctgaattgatatccggccctttatgggcaacaaagcaaatctgtgttgaatcagggctccaagtgaagtcatgaacatgtctatgaccggcgacgatagttctgatctgccctgttgctacatgggcaattctcaggcgggaatattccaagtctttccccccaaacagttggatcatctttactttctcctttgaaacctgttcttccgtcttctcatccgaaactggtatatgcgatacttgtgccggtggaatcccattcaaaggctactattggcttctcgcagtccaccggcgttacgggatatgcttcgccgccatcgactggcaacacatatatggctgagcttttgcctggccggtgccgatccgatttgaaggcaatcaatgttccagctggagaccattgtggctgttcgtcgttgaataagcctgaagtgaactggcgactgctgtattctttgtcgactgtcgcgatccagattgatgaggtggcgtggtcgcctttcttgctgagaggttgtagtgcataggcaatcctagaaccgtcgggagagatggagagatcacgaggaacttggaggtcggctagagcctgcaagttcaactgggccttgtcgtttggatcagtaaccattttaatttcgagtgttgggttggaaaatcgacaggagaggggaagtcctaagataagtacgaggtctgagggattaatgtcgttgccttgctgttggagtcggatatatctccgattacttcggtgttggagacggagtccgggaagccctttgagcccacctaaccttaatagtcatagcgacaacaaacatgttccatcatgcaaaatccgacctcctatttgtgtcggtatagcagggctaaagctataatctagcttctgatcgagcgctctgcatcttatcattaaactcgggtccatatccagaatttgaccaattactccgccccctgtgcttctctaaccacgggaagtggtggccattcgggcaacataaagcgaccagagcaatatattgatgatcttaaatttgaggctagtcagcagtaatattatcgcaggcgagagggaactagtagtggtgacatctgttgacatcttgagacaatcctgtgtcttatttctcgcatatcacaccttatcctccaccgtaaacgttcgaagaacgctaacctgatgcttttgccgcacctctctgccgggcaggtttcccgtcaggctctcttgactaccggttaagtggcccctccccagcggtgtcgacacagacgtgataaccccgtgcgcgcgcgggttctccgcggacagatccggcctccagtacttcagattgtcttgggtgatcgatctattcggcatggagcttgacaatgcataaccgcccgcgacgtagtcttcctgccgcacgtaatgtggcttatccaagcggtatgacgaactgccatcgaggaaccagcggaagagcgggcggagcgtaatgaggctgccggcgatgatggcgaggccggtttccatgacggaccagatggcgatttggtaagtcgagtctgcattgtcagccaatcctgcttgtgatggagtcgtggagaagcttacagaggaagtccgcgtcggcgtagtgcttcaggtacgggagtcgaataactacagccacgctcgcactgttgccctggttagcttgtccccatttaggtgtgtggaaattcacatacactgctcccagcccgaggatcgcgcccaacgccacctttgtgcgcggcgacatgtgcagcccccagatcaacgccgctgggaagatcccaagcgtaaagtcacagacaatggaaagcgaactatagatgtatgcgatgatgaggaggatattagttggcaagcacgtgcccgaattgagtgggttgatctggccccaaaagtacccgattggccgacaatcgagcaacagaataagccagaagacgaggccaatacatatcacggttcctatgacggcccagagaatgaagcggtgcagtgggcgaacggccagtcgaaggagagcaagggcaatggctactttggcgacggctgacgcccacaggtagagcatttgtccaagccaccagtactgatagaagtcagaggaagatgacaaagagcagcaaggatattggtgaaacgcactatcatcgcatactgcaatgcgtgcagactatccatgggattcccactcttcagactgaacgactcgaagtccgcgagtgtgtgaccaatcccagcttccggtcccatcatgcacagcacgcccaatgctataaatagcgcctattacaatcagtcagtctttaatatcaagtgtccatcaaggacagatggaaagaatacttaccagcgccgtcaccacaagcgcgtcatcccacccaaacgcacgcagaatgtacagacgcacaaagcaccgcagcgagacacaaatgattgctaacccaactgtcacagccgagacgatgaaaatcgccaggctgtggccaactaaaggcagggtatactccattctgaccagcagaaagcggggaactcgtttggtcaaccgattcaaaaatcacgtactggagcagggggagaacgcccttatgcacctttgtacgaccaaaagggcgaatcaagaaaggaaaataaaggatcggatcagcagaaaattaaaagcctatctgctgggggaactctaagtcgtaacggtgcatatcggcggcagcagccgcgactcgtgtgctcttggactgggcgtcggcgatgaaacagtaagtctggctgggtctatggagtgtagaggttcgatttataacaccgaagtccatgcaagtgatatttctgtgaatatttcgaaggtttgcgctagaagagtcagctggagggccttctgctggatttgccaacaatgccatttttgtggtaacatcttccttggctatacgttgaagcccatagagctttctggttcgatatcgcttgttataaccctaggactgatgcagtggctgaagattgatattttaagtttctctgtttcgatagtgctttcccttgtttcacatctctataaccatctttccccccaaagttttacatgggctagaactatacaccccttctaatcaaatcgctcgcatttcaaaagatccgatcaacagttccccattcactgattgactcgatccaaaagcaaagtggacccaaatgcaacggagtttcttccataataggagatggtggggctgttttgagagagatgccgaaactctcctgactcgcgtcttatgaaaggagcttcaaccggatctctgcaaactataatcttgtgattttgtatgcgttgagctcggcacgaggccaagaaccgaacgccatgcttccaagtgcaaatttcttggtctttatgttgaagttgtgtgattactggggagtctgggttgacaatgcctggatgggattgaaatgccgagactgttgtgagcattctgtatgatgtttccaagttgctttcggaagacttgttgcttttgcatggagacattgatatttacctcgatcctgatcgagcgccctaatgtgttcggcgtacaacccgcgacaatcatgcattctccccccagttctataacagactcgtgaacacgggaacttcgggatcgcgctgtgagttaatgcatattctgattgaatacttagaatagtaatacgcagcccatcgagaagatggcgacgcgagttttcgcgtcatcggaaaggcagaccgaatccggataagacctctttccggcattggaagagtcagtcgtacctacagatttagtaggacgtaaaaagaacttaaaaatagccttgatctactgcatagatgtatatactaataccgtccgggagcaagcggggtaacaattaatatccttaaatttggttcgttcttcaaccaatcttgcggtgacttctatctttctctttgttctctctcacatactttatccagttatggtcagttcctacttaataatccagacatgttaattcgtcagaaacaggtcttacttgcctttgcttcccgtgtggcttattagtaaaagtgctggtcatacttcggcaaccccggctgtcgtgatgatgatgccgcccaaaccttaaaaacgaaccacaatcgtatccagtatggatagcaagggacatgttacaccgtatctcataatgacgtctagccacacacaagttaaagaagggccagagagccactaatatatttacgcagtgcaactggtgcgccttaattctttaacaatgactagccgctatattctcaactcttcccgccctatccttaggcctctactatctatcccaaaacaacaccgctccatatcccaatcccctatcatcatggcacctcgtatatccgaagcgatcaagaccgatcaccgcgagatcgaggactactacaacaagatcctgaactctgctaccgagaaagagaaaatcgaatggcaaaaccaatttacttgggaattagcccgtcattcgatcgccgaggagctggtcgtctacccccagttcgagaagtccatccccgacggccgggccatggcagataaggaccggaaggagcatcaatcggtaagtcatctatcatgctttcattaccaatccgttactaaagcaacatgtaggttaaagaacagctgaaaaaattccaaaacatgaaacccgcggacccggagttcgagtctactatcagggcgttgatgaaggacctctccgagcacatcaaggaagaagagagtcaagatctgccgaagctggaagacgccgtgtcggcggaggaaagcgagaagctttcgaagtcttttggtaggacgaagatgtttgtgccctcgcggtcccatcctagtgcgcctgataagccgccttttgagactgctatcggtttgatgactgctccgattgatcatttggctgatttgtttcgcaaatggccgcatacttcggggatgccgaatccttctacgaagtaatgtaacaatcatttttcctatgtgttgtggttatgtaaatcatcgtcttcgttagttctggattacgctggttatagtttggaggatatggcaagaatgacacatacgcaaaagtgcatgtaatttaaactcacctggtctatataattatcttacgtgcccggtctacaatccgtatctagtacacccggtgaattaatgtcaatgttacggcatagttatattgtagccatatgagtcaagcttataagtaaagtgcaccctatgtagtccccctctccatctctaattcctcactctcctgaccaggagccattcggtgcgcatcgcccaaccgtaaatcacgcaaacacagactgagaaggaatccgacccccgcgacagcagtataaaacacccacacccagcgcaacgcagccgtcaacgcatgaaacaccaccgtccgatcctcgccgacaggcaatgtctccacaatcgccgctgcagctgtcgacgcctccacgatctcctgcgcgaccgtctcgcccagtacggcagccagagcgccccgttgcccgcttacagcgcgcgcgtacagcacagacccgacgacgacagagatagcagcggccagctggcgcacgaacgaaaaggttccggtgccgcgacttaattcggcgggggtggtgttggcttgcagggcaatcagggtagcctggaagttaggcccgatgccgagtccggcgacgatctggaaaaggataatccgcggccaggacttggtggaggggaggtcgataaataggccatagcccagggtggtgaggagcatgcctgagatgatggcttcgcgtgaacggcccgtggtacgcatgacgaagccggccaggccggacgagatggcgagggctcccactagtgggaggaggtagacgccgctcattagggagctggcgagtaggatgttctggaagtagacggggaggtagaagcaggaacccaagaagacggtggagtggcagaagttgatcagtaggatgatgaggttgtacctattggaaaagagcgtcgtgggaatgatagggatctgggcgattcgggattcgtaaatgaggaagaggccggcggtgagcaccccaaagacgataagacagatgatcgtgggggaagaccagggatagagcgagccccctagttcgaggccaaagagaagcatgagcgtcgcgccgacaatgagacccagtccgatccagtcgagggagaggaggcccgccctgagaggggtgagagatgcagtgtgcagttgcaggaagaagagaaggccgaagaaggccaggccgccaatggggactgcggatggggtttagaagacaggcagctggagaaggagtgggaaaagggacgaacgattgatatagaagcaccatcgccaggtcgagtaagtcgtgaaggcgccaccgatgatgggtccgatggcaccagcaatcgcccaagttgccccgaaaatccctaggtaggcagatcgacgacgcacgttgaacatatccgacacgcagatattggctaatacagtgatgccaccgctgcctacgccttggatagcgcgacccgcgatgaccatgttgacgttgattgctacgccgcagattaagctgccgcccaggaacaatgcgacgactgtcataaggatcggtttgcggccccagatatcactgattcgaccccacagcggcacacaggaggcattggcgagcagatacgacgacgcgatccaggtgtaggcgctgtcggaagctttgaaatgggcgaccatctctggaagagcggtggagacaatagtctatgaaatcatgagaatttgccaagtagaatccgatttatagacacctacaatgtctagcgctgctaggaaaacgcacaactgtgcacaaatattaggatgtgtatgataagatacgacgacagttaattatatggacttgcgtacactcagggatgtcatcacaacggcgaccctttgcttgctctgatgatcagtgggaaagtcatcctcagctgcttcggtaggggcatcttttcccagatcatgcttgaaatggttggataggttatggtcctcttctaggtgttggtacggtcggggagagggatcttgctccgtattgacagccatgtaacagagactggcgtgaagaattgaaagaagaaaggaatgtgagagctctgaagaagagggaaatgcaataacaagtggaaatgatgaacgagcggattcgactaggtgctgtgcagaagaataaaatatcggaaaaagctgtggtgagatagtcttccccggacaataatcatcagagtccagaggacttaatatgtaggcagcactccttgacaccctcatgggcagcatgtggggaaatggatcgatcatcaatttacacaacgtcatggctattctaggctctgatcacgatgctgattactggttggatctgtctgtgtctaaggtggagaagaaggaacatcaagaaaggggcagcagagagggtttgcgctcggcacagacataagcgatgtctggttttctctactatgatactaaactattctatatggctactattcaagttagttataattcaatataatatgttcattgatacaaggggtgtgcctcataaaatcgctgtatcagtcctttactggaatgacagcattagggggacggacccagttggaaaaggtcctactggccgatgagccgctcggcaaatctacaggaaaaaattcaacacacgtggcctgcaattgtgggccccaattccctttctctgactggtaaatttaaagccggaattgccagtagacaatcgacaccggcccgtaccgtgagatgggaagagagttgcgaagaagcttggcctcgttactggataagcgggccatccacaggccttctagcagtcgcgcattcgaataccctaaaagcaaagaccggttttcccgcccctaaagccccatgatattggctgcacatgattaacctttcaaataatattcgtaactccgcaccctacaattgactccatcgacttctcagagtctgaactgcagcctttggtttcctatccctggtaaagacccccttcttgttcccgtccaccctgccgacccctacgaccgcctgaaagtccgcaaagttccaaacgtgctctcccaccactgattcgacacggtcaaacactcgatggtacatgtcgagcagttcgacctggaactcctcgctccacggaagcccaagcaccgaatggaggccagccaaggtatccgccccgtattctgtcatgacgatgggtttgtcgtatttgccctcccagcccaatagctctgtttcgagagccgcttccgcctcctcaatctcaccggtttgcgaataccacccgaaatagcggttgaggcagaggacgtcaaacatatccgagattcgatccacctcatatgtggcgtctccgtaatttgcaaaacagatggggcgatctgagtcaagctcgtgggccaggtcaacgagtggcgtgaaatactcacgggctcctgcttcttgtgatgcaggctcatttgcaatcgaccacatgacaacactggcgtggttcttatcccgagcaatgagctcccggattgcttgcttgtgagcttcgcgggtgttattgttgatcccttccggggtaaatgtctgtgggctgtcttcgctagaaactccagccccaatggagtacgccaggccaacggcgggcgtctcgtcaatgacaacgattccgtgccggtccgcaaattccatgacctcttcggcgtacggataatgcgaggtgcggaatgagttggctcccatccaattcatcaactggaaatcgtgcaccatgtacgctgcgtcatagcctttgccgcgcacattgctgtcctcgtgcttcccaaagccggtgaagtagaacggcttgtcgttgatgaggaatttgttaccgctgactttgactgtacgtacgcccgtcgcaacactataagtgtcaagtatactgtcgtccaagcccacgatgctcacccgaaattgatacagatatgcatctcccggctgccacagcctgacagagtctattgtaacattaccatgagtacctgaagcttcggccacagttctgccgtcctcatcgaccacgtcgatcttgatgcgctctgtagtcgcgttggtcaccgtgacgaggtattttatctgcccggttgcgccgttcacgtccgtgacgactttgatatcctggatgtgctgcttcggaacagaatacagcgagacggagcgcgcaagtcccgcgtaattgaagaaatcatgctggtagacttgcgtctttttacctgtgtattccaatacttctatcctgcctggcggaatagtctcgtgagtcagcacgttattgacagcgatagtcagtcggaagctgtcaccagcagagacaagactcgtgatatctgcttcaaaaggtgtgtagccgcccacatgctcggcgactagatggtcgtttatatagatacgacctttgtgtgtggcggcatcaacccgcacgagatattgctgctgtgaccagcctctggggacaatagcttggcgctggtagtaaacccatccgacatggtcatggatctgacgatcgacaaagatgtcgttataagaggctggaacgggacactccagatcggtggctaatggagctgtccagggtgtcgccgtctcattatcgctggaaccgagagcaaacttccaaatcccgtcgagggagactatatctctaaaaggtgtttgttggggcttcagcattgctggtctctgctggaccatttgacgtgggtgaataagtgaagggttagaagatacatgctgaattagggaaagtattgacaatcctaagaggaccttcatcatgacagagtcaagggagaaatcaccagttttctcgacatcgccaggagtagctacatcggtgacgacgtgagctggtaattggtattaaatgatagaaggcggcaattgactgccacaccgtcggctgttgatgcacttgtcatgttattgcttggcaaggactaattctttaattccaacagtaatatctagtcaatgctcccttggcagcattgccaagcacatgtctcttttattctttgcagatgtggtcccgaaatggacccgaagagggtccaggatgcagccaagaaccaaagtgcggagaaaatagagtttggtgccctccaacccgatggataccgtcatcatcaattgccgaccaaggatggactttcttgaatgtctttggagagcatgatgcttccagcgaggcgatagatggcgaccctaattgatatcagtccttatacgtaccacctagctgtgactgtgtcagctaggttgtattatatttgaaagtacttgacaataatagtcataggaattgcattactcaccttcgcaggaatacttgtctcttgtcattccattgaactttggactctattatcatggaaatgcaattctcccatttgcgtcggcgtagcgaggctaatatgaagaaaccttagcctctcaccaagcattctacatctgatcattgaataaaaagcttcacctgcggtattatagcggtacaaataatggctgcaattttcattgactgacccgtttcaattacttttgaatcaatcgatcaactattgggtcacaaggaacaaggacatggtatcagggggaataagatgtggcattccatgagaatggaatttttgagactgagatcaaccagttgggccttcacggccggatgcgtgtagcgacgaagacgtaagcggatgagtcgaagatggtcaaagtgaatttgggtatttctggtgttcacagatgaacagcactaggaaaagtgatgagcagtggatgaaccggctgaactacgttgaccacggccggtgaagttaaacattcatccatgacatgctataccaatgcattgaatgcacattttttgtgcgctgattaacgcaacgcactgggcgtcactgtgtagaaaaatattacattcacctttggggtaaactacgtaaacagattgggatatttaatcccaccttttacccccccgaaatgccttcccctttctcctctgaacatgatcgttgaatcccccaatctgatgagatgtacctgggtcttacctattatacagatccgggcacttcccgtcaacgtcaggtactccggcatatataaaggtctccgtgttgtcgtttggaatcttcctaccactcggcaacatcgaaactcaagtgttgatcttttacatttttacaaacatgtcacaatggcgacacctcctcccacagatacaacctcacttgacaaaacagtcgggaaaagagaagagctcctgagcgacacagcaatgacaattctaactcaacttagtgagacatcgaatatcttcttccagccatcctgcacctaacaggacagacctttctgttatttctcactcatcctcgttgcggacatacatcagttggcaagttatatgtactgggcaatttcgtgccacggtggctgtgtggagttttcatcgaactgtacaatgtccatttttgaatgggatatcgctatattctacggaaatggacatgctcgggcattaagatccatcaaaagaccgcagacttctaaaagcaattatatacatactggagttacagaggagttacagaattgtctagaatctcaaaaacggacaatcatccatattgaacaagacgatgctttaagtgaccaacagcatgaatcacatatgattattcccagaatgaaagcccggttggagagccgcaaaggatgcgggtatttcgagagctaaagggaataggacatgttgactagaaagggagggccatgggagagttgatgaggtagcacagtggcttccaccagctcttctgttgtggattatcttgtgtctgaagatatgttctggtgagtcgactttaccacagcaaaggactgcgattaatgctgaccgagattagcttcttgatagtgctctgctacggcctaacaacttccagtacaaataaaaccgaaactggatgattattgtcttcttgttgtgacgttgagacattatgagcacttgtttgctgttattgggagaacatggctctatcagacatccaaatttacagcagcagtacagctttaaactcagttaagacattgattaccggataatgtctttcaggaaggagaatagtggatgcactatcatttttgcagacatgtgatgatcataaatatattttgatatgatgactgggctgtggctcgcattagagcttggttgtgacttctgaaaggtacgtgaatgtattacccttccaggagagaacgagaacgaatgaacaattcacttatccaatacatgtttgctaactatagagcaccttaggctcacatggcaccataacatgctcgatattgctcgctgccacaaaatatctttgttcacggccatgcactctgcctggttcactggttcacagtctacctacttgctgccccacattataacttgctcgctgccacgagctctctttgtttacaaccgggaatcctgcctttctcgctgccgcagaaggatcctacttcataggctttccgtatacagcctacttctcagggaattggcccatatcctccctcacgaatggggttgctccaaaggtataaagcctttctcccaccatgtcggttgtctcgcttttctttactctcccagttcccactgctctgctcagacattgttcgtaacaatggtttgggacgagttggataaggttttgctagtcataggtcttattggctttgctatcgttctcaaaaacgaggcacccaagcttcgaaagtggtatcgcaagcgacaggacgccaggcctgatcaaccgggcgcctctgtaatccagcggctggcagcgattcgttcgccacctccagctttgctgccgatccatttacatccaccaatcgaactcgacttctgggagaattaaggtgcccttggggaaggcactcgtactgaggacgcagggaacggggagatcggatgtggtatggaaatgaggcacagtggtagctgcgtgaacatttcgttggcttgggaaataatctctgattgagcggttggtagagtttgggggcgcccaccggtgatgagtctacccttctacgtagggccggtgattagtagccttcgggcgaagctaagatggactcagatgtaattagattgaatgcaagtattttgtattttgcatgtatgttcttcttctcctagctctttccaacggtgttgcttctctaaactcgagtttgagaaaaccgggttatgagaaacgtaactcgactattcatagccgcagtcgtgcagtatccatcttatatcgacccataagtgacgcaagcagagcggcaaggcccgagagtgctgctaccaacaagaatacatctttcagacctccaaggtacgcagtgcggagtgctatacttgaggccgaatcgatggcttgtacacgcacaaggcctccggtgagtatttggttggggttcacatcggcaacagtcatcatgtccagattccgcttcaccttctcgaggaatatggtctgccctgtctgcataaataccgaagcccccagacatttgaagaacaaggttatagatgtcatggttgacatgtccgattcatcgacagtagcctggttcatgatgattggtacctgaagtgcggctcctatcccaagccctgctaaaatctggtacgggatccagtgactcgacagcgtgacaagatccaacgtgtatagcagtccggctcctacactgatcagcatcgcaccaaacagcaagaacggtgtcgggtagccgctgataccaaaccctatcgctccaaatactgccataacgccagctgacacgatcaatggcagggtgcgtatccctgagtcctgggctgagttacctttgactgtctggaagtagatgggcatgtaatataggagcatgaaaaacgcgcccgccaggagaaaaatgacaatgagattgacaacaacttctttcttgagaagcaatcgacgtggaatcatcgcccggtcatcccagaagaattcattcgtgatgaacagccctgtgaggattggaaaaccgaccagacatccaatcacatctctatcatgccaggacttgctcactccccactcaaggctgagtagaaaacagagtaatgcacctcttaatgtaatgacccccggtatatcgagctggaggatgatctctttccgtgatactcctacattcgcgcgtcgaaagggtggccgaaataagaggaggaggacagcgaaagtagctccgccaacaggtacattgatccagaagcaccatctccaagttaagttgcttgtaaattctcccccgataacggggccggcaaagctggcgagcaagaatgccagacccgttacgccaaccagtatagggcgttttttgggtgggacgcagaccccaatgaccgtatatatccccgacccaatgcctgatccacctattcctgcaattgctctgccaattatgaatgttggggagttgtgggaaatagcacaaagcaaagaccccaactcaaacatgagtaggctgaggaggtaggtccatttaatatcgaaaagtccgtatagttttccccatggtgcttgagttacagcgcttcccagaagaaatgcagctccataccagccaacatcagcagtggagttaaattcgtctgtgatctgaggaatagcggttgagataatagtcgtgtcaagggaaaccaggaacatggccacagctaggcaaagcacaatcacatgcaataacaccccatcgatgtatttctcatgtgcatcagaatctctgtcggtatctcgatgactgactactttggtttcatgcagcggagattcgctgtcaacttgtgacgttgctgtggtcggcggctttaacgccgtcaaatcactgggatctgatggcatcttgcggccttgtcctgaagatgcaaaacacaacagctgcaggaaggactcagcacgaactggaatgagcaaggcgaaaaaaaagtctaaacaaatgggtttgcttttagtctttcaccgctgcctcggagaagtcaaagcatgggtatagacactttcagaatgggctttcacagaagaaattgactggtaaaatgctaagtttaaaatttgcatagcatggccccaaaggattgcttcattaccaacgcagactagggtggcccttcctgtcctcacaaattaccggctggctgggaaagcttatcccatattatcattttaatcacttcaaaaaagagtaatgatcgtccaagacatgctcgtttgcgatttacccctgcaattattttacaggtcgggagtagacacattactccgtacagtcttaggcaatgtaagtcgaacaaggactcctcaggattccggacccacatgtctcgatctatgtggctgcctgacatgcagagttgccctctctcctcggaaaggccaaagatatgatgtcgatgagctcaggtatatacgcgaaaacatttcaatcgagtcttttgtaatcgcagacggttctgattagtaggggtttaatccaagtgtgggaacttgtattaagtatagtattcatctgcttcaagacatgtctatctattttccattaagattcttcagctcttaggaaattacgcaagaagctatcgatatgcagaatcatacaagatgatgcattgagacacctcagaactaacgtttcgcttccgatcggtcagatctttagcaaatgaaaatgtcctcataaattgtatctgacggatcacataacaaggaggcaacgataacaacatagcgggccataatatagcattatatagtagtatatttgttttcagttaattattaggttttttcttttcttcttctttccgaagaaggaaagaaagagaacgagacttacagattcctgctttttcgatgcatggtaaatacccactgaagtatcagccagccatttcactaaagagtaataagtgaaaagatacagtcgataccccttacagactccagtgcaaaataaactttggtgttagctatgcaggacctagataccaagaacaaccattgttcatgaaaggaagggacagggaaagatgggaaatactcccttgtttcctttcttttcttttcttccctgttttttgttcattcattattactcttacaggaattatgaaaatatgatacatggatcatatctagtcaacctggctgaagttttgacaatccctcaagatctgtctacagccacctttctgattatctatgctcgattgcagccacatgtttactattgcgttctatcaagggtttattatatttattaatgttataatcgagttatcacctactccatcagaagccgagaaggaagaagatgatgagaaagatgaattctgcaagttctagacaactatactctccaccagtgggccggcccgggcaattgtgaaaggttagccaggcacaaagatgccattcccttgcactcacatgctccactgtagagtagacttgtgttgactgggggactcaggcaccgtttgccaatagtactgctttgatggtggatcaatgggtccgggtctcattcagctaactttaatgcccccttgagtggcaagtccggctaaatagatgctggacgcccgctcattttaccaggaaatcagcaagccctgagcaaactcacaatttacctttctttggataccatggcacaccaagaaactatggccagcgaaacttccatatctctacataccctggcttgcgatgccaccaagctcgccggcacatacgcactgcgccaagtgcgggaagatggtcattggtacggtgaaatgaaatccaatgctactattacagcggaatatgtctttcttgcgcaagccttagggttcagcattgaggaagaccgggacgatctcatcaagtatttcctttccgagcaaaatacagacggttcatggagcctggcatatgactttcccggggacgtttctgtaaccgcagaagcctacttcgccttgtgcctgttgggcctcgaccgcagccacccagcgatggcttcagcgcgcgagttcaccctctccaaaggtggcatagccaaggtacgcgtgtttactcgcatgttcttcgcttgcttcgggctatttccttggtctgcagtgcccgaattgccagccgagttgatcctactccctgctgcagccccgatgagcatctaccagctagcaagttgggccagggcgacagtggttcctatgctggtcatccgacatcatcgtcccatttatgctttgccaaatggaagatcatcttcaaatgaatatttggacgagctttgggtcgatccaaccgacaaaatggtcccctattcgccttctttgtggtcattatggaacgatgatcttacagcatttggcttcactctagccgacaatattctgaaagccttaggtggcctgcggtggttcccttcaagaaaaattgcacttcgacattgtgtggcgtggatccttgaacgccaggagcccgaaggcgatatcggaggtatcttccctcctctgcatgccgcattgtttgctctcgcgctggaaggttatggcctcgagtctagccctgtacgtcgaggtattgacgcccttcaaaacacctacgcgtggagagacagcactggtttgagaatacaaggctgtatctcgccaattttggataccatcctcatgaccatcggcctgattgactcaagccttccggccgaaagtcccctcgttgcacgatcgtcacgataccttaaggcccaccaacagcttggaaacgagggcgattggagggtgtataacggaaatgtcccatccggcgggttcaatttcgagtactttaattcgtggtatccggatattgacgatactgctgcggcaatcttggcgatggtgaagcaggatccaaacctattagacttaggccccatactatctgcagttcaatggatcctgggattgcagaacgatgacggtggatgggccgcattcgaccgggagaacaactacctgttcctcaacaaaatccctttcagcgacatggacagtttttgcgacccatccaccgcggatgtgactgggcgtgtcattgaatgctttggcctgttagctaagaggggttctgtgctgtccagaaatggtaaaaacccaatccctcggttcttcatcgacgacatgtcctcagctactgagcgtgcaatcgactttctttcaacggaacaagaggccgatgggtcatggtacggccgctggggctcgaactacatctatggaactagcgcggtactttgcggtttggtctaccacttggaaggctgggatgatacgtatcccgtcatggaaaagaggcacaaagtggacactcatgccgccctggactggctcaaaagacaccaaaatcccgacggtggctggggcgagcgcctcgaatcctattatgaacctcgtctcgcaggcaacgggccatccacagcatcgcagacggcctgggcattgatgggcctgcttgcatatttagcccctacagatgagtcaatcacccggggcattcagtacctttcacggacacaaataaaggagggggaactggcggggtcttggaaggaggatcactacactggcactggctttccaaaccatttctacctttgctataccctgtattctcaatactttccaatgatggccttgggtcggtataccagtttgtccggttacagaccactagaaaatctggaaagcacagtggaagaccataaaggcaactctagtgactgttgatgggtagggtttgaccgacccgatgcccggtatgttaaatttaatatcaaacttattagccttcgtagcaccgtgaaaacttcacagaaactaatcccaggttttgacctaatggatattgggaacgatgtggtgtttggcaatcggtcgtgcctgggcacggtggacaggctgggcaggaagcccattgtcatcaaagatggggccatgctgggggaccgatctgtggggcttccgagggtaaacattggaacgcgcacgatggtgggctcgggtgcattgctgcggcggaatggctcctatctcgatgaccgcaggagctattgccagcgctggcagatccagcgcaccatcgatatcctcatcgaggagtcttttggcgggaggggcatccctgtcgttaatcagcgggacagcgtacctgagctggttctatcgggcgatgggggccaagatcgggtctgattgtgcgttgagcgccaacggggaaccgcacatatttctcaccgagccggacttggtgacgctgggggatcgggtgacggtggatgatgccagcctggtatgccatctcaataccagagggaattttgagctgcaaagaaacaatggctctgtggggcgtacattatggctgagtgggcaggtatacaggtaccaatctaacaggaaatgctgaaataatagtaggatttccacttcagtatcgcccaagtagcagctcttgttcttccagcttttggcagatgtacagccgcccaaacaaaagcttcatcctccttccaatcacacaaaaatgcccataggaaagtctcagatttcccccttcccaacgcacatattgttctcagctactacaccttggccatatttaagccaaggcatgatgcagggaataacacccctttcaaaacatccaaccaggcagaatacgttgcaacacaccacctgtagcagccccggggtgcggcagatgtcccagcggatggtctgcgcacttgcgcacatccgcgagagtgactccttcgggaagatcggctgggtcgactttcattactccgagggagccgcactcttcttcgacactgaggtcggtggatacggcgctggtggcgtagatggtgagaaggaggtaggtaaggagtctcattttggggtgtctttgttcgaggtttgggtgacaataaaggtattgattttgctgagggtgaaggtgggagaagagagagtatgtagattttagttggttttactagtagtagtctaactgtgtggcggccctagggcgaaatttgctgctgctttaaatactggcgtggaaaataaacagacaacgtggcaggactggccttgacagttgcctgctgtctgtacgacctattcctttgttccatggtgtattgatagccgcctggtattgatgggtccaagtggatggatgatgccaatgactcatgggaatcatggtgattgatttggtaggttttaacttgaggatttgatctacagggatacgattcccgtgaatgaaaccaacactcggtgagacttgattagttagtctatatctgtctgactacttagtttctcttggcagggtccacaacacaacatgacattcttataatgacaagtaactcaggacaagcctggcctattcgcagtggctgactgaagtcaacaatatgagagctcaggattcgagcaactccctgcaatgaatgtttgtgacagccgtggaaggtcgggttcgaagatctgtgttgatgggtctagaatacgatcgattatatgcaccacaccctatgtctagtattaataagaggatagtattcgccggtattgcaaggaaggaatgagttcgtacactagtaaccgggatatctgattccaccacatttgccacttgattaagaacaatcgcaccatcctgcatttgcgatcccacaaagaggtaggtggcagtctaagctagacatcagttgattacattgtaatcggacgggtattctcacctgaaaacgctgcaaagtctcattgaaactactcgatgtgagcctagagttaggcacatagtggtgtatgatggtgtttcccagccaccatttccctttcctatgcaggatcagcaacgttgatgcaagatcagaaagattgatctgacatacggagtcggctcaaaactatcaaagtatgccccggtatataattcaaaggcatcgttgttcggtgcaaagaatgtaaatttccaatttggatcggtgtcaaacgcttgtgcaaatccgccaagttcatcgattttctcagacaggatgcttaagtccgaccgagatttgatgaaatccacaagagtcgtcacattcaaggagctggaagtgacatagccggggatgtttcggtagttcagaggatcagttgtggctatgactggactaatcaaagaaaggagtcctataattggagcgaatgagaatatcatattgtgagtctcgttatctggataagttgaggtaacaacttcagcacgcgagtcctgggaaaataaagagatacctcagaggcttcatgatgcaatttgttcagggtcactagtttggccgctggatctcccggagcatctccgcaacttcatccccctgacccggccaatgagattataccactcggctgaaaggctgcagccttattagctagtatctttactctacctagcccctttactccggtggggattccggacaagctccggaggttgcatagaaaagatctgctgcagttgatctcttataactaccccaaaaatggcttcccggttactgcacatcacgtacccttgggcaaacccggcaacatgatgaaacgcaaatctcagctgtcatcattcaccttagtgacggcggcaattttaccttttgcccattttgtgatgggaggcacaagtctcgcacaaaagcctcagatgggctggaactcatggaacgcattcaaagcgacggtcaactatacgatagttcaagaagttatttcgctgttcgatacgcttgggctgaaagaggcgggctacgagtacgtgctgcttgatgatggatgggcaagttacaatcgcacgtccgacgggtatcttcaagccaatgcaacatcctttcctcagggtattaaggcactggcgcaagaggtgcacggtaagggcctaaaactaggcctttatggagatagtggtcattacacctgtgcgtggagaccgggaagctggggatacgaagagcgagacgctcaaacgttcgcgggctggggcgtcgactacctcaagtacgacaattgtggcggatttcagtcgatgacagaggcccctcagatacgctttggggcaatgaagaatgctctcacgctttcgggtcgagatatcttctattccgtgtgtggatggggttatcagtttccctggcactggggaggaggtgagatacaccctgcaaaccaaccaatcttctaccttaagatactcattccacccgcctgcagatattggtcactcatacagaatgtctggtgacattacaacaagcttcaccaacgaaactgagtgccagtgcaagaccgcctactgtctcaataccgggtatgccggttgctcagtactgaccatcatcaacaaaatgaaagaaatcagccaatatcagacgccaggtcattggttggatatggacatgctagaagtcggaaatgcaaatttcacactcaaccagcagcagacgcactttgcattctgggcggcgctgaagtctcccttgatcattggtgctgatctcagcaagctttccaatgacagtttagctgttctcaccaacaaggctatcatttcgatcaatcaagacgcgctgggggagcctgtgacgtatcgcgaagcacatagcaaagaaggtctcttccaggtatgggctgggaaggttgaggacggatatgttgttctgctgctgaatgagaaaagctatccgcaaactgtgtctctgagctttgccagtttgggacttggctcacctcagaaggtcactgaactttggtcggggcagactttgcaggatcttagtaagttcaatgggactttggggtcttatcaaactcttgttttcaaagtgaaggcatgaaaaactgaggcatggtgtggctttaaactgtcaaccttcatcttcataacatattttcttattatattcgctggaagagtctgtagatttctgcaaacccacaaagtagacaaatagacatattgaatataaagtaggcttgattatgtctcaaggctgaaattacgctcgattgtcttctaattgcccgccgtattcccaaataagacaagtttgaggacggcaaatcccagtaaccacaattgttaaattaggtgaaaagcatgagcctttgagcagagatataccactacatcccattgtgatctttctataagaaattcgtacacattgcttgtgccaaccgcccaatatggaagtagttggaaggaaaaataggccttgaagaaatacataccggcatatgccaagctccgtcctcattgtttagcgcgtaacgcttccgcgaacatatcaatcgggggtgacggaggtgaggatgttccatctcatgtccctgcagtctcggctgatagtggcaacagttcattccacaaccctcgtgtcgagggagtggcatgttggtaagtggtatcccaagcttctttggctggcccctgaaatgttaagttgatgctaaattttggttcttacttcttgtctctgacaggtggactgattggtgggtcgacgggttgcgtggctcactggatcccgtgcactagggttcgacaactgcctcccttttcgtccgccacacattaactaccctgcctggactccgtagatagggataaagtactcatgatcaaatgaattgcaggtttctcatgacgcactctctcacgcggagagagtctttagtgctcctgcgcatacgtaagttcgccgccgatccttccctgaagacatggaccctggatattaactgcaggtgggtctgtcttgcactccgcaggaaatattttctcctatttcctgtacatatcggtggaaccaaaccctagaactttaaaagaacggaaacgatagtctaataagaatccggtgctattcgagaatctatacgcgcgatagtgaagggcattttctgtacggttagggccagcgcgccccaaatcttaatgaagactcaatagtagcgacgagcctctgcgtggactgacaagcggaagttcctggccattatctatttaattatgtcgatccattgcctattcgactttcaattaagcatatcgaaccacttgctaagtcattctgggaaaatctccggcgtcggacactcgccggcaattaccccgcccgccgacaggaagctgattggcgcagcgtatgtctccatgtctacgaactcaacggtgcagaggatgtgccaggagtggcatgacaagtgcagattgcggggaagacaattcccccatgggggcgtcggtctttgtgcatgcctgactctgtatgtcagacatctccttcctggagacaatgttcacatggtaaatttctcaataatctcaactctgcctacccgatgccccccaaatcccatcccgcaacagccaacgccaacgtaggagacttgccagagacaaccaacaaaggagaggaggagattccagcctgtcagttctgtcgcaagaaaaaagccaagtgcaatcgagcgcagccgtgttcgcaatgtatgcgatcggatgttctttgcgtctacgatgatcgacggacgaagcccggtctccgagctggggcggtcgaccagctctatcggcgcgtcgagacgctggagaatatgtttttgggtcaggagatgctctggcagcagatgtggaaggctttattcccgaacactgagcccccgcgatccctggacaagggaaccacggcagccacgaccctgacggagcgtcgggagcagttgaaggcttcattacaggagcctccacccttagcagcgaagaggtcacttacagtggcagacgccgacaattctgcaccgctggactgtgttcctctcccagccaaacgcgcccgtgtggaggacgaagtggctccccatgcggctgtcctagagcccgagcctttcttggccaactctttacctgacatcgtcttgaacgaactggtggatttctactttgtcaacatccatccgtggataccgatactacacgttaagagattccgtgagcgcatgcgatcgccggaggaacgagggcatatcaattgcatcttacatgccatcatctctgtctgtgcccgcttttcacaaaatggcccaaatggcgatacgttgaacttaaaagagatcgccaagaaaagtcggcaagaggtaatattgcaaagcactgaaaccttctccgttgagaatctccaagcgctagtgatcgtcgcatttgagacagtgagcaagaggcccacgccatggatatccgggaacaagtagactgatttcattcgaacagattaatcgcggccgtgggccctcctcatggtctatcattggcagcatggcgggaaccgtggagcagcttcagcttggcgtggaagaagatgacctgtatcgtgtcaagcgcatgggagaaagactgatcaggcgcatggtttgtctgacaccatctcggtcatggagtgaagcagaagagcgtcgccgtgtattctgggcagtctttctcatggaccgcttctgcagtgtctcgacaggctggaagatcagtctgaggaatgctgatgtgaagcgccgtctcccgtgtgaaggtgctctgtgggaaaaggaacaagaggtctgcaccccgtatttcggcatctctgatttcaagaacacttccatgcctaatagtcactcaacttcgatggatggctctgaagaacaggccatcggcgcatttgcctacatcatcgaggctactgagtcactggccttagtgaccaacttctatctccaccacgtctttctgattaacgatgccagcaaggcacgattatggctcgtcaaattcaaggaactagatctgcgactgattcagtacgtatcatctcttcccaagggatgtctaaacaccagtgatgctgacgcgcgcagatggaaaatccatttgcctcccaaatggcgcgaagcctgcgtcctaaatgaacacagagtcatggaccccaatctgactctggcacacatcacccacaatacggcggtaattctgctgcatcagggcatcgcctatccaccatcgcattggcagtactgtcccattaagctcccatcagcatcctctgctgatacgtgccttgaagcggcttcagagatagcaactattgctaataaattcctgtccttttctcccatcttcacgaatccccaattttctttttgtctattcatcgccggccgcacactcctcgcacacgctaggtacaatagggtaccgccttcacccgcactcaacaccctcattgcaaacctgatggagatctcgcagcggtggacaagacaccatgacgccagcgaatcccagcaagaggagagcctggcattcaagtttgccacccggctcatcgaagcccagcagaatcgaaccagtgcatctcgtccgagtctggatattcgcacgactgcgtattcagatgaatcaaaagaggagatgtacaaagaccccatgagaacaaaccaggatgatctcccagactatgaatcgcttagcagaccactgcagctggcttcattcccttcgcaggagtccacttcctgcacgttcgacccattcagtctggccttcccaccgctgccaccagcctttcagcaggatttttcgcccactggtctcgacccgctctctttctataatatgcaattgccgtcggagtctatgtcttcgcctcttggtacgagaagccacggatcgggttctcagcacgattcggagagttccatgaccagtctcttgccgacggatatttctcatctcttcgatatgacgtctagtccggggcagagaatcagttattacggcaatacacggggagtgaccaacaattcgatagtcgagggagccgacaattagacgagtaacagaacttgcgtgatcatatttcctctcatttacgttgtgcctctatattttatgtctacttccctgcccctcagagggggttctttaatgcttctactccctgccacactcgctgccttatatatgaggatcgaccaagtccatctcaaggagcatatttccaaacagcaagaaataataatcagcatagacgagaccatggtccgaccaccttcgcggagcaaactcatagttattgattgttgcgcccgtcagtatagtttcagcaacatccccaaccaccctcagcacttccgccccgttccgagtctcagtgtgatgcgtcgagcactggtctgcgtacacggagatttctgacgcaggaccagcctcgaaccgcatagggggattcaaataccccacaaccgtacaatcaaccagcttcatagcagcccgaaggtagtggttagccgcctcaacatcatgcatcttcttgtaagccttatagagcaacaacatcccacaggcagcgatcatcgcagcagaggtatcgcgtggggaggtgtcagtaacaggcgcatcaaaatcccaatatgggacgccatcatccggcaatctcgcaagaaatacatccgccagtgctctagcagtgcgaaggaatctcatctctcttgtccactcgaatgtctgcgcgaaccccatgattccccacgcctggcctcgtgcccagcagctatcatcactatatccctgatttgtgaattttttcttcacctcccccgtctccaggtccagatcaacaacgtgaaatgtcgtatagtcatctcggatatgatgcttctgtgtagtgatcgcatgagccctggctatatcataaagcctccgacagcctgtttctctcgctgcccagaaaagcaaatccaggttcagcatgttgtcgatgataaataggaagtcctgcgacgaatttctgtatgcatagcgcttggtgatgcactggtcccagctacgaatacactgggttgattcattaaagcgactggcgagggagtgggctgctagtatgagagtgttgtaggctgctgggtctcgatgcagggtccatgctttcatcgcccaaggggtgatcatgaaccctaggtcgtgagtatccttgcgaagggcgttttggtgaaggtttgctgtccaccagcggcagaggtgctcgtgttggaggggatgggggtggaggatggattcgctggtttgtcgttggagaataagatgccggtcgcggaagagagtgctgcgttctaagaggaggtataaagagcctgggaagaagccggaggtccagaagtcaagggttcggtagatatatgtggtcttgtcttcgccggtatattcggggtagaaggttggaggggttgtctatgtagaatgtattttgtttaggatagtgtgaaacatttagcggttcggcgaaataactcacactacccatcgccttggatgcgacgaaccagaccttggctaggagggattctgagaagagggcttcgagtactcgcgcccattgcttggtagggagtacttcggtgccgttgatggttgttgggggtcccgcttcgatagacatcgttcctagtcaatatatggtttgcacgctatagagaggaagacttcaagataaactgaatgagatgcaagatacaaggttgaaagtgtgttcaagaccgtccatctacaagatctcctgctccatttgaggctgtatgcattagccctcggaagggggtccgggaattcctccgcgcgagaactccctgctaaaatgcactggacaggcatttcgggctatctcccggagtccctccgacgagcctagaagacactcgttacagctaagacttccccaccatcggggctcttcatcaccctgaatctagggaatacaagtccaaacattaatatcttatctacacctcaattttgtcttcctgacccacaaatccgctgtctccaaatccacaatggcatccaaaatctccgatatggacgcaacaacggccgatcatctcgaatcgacagagaaaaaagacccctatgcggcagacccaggcattgaaattgacgaggcaactgataaacgactcttttggttgatcactcgtcgtatcctggttatccaaattgttacctatttctttcagtcgcttgacaagggcattctgaattatgcctctatcatgggtatcaaggacgatgcacatctggtcggacaagaggttgtacaccagtctttaatggtacataacaattggctaatagtaatttgtttgacttagtattcgttactgggtacgattttgtacatcgggatcctcgtgggagagtatccccaaaacctgctgctgcagaagtttccggtcgccaaaatgctctctgtcaatgtatttatctggggtgcgattgtggcctgctcggccgcatctacgcgctttggatctctcatggcagtccggtttctgttggggttcttcgagagctgtattcagcctgcaatgatgctcatgtgcgtgtctttccagcttctaatacagaaaggccttgctaactctagttccagaacagccatgtggtataagcgggaagagcagtcggtgttgaactcgatatggtactgtatgacgggagtgcaactgatggtatgtttccccctctcgctcctctcttatagatgcagttggactaattactcccaaaagattggtggtcttctcgccttcggcacttcacagtacgtaggcggagtgataaagaactggcaactgcttttcctcgctcttggatgcgcgacatgcgtgtggtcattctttattggcttcttcctacctgatagccctctctcagccaagtgctacagcgaagaagacaagaaactgatggtagagcgcgtacggcataacgagacgggaatcgagaaccgacaattcaagcgatatcaagtcatcgaaacgatccaggatcctattgtctggtgctgcgtgatgctcattctcgtggccaacctagttatcggtggtctgggcgtcttctccaacctaatcatcgagcaattcggcttctctctgcttcaaaccgagcttttgaatatcgcccaaggctcatggacaatcatcgtaatggttggatcagcatggtgctcgcaacgctttcaacagacgtgtttaatcatgatcgtgagttccaacccctccattcagccacccaaggctaaacagatcccagctctggacaattccagccatcgtcggaaccatcgttatcctggtcgtaacacccacatcatccaacgccggcggcatgctcatcgccttctactgcacgcagttcttcctcgccgagggcaacatgatcatctccttgatcacccgcaacacagccggtcagactaagaagagcctaacaatgaccttccttttcgtgggatgggccgtggggaatctcatcgcgccgcagatctttcaggattctgatgctccacgatacttgcatggctttctggcgcatattgtgatctatgctgtcttcattgcgctgacggttttgacgagggtgattttgacgaggcggaataaggccaaggagggcgagagcagtgatgtctcgcatgagttggcgtttcaggatttaacggatcgggagaatccaaattttcggtatgtatattagtctgcttttcgcattggggtgtagggttgtatagtcttcaagtagctagttagtactggatgggtctcaattttttcaaaaatgtatatccacgcccctcgagtccacatatactaccccggatctgaataaggaagctgaatatgttaaatacatcattatattgaagaagctatcttaggcacgttcaaatactactacatagagcttctccagaacagagctatgccatttagtaactacatattttccattgcactaattgtatacatccaaagctgatacatttgtcaaagcttctattcctctgcaaccgcgaaaagcaagtccgcccaactgaacggatcaaccggcgaggtctgacccttcacagatgcatcatagacatctttcacgcgcgaagtccaaggaacctcaatccctctttccaaagcctcataataaatcaacccccaagcagccgggttcgtcttcccatcctgatacccaatataccgattgatcgctgaaatatttgcccaaggaccatcgaccaaaaccacctcgcaccgataaaagctcgcgtcataaggcaccgtctgattcatgaggtacttacccgcatactccgccgccgtgaaaataagattattttccaaagcaaataaatcatattcttgattagccacgaccctcgcagcaagtgccgtccactgcaatgcatcctgcacatgcgtctgatcgcgacccgcttcggagttctggcccgtggaagccagataattgtaggggaaaccggcacagcgatcatacttatacgcatacagagcataattgtacagagccacgtcgtcaaggtaaacggcaaagttgagcagacccataatactagccatgccgtagtttgcttgtccgatgatgatgctctgtcgagcgaacagccaataaagctggacgctcaggccggagccgcctttgaatgttgcgccttcttctacccaaccgccttcccagcgcatgatctcggctgcgttggcgaaaatggagccttcgattccgattagaagggatcggtctgtgccaatgatgttctcgaggttggagccccaggcgtcgaggatcgtggttgagcggttccagtggctttcgttacgggttatgtaccctatgttttcctgatgtattagtcctggagtagtctctggaattggattagagacttacacattatagcattctggtatgcagcgcgagagtcgtcatgaaaactggtatagttgcttatctgcccacgactaatcacaggatacggcccctgcatttcataagaggcactggagtagggatccttggcaaaacgggtgtatgcagatgcccagggctcgacgcctttgagaacattgtttcgcataagctcgagctgagagtggctatgccagagtcctggatgctggaattgattcgttctatcctttgagccgggtgtgtcagggaccatcattaccggccctagagtaaataagcatgttagagtggatattataactcaatgtctagctcgtaccgtttagactgggtacatcttgaatcaacccgtggacgtgaacagcggtggctaccgcaaggaatatttttagtatctgcatgatcggaatgcttggtggcagtaaatgttgggtcttaatggtggcatgtcgttcatattactactaccagctcgtgtttaaagatcgaattagacctcgggctaagtgccggacagggtccgattctctaacaacgctaagaaacgtttcaatattcatgcggggaacagccggacaatgcaccggcgtgcatctggcatacgcattcttcccgagaagacgggaagaaggtggatctggtggggagcaggaagaacggctgcttcatttgccgatgcccctgaagaacaagcacaaaaagtgtactttaatatagatatcaaactcaattgattcagggtagtaacttaaatatatatagtagcttgtaccgccatatcctccacctcatggttccgcatccagagcagcatcatacctcatatccatcatgatctccattctctcgctactctccctccctctcttccacaacctcgcccatgcaggcaccatctaccacagcaacttcacctcttccctatcccccttctccgcttgcaatgtagaatctccatcctactccaccgccaccgacggcaacctgaccgtctacttcgacgagtcctactacgacggcacccgcgatcgcaaaggcgccgagatctgcgtctttgaggacggcaccagcaccaacgtgcgccaaatgaccaaggaaggctggcagggcttttctatctatgtgccgtcggacacgtacccgacggacaagagcgccatcattgcgcagcagttctgccccggcgggtgctcctcgtggtgtggcaccgtcgagatcgtgaataatactctgcagactacgcaccgcgcggcttgttctactggtacgacggcgactcttgtggatgatattgacagagatgcttggcatagtgtcgtggtgcatatgcgcgtgtcggaggaaagtgatggggcttatgaggtttggtgggatggggagcaggtgtatagtgtggaggatattgatgtgggatttgggacttgggatgataatgatacgttgaccaccgggtggtattttaagaatggggagtattgttttggtgagttggttgatgagatgacctagggttgtggttacacttgctgacttttcaatttactcttagatgtcgacgcatacactaatgagactaggacgctctactttgataacatcacttggtatgagactgatgatgggagtgatgatgggtatgagacggtttatccttgatcagggcctatcttaagggaaatgcgtgtagtagtgctatgtggtttgcgttggcaaaatcgactgtgtttgataaaggtgtatcagcgagttgttaatataccgagaagataatctccccttaaaaattcgaagcagaatctacttctgcgcgctgttacagcattgaccaagcaaaatgctccatcaggtgggagtgggaccagcgcactgacatcgatcttcatactaacttcatactaccactgcgtggcacctggagtgtcttgtcctcttccgttttgagaccatgtgccctatgacctcgagtcttgctaggagcttctttctaacagaatccaagatcacaacaagtgagacaaatgtaaatgtcccgcactacggccttggcgaagcagaattaggtgagatccccgcacttttatggttcaaatctgagacattatagcctgaacttagagtggcgatttatataaaatcaatgattccctcattttcgcctacttttgacatacaattttaatgtatctcagccaaaaacatgtcatctataagcgctgctctcgtacgccgaggcaccgaagtcatatcggctcggcttcagaccagccaacagcctctcattaaagaatggataggcatctttctcgtcttcttcactgtttttgctttcggccttgcaataaattgggtgagtccatagtgatatcagaaaaaaacaagtactatactcatcaaagagaacaggtcgcctacacctgcgcggaagtcatcgcaaccctagccgcaatcgaagaccccaactccaactcaactccctacatccacctcgacaacgaaactaccaaccccgatgaccccgaactcagcaccatcacaacctccaagccaataaccagcgacttccgcacagcaatcaaccacctccgaacgctcggcggcggcggtttcttctcaaccttccgcggattccgaatgtatctcgccttcatctggctagacgcaggcttagcccttttaatcccaatgttcatccccgttcccatccacatgggcctcgtctctttcatgaccgactttatcggcagaatgttcctcgctacgggcaaacggcatgggttcatgtagtcattgctgataaatcccctatggtcagctatcgacgaatgctgggctatcagcattggagaagaatcgctcctgttgctgttctgcataatgttgtcatgtctgtgacttactcggtgaatctggctgcctctaggtttgttgggagggttatttgggtcattcttggtggtgagcatgggaaggggtcgagtggtggaaatgcagagggagggattggcgttgttctcctgataatgttctttttattgcttactgtgcctgttaaggcgatattcactcgtgtggctgcttcgatgttgcctgagggacttgatccgattttgccgtttgatcggcggtttggtggtaaggtgataccggagggtgggagcgagactctgagtatcatggaggcgtggacaacgtttgaatggtctgctcgagttcgatattttaaggtttttctcaaggcgcttgctcttgaggtcgcacttggtgttcttggaggtctcttggttattggggagttgaagtggttgctttattctcactgaacacattcctcttggcttagttcgcattagattgcgctggttgcaattatacatacataagaaactctctttagcagctaatacacggagcctacagggcttaagtgagagtcgcagttctgtggtctcgactggaggcagcgagggcagatgatgagtgattcgaaatcaggtgtggcggactttctagatattgaaatgaacaattgctcaaacctctcacaaaactggctagactttctgacataacgggaggaggagagagaaaaaattgaccaacttttcttactaggatctttcaaagagatgcaaagctgccgagcagctatatgactccaaagtgctttcatacattgtctagcttgcatagtaggatatcctttacaaatcctaatcaggaactctctaggccttcgtttgaccgtatttagcctccacatatttggcttcttttctaccaagcgcgccacttgtatactgctgccacattgccctttgtaggtaaacacgcatggccttcgcggattcctcggcttcctcaacaccctcatgatccgcatcctcttcatagagacaacctggaccttcatcatcgctatcactgtcctccccgggattaccgtcatcacgtttattatcgcacccacgttcataggaagcttcaagtgcatccacaatcttccgttttccaacagacagaacaaccaaggctcctgccgcgagcagaatccgaacaatctctctcaagttagctgcgcgacggcagtgagagtttctgacggctattttcattctccacgctaccatggccaacacactaccataacgagatttggggagtggcaagttgacatcagcctttctgacttcgacaaggtatttcactgtctccaaataggcaccacagcttcccgcagcggcagccagggcgctaccatagttcccgtattgcagagccagattaacatcagctccgccctgttccaccaagaattttgtgccctccaaccagttacgaaaactggcaactgctagtgggctgccatagtagttgtccaaatgcatgttaacgtctgcgtggccttcggagaccaacagctgcaccatatcggagtcttcttccattatagccgcttccaatgcgcatgttctataggcactcatcctgtctatcttcaaattgacgtccgctttctggttcaacagaaatctggccgtctcgacacgtcttctatcggcagcctcgatcagcggtgtcgacatggttgagctgccttgtatgccaagatttccccctttcgccagaagaatccgcagtgttgggatatggccataccttgcagccaggagcatggaggtgtcaccagagtcgttagtattagccagatctagctcaacctcattccaccatctgtccgatacttcaaggtagggtccatataagcacatgaccagaagagagtattcaacaggttgtaattcagaatagtaccgggcccaaacacgatactgcgcgctgctatcctgtggagcaccaagaaacttttctagaagcttggtcacagtagacaagtcatcatccgacacgccgatatagcgtaagtttgcaatatgtcctggccagtaacgcgcgacgtagtagaggaatggtcgcgaaaaatcatattctaggggcaaggcgtacaattcttcgtcgtcgttaggagcgtgaatgctctcgttccaacaagtgtcactcaacataaatagcaaacaagctttgcccaccataaagttggtgactgcagtagtccagctgcgacggagttcgaaatactctgcgaccgagagatgcgatactctccatacgtcccgctcggaatcgatgaccaggaaattgcgacacaacgccaacaatgcatcgtcggtaattggggtacataactctgttgtcataacgtcggggttgatacggactgcctcaaggagcaattcccgtgaaagtggttcccgtgcggccagaacccacttcaaagcgcgtagtgcgaggtctcggtcgtggggagggttttcctctatttcctcatacagtctgtcatacgtctcgtcgagagttttgggaagcgctcccagacattcccgtatagcttcaggagacatacattttccgagctgtttgagttgcagataggtccattgaaacctaaacaacattagcaaacttcgtggactttcacctaacaagagacgcatgtgcttacattccttgacttctctctgacagagtcgactcaatttcatctcggagtttgccgaatgcacggttcttttcaatcagctttagcatctcttgactaatgtaggcctgaatatcttggtggttatcggtcgcctgaatgtcaatgtttggatacgagcgaacctgctgctgaacatccccatcaggacggcttgcaataaataacttcactggtcttgtgctgctagaaagcaagtcctgaaacagctgaaggaggtcaccacgcgaagtaagatcgcattcgtcgaaggcatccaacaccaaagttgttcgagggtagaggtttagagattcggtgagtaaagtcctgcagcgcttgaagtccagatcctctccacacatgcgcaattccctgtatgtggacctaagcctagattgtatgtacaacgaactgctcttgcttgcggaagcagacaactgacgcacgtagctccgcgctacggcaaggggtcgtgttcgattgtcctcggttcggttgcagtagaaataggcgaatccttcatcgttgggcactcttgtgagagtatcttgaacatgatcgataacccttgaagtaaggaatgtttttcccacgcccgcttgccaacgtcagtgtcaagtccaaacaggaggggtgtaagaagtgatgaaaaaccaatgagagtaaaacttacgagatcctcgcaaccataagactgccgaagaactgctttcttcccaatctcggaatgtaccgttctgtaagagccattcacccgtgcctggtgtccgattgccgcgcacattattatgatgggacccatatttgactggtgagatccagtctaaaatctccatagcctctccccattcaagcttttccaggctttctgcaacctgagtctctatgcggggtaagtgccttcgaacgtcctggaggtggtataatgtctttccacctgtcgctgcactgcacgcctgagcagtcttagcaagctcttcctcttttgctgtcagctccgagaatagccccgagcctttgtcgaacatggtgtccaaaatcctagtccaagtcgatttggacagcatattaatgctgtagctcaataattccaagatagcctggtaaacattgacaaggtttcggcgtagagtgtcagcaatgtcattgtttcctgtcgcataagcagactcatattctctgccacgatacgtggcctgcagaacccgctctacagttccaagtagggcaaccatttcatcggcaaactttacaggaatctacgcattctcagtcagaacgctgcctgtatatttatagaccgctccaccaaaagcttgctcgaaggcatcctatagagaacctcaagctcaagcactcgtgggacctccattcgcgctgtgtcatatgggcataaacctacctccaaagctaccttgatcaacccccacggccctgcagcttgcgagggtgcgaacggaacgacgagatccccgatcaacttcacccatgtcgcacatttggcagcgtagtctcgcacgaagatttcattattgtatttccaggtcttctcctcgcagagcacccgcttctcttggagatcattaagcaggatatctacagcccctgcttgctgagtctccgcacccggttcgtatcccagggctcgaagtcgatcttgtgatgtcggagggagcctctcgaacgcttctttccagaaattttcagcttttccctcgtcgctacctgattttgaggactcgggcaagccagaatcgggttttcgatcttcacctgtaaaacttttgatgtggcatggggagttactgtttgacggcgaccttctcttttctgggaggctccgaggcacagcttcttcgtgctgattcttgttcctgatcgaatcctcacttgatatagaggccgtacttcctctcattgagagctccttcacatgttcaacggggtcacgtcgcctgcagtccggtaatgtggactgagtgtcagcagcaggctcttcatgttggaaacgttttaaccggcgcgaaagtcttgcccgccaccgatccatctttgagtcgcacttttaccgtgacttgggtaagtcgtgtggcaacagtttgaccccaattccactgggagggtatgggtcagtttttagtccagctgtcgggcgcgatcgattgtgtgttggctcagcctcacgcggggttcacgcgctaagcaggtcgatgggactatctatctttctttcgcccactggcaattggcaccagctgcacgcattgctctttctggagaggctgttcgcccttttaccaggggcggccgctgatgacgtttcattgctagacatcttatccccatagcattcatgatcaaggtggtgcgatctacagactacaacccctatcacagtgtgaatatcaaaagaacagggactaagctcggtaatctcaggcttggaacgctttgaacatcgaatgccagcatcaactgaggcaaactaccaagagtaaagaggcggaaggcacgaagggagtgaaggaagggcaaaagaggttataacgctttctccaattgcgcgggcgcacgcacacacgaacaataccgcagcatccgcactccattcactaaatgccttttatctgcaagtcgtagcatcgttctggtctgtgtggccttcccctgtgactcaaacggggcgtggttggagcctctgccatcgtctctagtctattgccacggacgtaggcatgtgaacttcttatgcatagtgtatactcatccctaagccccacggcgcagtttgactgtatactcgtcgcttcactgtgcctgctatagagcatctcagagcatgcagttcgactgaagtggaagactgaaattattcaatctatctatctataaggtagcaaacgtcgacaaagacggagattttcttgcaggtgtgaatgtgcacggggataaggtggtcttgacgcaaagcgcaggtcttggggccttgccttgaagcatcaaggctcagaatcgattcaaatttgaccttgacggtttcaataatccataaaacgtaatccttgttcacagattcatcgaactgaaacgagatcgagttcgaataccactccaacagcaagcttgacattatcatcatagaaatgatacattgtccgagtagatttcagaccgcgctcaaagcacgggccgcgaccgcggcgcactaatcccgattaggctatccgcccaacctcgagcgcgcaaagatcgctggtgcaaacaccgcggagcaataggttgctactgcgacagttccagctcttgtcactgtccgactgtccaggatgccgcccttcagagatgagcatatcttggtacgtgcagatatctccgatcgtcttcaccattcatctaaccccctcctggcggacccaaactgaccccctcctccccagataattgcgccaggctcgcaagtgaccctggcgcaactgggtctcccagagtcattcacccctgcccgctttcgcttccctacgcgcatgtttcctgccgaaaagaagggcgaatacgaaccgtacaagatccgcgaacgacgacaggaagtccccgtcagcaatggcaatggcaccgacgcgcccaaggaggacgtggagatgaaagatgcggaaacggcgcagcaagacggaaccgtgaagaccgagaatgacccctccgaacagcccgaagatgcacagaagaccgagggccaggatgccaatggagaagagaaacagggaacgacaaccgagatcttctacgaagaggacgtgacctccgatgagggcgctgtctatccaatccagaatggtcgcattgtcgactggccctgtttcttcgctcttctgactcacgttcacaatacgttgagtccgccattccacaccccgatcatgcttatttccgaaccggcatggtccgcccgcgaccgggagaccatcacacagtttgtctttgagaagttcaagacgcccgccttctgcctcatggactccgctctcgctgtatgctacggatacggtacctcgacggctacggtggttgatgttggcaagggcaaggttaatgtcactgctgtcactgatttccttgttaacgagcatggaagaggtattgcgctggaaggctgcggtggtgactacatgacggatagaattgtggagcttttgggcccgaagggatttacaagggagatgtgcgaacagttgaaacgcagcaacatcactgagcttttgcccccgggcacaccccttcctggtgccgctgcaacggcgagacaaggcgctaatccagccgcttcggcatccactgggaccaaggacggcaatgcgccaaatgacaacatcccccgcggtccgggtgaaggcacccagaccggtggtgaaggcaacggcgaagcagacgaagatgagggagttttggatgtcgcagccattgtcagtggcaacacgagtgagttcctcgccaatcgggagaaagagaaggccgaaaaggcctcgaccaagaagggcgcgacagatcaatccggcaagcctctacgtctccccaactccaagaaagagaaggcttcgttccaatttgaggagtacgtgaggatagaacctgagaaggatacgccaaatggacccgggcggtatatgcgtcagtctcgcgagatcgaggtcggtgttgaacgcttcctcgccgcaactcccaagcagaattctggagaccgtctcaccagcggtctgcttgaggatattgcgactcagatccaccacaccatccttgcggtgcctgatgcgactaagcgcagtgaactctgggattcgcttatcgtagtcggcaatggcagcaaagtcaagggtaagtaacccggcggattcaacttgaagccatgaactaatgtttctacaaataggcttcacacaatccctgctcggcaccatcacacagaagtacattctctccccatccgccaccatgttcacctccgaaattccctccaacttctctactccccttcccaccggaggaaccaacaccccggtaccttccggccaggctggtccgatgaatcaccctgcgggtcacggtgtgaatccactgcttgtcgcagccactcatgccaacaaccccatgcccggcactccctccatggaccctgccatgtcgcatcaccgctccacgggacattctcaaacccccacatcggtcaagacactcagacccccggaatatttccccgagtggaaggagcaaagcaacaccaatgcccctggcgctgctaccacgggtgggcctggtgccccaagcggtggccacggcatggaggaggccgtgttcctcggggcacaggttgcatcaaaggttgtcttcgtaatcgaccaaggcgtcagcaagggattcatgagccgggtggagtacaacgagaatggcccttctgcgatccatgaatacaccatgtgatcacctttaatgattggcttacgtgcctggggattgatgtgcgtgtttgttgacatatgaaagcggaattcttatttacggacctggttctggttccttttgatgcttccaatttacggttaattattttttgtctaacttcttttcctcgtggatattgtattctacgtgatggcgtctttcactagaaaagcaagtctgactcggatgccaggataggtggagtctggtcggattagtactttgaatagtatctcgttcaatgaactgatgtagttgctttgggtaagcagccggagccatgggcgtaggagctgataagcctaggagctactgatgctaatttatggcagactgactcggttagctatgtaggtaggtatagatgcctctactattctctcacaagcactgcaccaacaacaacagcttaaacacccccctccaatactagctttaggatgtttgcgagaacttcgggagacgggtaatggataacgcgagggagtgactctatgtggtgatcgaccagacgtacggaaagatgggtaggaaactaatcttctctttacaagctatacattttcatatatctcccacataagccgtatacttcaatagtaaagcatttcaccccaagaaaacatccacctcaatctccaaattctgcccttcaaacggcaaggcctcaatccccaacatagtccaagtaggctggtgatccggacaccacttcttaacattctccaccatcaggccaataatcttctctcgggtctggggcaactggacatggtaggtgcggatcttcacgacgcggtcccagccgctcttgacgctagcgcgcagatcgggcttggctttctctagtgtgtagaggataacttcgttgatgttgttgaatgcttgcgcaacttcttcttcgagggtgggtgggacatcggttgatgtcggggacatgccggctagaatgttgaagggggggttggattagtcggtgatgaggggaatggagggaaaggggatgggggctcactctggccggctatttccattcggtctccggctatgcaggcttcggcgaagccgtaggcgtcttggaagtgttggccgcggccggggcgggagtagctggggattggggacatggtggtgaggatgggatggtgtggagatgtatggggggtgagtgaggagggttggatgagaatggagattgattatttgttttaatgagtggccatggttatttatgttgggagacttgttcattgaagttgtcgctatcaacgctagttgcagtagtgcttactagctatcaggggtccttcgcggaataaattaaatcaacctaactgacatggatgtctatgttatgcaatgaatagagtttatacaattccactgttagtcgtatgtatcaattgtttgatactgattgataatttatagttttagtgatagaaatgacaagtgtccacccacgatctgcatagccacatctagctaagaacaacgcgttcaacaacatccccgtttcatctcaaccccacgtcgtcgtctcattgataggtgaaatcacagaccaaagcacatgtcactttgtcctgccccttgatttgcacaaccaaagacacaaacgctagcagtaagcgatttgtcggcattgcaatggaataggtatccactccagggggcatttcctccctgaccagctctgttcaatgcatcgacgattgccgcatcatttcccccttgttgaaaatatcagtataattcagaagcagacctccttaagcggatgtgacccaccaacgtctccaaggactgaggagcagtaatcaaggccgggggtacagtttccggttacggcggcatttgcggaggctgccaaagcgagagcgcccaatgcagggatgaacttcatcttgtagtagtagtagaagaaaagttgatataaacacttgtgattgaagactggaggtagttagactgagttggaagctgaatggatagtagatgagattcttgggagacgggaggggggcttttatatcttgaaattgtacaccgaatacgactatttccctgaaaggtagtaacacaaattggttaatgttgttctctaggataggctgaaggccccgcatctacagataatctcccaattccttgaattcaccctaaatattctacttccaatagtctcctctgggtacagcgcaaccccattgccactgagggaacgaggaataccaagctacgattctagcacatgatgtcaaccagctgaatgcttcagcattccatttcctgccattgtgggacatggcatcgatccacccaataaatgctccagatcggcagccccatgaggtggatactgcgtacggctgaggcccgcatagattttccggggcgagctgagataaattccagtcttgatcgacgcagtttgggggagggttctcttcctctttacacgattcgtcagttatcatctacctacccatccaaaactgatcgtagccgctctacccgtacgctagtttagtacggtgtatccagaccccgaattagtgtgagactccgcttctgggcatttgatgccagatcccggccggacatactactcactcaatgcgggtctatgatagtaataactaccggctttatctggctttctgcacagttgcaagagcatctggaagcggcggcttgtcactcgaacagggaaatccggtttcgatgcgcgattttaattgatacccagtatccggccaaacacgcgatgtaacgttgaagcgtcgatcagtgaatgtgaaagcatagcttttgctcctagcagcataaacatctgtgcatcttagaacacctcactcctcaccagacaattccatcggtagttctggtgtagtgttgaaagccttcaaacctacgtcttccgtgccagcgttctccctatctgtaataatctccgacaaggcgacatcatcttgaggtacgtaagctgacgaggacatgccgacatagctgcttcggtagcgatgggtgttcttggtgcggcggtagatgatcgcgaaagctggaaggcagccgacaatgacagctagcaagaaggattagcataccagagagcaaaagaggcgtcctaatccacacctatccccgcctcaatcataccccagaatgccagccaggaactgctcggggtgctgtcgttgttggcgcgagtgccaatctggatgactcgcacgacggccatgatcacgcagatggtgcccaaggcaaacacggcggcgacactaatcttctggcccagcggaagacgcagcgacaccaccagccgcaacggcagcaccatgacttgctcactcagcattgtattttgataaaaccctggaagagcgactcactcattatgtcgctaattgcatcgaccgcaaagctataatataagctggcaatctctgccacagcatctcggtgtgtactgcactccccttcgcagctggtcagtacccacacctgcaggggagaaggagcactgaccaacggtgaaccatgcatgcatactttggcatgaggtaaagttggagataactgccccaataaaggtccaaacagctatcagctaacgttctcacacacgatagctcgatctatgggcgcaccacgatgcagaaaaacagtaccgcataccaccacttcatctcacccggcaagtcctggaggagtcggcgatagaggaacagaaaggatagcttgacggaccacagcgacgcccataatagcattgtgttcgcaaagaaaaccttaatcatgaaaagagcatcggacagcatggtcgcccaaggaccgatcttgccatcggtatacgcatcgattttgtacacaaccggggtgacgataatgtacgcaatgctcatggccaggaagcaggcccacgacagcagaatacaaccatcttcgacctgtagcgaccgtaatttccagaaaatcaaactgaaccgagcaatgaccaccgccgacgacaaggcgatcatggtatagccggtggcctgcacctggctggctgagacataatttctttccatccggactgattcggagcgatcgccagcgatgtccaagtcctttgacggcaaacatccctttttcatattctgccgacagcccggatggtaagcatccgacgggcaacggagatgcattagcaagtgccaatttcacggataagactaatttgggtgtcatccgccatcaagcgaggcggacggccgctaaggaaaagccggcggtatagcgccctgttttgggaaagctaccatggcggcctataaaggaatgagccccctgcagtaagtcaacgcctcctgaaactccacgacttcctgctctaatccttatctccatcctgttcctgccaagcaccatgcgagccggcgcgctgttcatcgctacgcttctggctagagcgacagcgctggacaacactaccagtcgcattgtcgctaaattggcatcttacggagttgatgcctacgagtatttcaactccagcgtgctactggactcgtctttgagcacgcggtcgttgggattttgctccgagctggtgagttatttcccgtcttcctgcgtgctaaaaccggacgatggcacccgaaccctgtctagtcgtcgggctaacgcataagcaccaaattgacaatttcactaattcgaccagtgttccgcacttccccggctctatcccggccacgtgctgcaacgctcaaccacggcttactcgacttgggatgccagtttctggtcgcagcagcaggaggaggttgatccagcctgcgttttccagccagccagtacagtggaggttgctgttggcctgctgctgtcagagctgacgctgtgtccgtttgctgtcaagagtggcggtcatgccgcctttgccggcgcctccaacatccaggatggcttgacgatagatctggtcgggctgaactctactgccttgtccagaaattctactattgcgtctgttggtgcgggcaaccgctggttggacgtctatgattggctagaccccatgggcttatcggtcattggtggccgtgtgtccgacattggcgtgggcggcctgacgctgggaggtaagtgatagatcatcacaggcaagaatgtaagttaacgaggcattgcaggaggtatctctttcttctccggttttcacggctgggcctgtgacaatgttgccaactacgaggtaaagcgatctatattgcttatcattactgctctagtatctgacgagattggtctaggtcgttctggctgacggtagcattgttgatgtcaactctgacacacatcccgatctttactgggccttgcgtggtggcggcaataacttgggcatcgttacccgcttcgatctgaccacgcacactcagggcctcatgtggggaggctcacgcatctggctggaagagtatcaatcggacatcctacatgccctggttgactttggtttcaattctccttcggaccccaacggagcactgattgtgtcggtagcctacgctgagggtctctacctgttcgtcgcggacttggagtacgcaaagccggttgccaatccccctattttcgcgaacttcagcagctcgggggttctcgaagacaccatggccatccgcagtctgtccaatatcacacttctgttcaaggaatccaatcccaacggactacgcgagagctattggacaggcaccgtccaactcgactatgatcttgcaaccaacatcaccaacatgttcaagcaggaactcgtccccattcagaatgtgaccggcatcgttcccgcccttgtctggcaagttatcagcaccaacactatggagcacatggccaagaatgggggtaacgcgctaggactcgatccgaaggacggaccattgctgctgatcaaccttgctttcatgtgggacgatgaggctgatgacgctgcagtgatggctgtcttgggcaggatcacgcaaaaggcgctctcggctgcgcaagcccgtggtctgggcagtcgctatttgtacatgaactacgcgagtcagtaccagtccgtcgtgccctcttatggcacggccaaccaggctcgcttgcaggcggtcgcgaagaagtatgatcccttgcaggtgttccagaacctgcaaccgggctatttcaagcttgacggggcgccagctttgtagatagtcttcgcgggcaggtatttcaggaaatacgatattattttctaagctaattgctgtggatgacagcaagcttggcgcttcaggttagcgactgtgactgaacccttatcaatttcaaagctggggttcctccaaaagataaagttacatgaaaattatctcatgacactatactaagaaatgaaatctgactccgacagcacattagttctttaaagtattaagcaaggtcgttcgtgtcgatgttataatatctgtcaatttcgactagtcaccctcctatgagattagactgagaaacgggagcaccgcctatttatagttacttccacctccctatagtgacgatcgagtcttcggcactaaccatgcagtacggaagcaatattcattcattcatgctggccaccagcgaaatcgcaatttaattctttgtttcaagaatccgactgctgcaaatcatcaatactgctcacttattttccagccctccaagaatgtctagattgcagcctcactgtctttgaaagtgtctatctgcttagcgccagccagtttcagacacaccttatgaaacacgacaacatgagatttgataagctgaggataagcgcccagctaatgcagacgtctactagccaactattcagtaccctacaccacacagcagttgattctcacacagtaacctctcagccttgcgcctatacattcataataaaatgatagccttacgacatgccgcccaacaaaccaacactcacctaacaccctccccatccacctcgcccaaaatatcactttttgacctcacctacctgagataatttaatatgcaaatgtcctccacccaccccaacacctcctacaccctcgcctggatctgcgccctccccgaagaatacgaagtcgcgatcgccttcctcgatgaaatccacggcataccacagcatcaacctctcgaagataagaatgcctatctattagggagaataggtcaacaccacgtcgtgatggtctgtctgcctgcaggacggatggggacagcggctgctgcttctgtagcggagaatctgtgtcggacgttttggtcagtgaggtacgggttgcttgttggtattggaggtggtgttcccggtgtagtctccgggaaggatattcggttgggagatgtggtggttagtgttccggggggtgggaatggaggggttgtgcaatatgaccttgaagacggtgaagtacaccatgggcaactcaactccccgccggagaagttgctatcttatgtgacgctgctgaatattcttatgcggagtccgaggatatctgggaactgctttcgggagcagttggagcttcttgggcaggagtatgagtatcctgctcatcttgaagataggttattctgttcacggtattggcatcagtttgagggaggctgcgaagcttgtggcaataattgtggtgaaatatacaggaataagagggatgatacactacctgctgtgcatttaggtacgattgcttcagggaacacggttgttggtgatggagtgacgagggatatgataaatcatcgatatgggaactccattttgtgtttcgaaatggaggctgcgggaattatgaatgccttgccttgtttggttgttagaggtattagtgattatgcagactcgaggaaaaacgatgagtggcggccgcgtgctattgctggtgcttgcagctatgcaaaggctttgattttgcatattccgcgggaggaggtgccgcagcacgagaatctcgtacatgtgacagatctgggtaagtggggtactttatttcgagctatgggctttacgctaacggctttccgtgttagtcaaagacatgcgtgacgaattgggacagataaaggcggctattgctggtctctggcatttacagaaaggtgattcccataacaaagagctttattttcgcttcaaatgagctaactacagtataggcgatgagtatacaaagagtcacaccgtttaccatcgtctgaagactctggcaaacagaagcgtgagcatcactgcaagcatcactagcaggataacttttccttattatggatttatgcaagcgagtcagtatctgagacattggatatcgctatttttcgacaatctaaagcggtatatctggtcaatacgacctggccagccttcaagggacagggggagcggccctagtggtggagcactcccttccgtactttcgatccaaggatggggatggcatctcattgcagagccgcatgtgtggatgtcctcgtgatatatattgaaaatgctcgagcagaccttcgcttgaatgaggatcaacacatgcccgcctcagtacgaagataaagtcgagcgaggttcgtgatgtggctcgtatggaggggtcaagaggatgccgagacttgcaaattggcaggttccgacactttatgctctcgcttggtcgcgcgatcatctatttagcctctctgccttcaaatcgacactcattttcgttttctattggtccggaagcaattccacacacggctcatcggcctcgtatttgtgccgatcagacgagatttagtatggcctcgtcttggcatgacagatatatagaccctgagctgaaaatttagccgtatacaagatggataggggattcgaatcccaacgcgggagatggtgagaacaatctgtcaggacatcgtcacgaactactgaaatttggtcagcacactgggagtacttcaaatacatcccctgagctatggcggaactcacagttggctatgtttctggcatcattgctgctggcgtgtttcttggtcggtgaatccagccctgaagagctaacataggctaactgcttcaagtccgtctgtttattccaacagtgatatgtctcttaattattggccatctacccgctgaaagttcggtcgtctcttggtattgatttcctctcacggacttggttcataaatcgatccactgataaagctgtaggtcagtcgttagccggctgcttcactcatcatattggcccaccatacttgattcagataccgccgccagcacaggcgtcagcaagagaatcctcacctattcctggcttcagttgatcgcagctgtcctagtatcaattaccggtatcgtcacccctcttggcctctacgacacgatcggtccccaagacaaccccacagatgttctctttcactacgcacccgatacatcagcatttggaaaggcaacccctagtagggatggatataaatcacttcggatatgctatgccgatgaggatcccgataccccagaaggctgccccggcgcaccgccgaatcgcgccgacatggaagacatcactgaagcgtattccgtttggcctagcagtgtcagcttatttacgagcggaaacgtgtcagcgacagtctccagtgtgtttgatgtccagtggcggtcgttccgttcatcaacgcagatagtaccaggcgctagcgctacagggagtgtattttctcagggctattatcgacagatctctcaactaattttggatgaagacctgttggctgtcgagggtttgattgtggatagcaaggctggacgtattggtttccgtaaccatactatcccttcgactttgccaatgggagctgagtggacagaggatatcctattcatcgaacctgaaactcgctgtgtcgacacaaatttgacagtggattacaactacgatccccaggcacaatatagcagctacagtaccgacgacatctataacaccgatcttcggaatctggctctagttgatcgcggtggcttcgttaatctatcccatgaaaggtacagtatcgatgctagcaattttcaggaggatgctgcactgtacgagcgtgcctacaacgctgcatggagacacaacatgctcataatgcagtacttcaacgtgacaactaacggttcagacggaagggcaccattcgcatatatgcactcagaaatgggaaagaggttcagtctggcaaacatgtctagtataatcgtcgagccgatgactgtccaaacagactccgggtacggtagtttcctcgacgtcccagacggctttaccttgtcaggaaacttctcgagtggacagcccgagaacccgttgaacctcagcacatatgacgtctacgccatcggcagtgaagcctgtcactacccctccgataaggctctctcgaacatgtcattcgtcggtgtggcctgtggtactgtgtttgccgctcctcgtagactcgacggtgattcgctcattccagacacaaatagcacctggagcaccccgctatactcctgcgcggcggcaactaaggcagctgttcgagaggtcactttccggttcaacggtaccggagggctagacaagttagtcatccagagcatcaacgaaaagaagtacaaagacccttccgagcttccactctggggtgtcgaacgactgaagaaccacacactacaaaacgtaagacccttatggggtcttgtctcaccagaagtcggcgctcgcgacgacatctccacagtacaacgagactacctgtggctacccggctacgcagacctcctcacatctgacaccatagccggcgagccaagcatgcccggaaacctgttctacacacagagactcctctcactattcgacattgcaaccctcaaccaagccacctctcgatacacaggatccggcgacctggctttatacaaccgctggttcgaactatcctcctccgccagcggcgtcgagaaaatgctcgggctgatatggaccgacatgaccgccaataccgttgtcgggacacgtggctggcataatgctccaagccaaacctccaagaatagtaagaggatgtcaaagcgagatgtgggaggggtaagcgtgccggtaacactgtggtcgcggaacatcaaatatcacattccttacgcgatcccggcgtttatagtgctggctctttccattgcgcttgcgggttttaccatctgccttcttattctacggcgtaccgggctaggacagatgcggtcttaccttgctcgtacctcgcctggtaggatacttggaagtgcgctgcatccagatcaggcgggtgttcttgcttccacaaagacctggattcagcaggtgggtgtgcggaaggccactctgccggggcagaaggaggatggtacgattccgttgttggatatacctgctgctggcgaagaaggggttcgagatcggaagtaaaatccgctgtttggttatatttaatctggggcgtttctcgcaataaaattggagccttggacatggaattagctcggggaggggaatgtagtgcggagctggtcaaggagctttaatatgggcgcaaggttccgggggttctaatgcgtacggctatcaaccctcctcataatttctaaaaggctataagtggccgggattataattccaggttcagcttcggactagtatgcggggcagtctgatatacgatgtaggggaaacacattgctagtttaatatgggattaggcacccaaagagatttgtccggctctcttagcgggagaaaatgtaagagtataataaataattgggaaaattcaaaaggctttgtcttcttttgcccttttcattcttgtttcagtttttcttttgttcagccgcagtgacaatcaccctgactcaatcaatgtcttggcatgcagcaggagctaatctgcggctgactcgacaagttacatcaacatcaacacaacgccacccctcattgccacactctctattcctacagctaagtagtaaatacaagccatacggagtaactcggatagatgtgcagcatccagatgctggtctatccaaagggtatgggatcaacaggctgtggcacaaattgagcgtcaacgccagccccataatttcatgaaaggctagtaatggtcctccgaagctatcttcaaagtggcaaaatgcagtctctctctccccttgtttcgcccctcttttcctctctctaatggtactcaatggcactacgcactagtgggctctctcgggacctgctcggtcacaaggtatggatagttttatgtgtgcctgttgcgatctgcatgcttccgcatagactaacaatatcgcgcatcaagataacgcattctctatgttcgattctcaaattgctgattcccggcgctttcagagtgtgaggggagtgtattaagcgaccaaagccaatgttcttgatgagcttggaaaaaatattggtgggttgatcattgacaaaagaacctaatggctaggacgtattcgcgtatttggcatctggcatcaaatgcggagagcagggatatcggactacttctgtgctgaatactcccgtccaaggtggaggcatatggtgtaggtctactgagtagtagctgagatctgtcgatcaaggctgagagagaccgatgaccccacaggctttatcctgaactcatatgtcagtttttccaattttgtgcgctagatgcaagatcatggagttcattccaacatgccggaaattccggaaggacatatgaacgcaactcctccgtcctgatagaatagtactgtatagttgcatctttgattgggtggtctcaaagtcatgtggcatattgccagaaaaagagatgctatactattgagtactttatgccggactaaattagtgtctttatgcgcccattaactagattgatatcttttcgaaaaggatctgctggaggcggaggtgtgtccgaaatgggacattcacagtgcaactactactacggccaaccatctttatcattaaggaaacagcagttactctctcaatgaccgaagatataaatatcccctacctgttccgtcaaatctgctctttgcttctatctatcatcctcaagcttccaaactagcctgaatactgctttccaataaatctatcttattccatcttcttcggtctacctccaaccctccctacaagatgaagctcactactaccgcatttggtactttcgcactcatcgccgccgcgaatgccgccgtgacaggacactgcacacctggtttgaattactgctccagagtgctcgaagacgtcggtgagctagattccgcttatacgatggctttccgtgaagatactgatatatacaaaggcggcaatcatgcggcgatcgctgatggattgaccagagatggttatacgtcagcggcccaatatccagttatgtggaacgagttcttattccattgcaacaatgatcaatcgatttctgttgttggagcttgttatgggagttgccggaacaatggcagtggtcaaagtgacacctgcgcctagtgaattatcaccctgcgtggaattggaatacctggattgggaaagtctgagtctatacgattcttatttcgaattcgggtacttggttggttatgcattcttcagcaaggagtatatagtactacgtttgttttgtacataaactgtggtattattgtttataagaagaaaccatgcactattgaccatccaattcataggttggcagtaagaccatgttatcgatatctcgaagagtcctgcaaacaaaactttgaaacatggtctgcaagaagagcaagaaaatgtcaaactatcagtaaccaccatggtgaagcgtccgatgactcctcgccgaggcaagcgacgcgaacgacctcctgcagtccgtacaccgagaatgcttctccgtatcatgctgtctcaaacttttccgatcattgaaaggtttacaacattccaggcagaacctctcgcgataaatacaataaacatcacgacaatataagacaatggtagagaaagaaaatattcttcatgatctctatatccaggttcgtcattatcctatgccataaacgtaagccatgatggacgcctgttgctttccttgggtcaatcttcatgatcacctaccgtagtttcgtttccacacgagccattcgttggatcaatgatgtggagaagtcgtatgaaaatagtggaaattcaatgcgcacctcgtcaaatcgaggcaactttataagcgtagcaagatgctctacggcgaacttggctattgtctcccgcagcttcgagttttgtgggctatccaacccgtagactttctcgataatgtggatgaattccttgttgtcccagactagggtaagtctgtactccagcttcttctttgccagggccataagtggttcaatggcatatttatcagcaacgttgtacatttctatattgacatgcgccttggtggtaggagattcatagtcaggattcgtggcaaggtgactcttgtccggagaatcgtcgtagtctccacgatagaaataatcgatcattttcttgatgatcgtgggatcgtcgtggatagtaacgatatttgttttggcctcctgtaactcgttagagtcatacatgagatatgccatgtgctcacctgaaactccccacacagggccttctcgaagaattccgattgcggacagattatacagcgatggactttgaaagtcgatgaatggcattttatttcgacgtcggaatatattccatttcggatgctaattttttgttgcgttagctggtatctagaaagaaaaaaaaataaaaataaaaaaataaggctctggaagatatcacttcgataggatggcaagaagggtgctaagattggtggccatgcttttcaacggcgcaagcaagtgcatttttgacggatgagcgaggatgcttagatgttaagaagagtaagtcaatggtgatattccaatcactcgaatcaatacgtcacgattcagggtaattctagggtcatgtttacgttgtggacggatacgcgctgtgggcttccgtaccaatgaagactatggggtagaataggtttttgtactttgtgcattcagagctctacatatgttagcttcatgtctttatataaggggaatagaagatgttgcaatttttttacgagttgtcccaactcaacgaggttcggtgaccgctaaaatattacacatcctacaggagggctttttaccccaaggtttgcggtcacactgttaacaacaaccagtgctgattaacctagtagtagccacaactacccccggagcctcgatcaccagaagacaacaacgactacgcaatgtcaatccggagatcctgctcgaatctgggctatatcctggcgcctaccaaacgctgcttgttaatcaggtctgtgaagcgacaccacctagagctccgaccaaaattgactcgcagaagactgtcgttgtgaacatcggttcaattgggcacatataatcgataaggcattgttggagcttattcaattagctatcaaccgaatacaactacttcatctgagtgacagaagaacgccaccttgtataagtgaggcgcatacgtgattacttgatctgcatgggataaacatcatcctgtgtaggcaagatccgggtgcatcaacgtttcggaatcttccagtgggggaaccatcgaaccttgatcgaattgcggttccactacctcacagacaattcctaattctttatatgctttccctccccgaaaagtcgtacagtagatgggtgtgtcggatgactgatccaaggcagccttgaaaagggagtaagattttggcgcggggtgtgtggctatgccatgtaatcaaccaagctacctaacgttactagtaagctcatctcacccgggagacaactacccgacatccggctgcatcttactcttcccaaataaaatcactattcaaatacctgaactcgctgcctccaatccctctctgcatactctctataccctatctaccccctatctttccagtaccataaaaacaaatcaaaatggcctccggactcatcctcaacccgcacaacctcctccgcgccgccccactcgtctcatccacctgcaccctctggttcgcattcgaccaagacctcgtcctaaatgtcttcctgcacccggaccaccgtccccgcagcaacgaaatcctaccatcttatttcaacgtcctcttccgccgcggcgttgtccgcgtcgtaggcctcctggccctctccatggcgggaggcggatacaacattctaaaggaccgccgatcaggggtagtcgcgggactccaatcatccttgtcgtggtatgtagccggcacggtgcttgccgctagtcatctgctttatgtgcctgttattgctcccaaggtgctggccatcatggaggattcgtcgaagggttcctcgacggaggatctggagggttggttgactatccatcgtgtaaggacttggacggtggatttcgcagcgtgggcttgttttgtggtggggttggggttggcctagtgtatatggattatggggatcgatgtgtatgatgtaatggggtggaaatgtactcatgagtactcatgtaaaatgcgcaatgatattcgatgcagtctatagattcgtatttctctgtgatctccaccgcatgccatatcttcgtatacaccagacagctgctgcaccacacactgcactcatgatgccaagggcggtaaaataccaccctaatcctgcagcatccatcagaggctgcaggctagtcactcctattgctgccatagcacaccgtgttatgcttgcacttgctgcggcagtactcgggttctgcgggaagatatcgaccaacaatgtgttgtaaacagtgtagaagcacgtaccctagaacccttggattaattgcaggatcaatagaattgaaaaatgcttttcatttcgcgcagtccagccgtaggcgatcaatgtgctagtggagaagagaagaaggtaatagataccacgagaccgcgctagttcgattgggaactcacgcagatcatcgccatggactcgatcaattggatgattatgtttgcgggcatcgcttcatagttgtaatccattattcggccattgcaatagccgcctccgatgataccaatgccttgtggaaagtaagccaggccggttaataacgtgttgaactgatatgtgtgcatgaaaatatcggaaaccgtagcggcgaggatatattcaaccgcgtagaaagatccgtgcatccacaggcagcaaaaggcgtctggaaagaagatgatccgtaaggggactagaaacattcggatattaagctgagtgaagatgctctttctcgcctggccagaaggactttgctcggtattacctgcaggtttctcttntcgggtgtcgttctttttattcagtaaaaatcccncggctgtgatataactccaccagcaccggtnccatgctttaaccttcgtcctatcacttccattcccaacaatgttgcgcccagtctcaggaagcagtataccaacaacgaagaatagaagaatcccgacaataaataaggcccagaagacccacccaatatctccactcagatatacaaccagcccacccatgatcgggcccacacaggtccctagattcaaggccatactgacccaacccatcatcctaccccgttcactgggaacgcagacatcagcgacaatgccatagcttatagcaaatgaggcactggcgccaaggctctgaagagcccgtaatagtaagaggacaccatagttggatttttgagtgccatgcctaaattagctaaagcatagatggcgagggtaagaaggtatgttggtcttcgaccaacggaatcagaaagcggtccgaatattgctggtgatacagcttggaagcttatatagatggtcaatgtaatatctattgcttgccgcgatgtttcgaattgggtctcaagcattggtagaagtggaaagtatacggtcgcggtgagaggtgatgttatagttgcaaatcccacaattataacaatgaacattcttgttttggaagtgaataatgtgtatggttgggtggccggtggctccgaccgttgtgtttctggggtgtcattggcagcattggtagcaggtacagagtaatttgagggatttgcgattgcaataacacggcttttctggaagtgaacaaattgaattctgctcattacaaaatgtattcgccggcagtagggtaggatgggtgacgacaaaacattcagcggggtgaggcagcgggggagtggtacagcagttctttgttctaaatcggtgcatattggacaccacgctatccaagcaataacttcatcatcaatttttaaatagcacagtgatgttggaagagtcatccagcttttcatggagtctttctcaaacagcactttggggtagacggtatgaaagcatgttcgagtagacaccatcccatctcccttaagttatggtcagcactgatctttctctccccgctagttcttgacactttcgctcgaaagcagttgacagtcatcatgccctcaaactcaccagtagtcattgacattctttcaggcgaattccgcgtcgatacaaatctcgccagtcagtttccgcccggttctcaaatcgtttctgcaattcgcttcgggacctcagcatggaccaccacagcacgtctctgcgtgaagaacaatattgggattgagaaactatatttcctcaagtgtgctactggggacaatggtcgtttattgatacaaggtgaattcaacgcacagtgtgaactctacaggacgatgccagacttcgtaccaaagccttattcttggggcgagatcgatcggtcagaaccaaagacatattttcttctatcagaattcatcaacatggccgacaggatcccggagccatatcaactatgcaccaagcttgcccggttgcatcgcgaaagtgtctcacctacaggaatgtttggcttccatatcacgacctgccagggaaatactccgcagaacgtttcatgggagagtagctggactatattcttctccaagcttctcaagcacgttttagaccgagattctgcagtcaatggagtctgggaggatctcaatatactctctcagagggccctgaattatgtggttcctcgactaatcggagtacttgaggctgaaggacgcaaagtaaaaccatgtctaatccatgccgacctgtgggagggaaatactgggacatcttccaaaacaggaaacatctatatctttggctctgccgcattctatgcgcacaatgagatggagacagcgaactggcgatgcaactataacaagatccatgaccaagtgtatatacgcacttacttgcgtcacttcgcgcccagtgagccacgacacgaatgggatgacaggagccgcatgtactcggtatactacaatattatctactctgtcaatcataggagtgaggggactgctgttcgtcagatgtgagctaacccctgttgatctctctgcacgcgcgaagctgactctgacgccagggcctatgatgacttgtactatttgatcgataaatatgcgtcgtttgaagaaggtataggccctcgaaggattaacgaatctgagcgagcctcgctctcggatgaacgagaccatactagagcttgagagagcatagccagctcactgtatagataacgaaatgtatttcagaaaattgttcttctattgatgaaaacgcaatgaatgttgagaccagtctgatttgcgtattccacctgtatatgctttaccaataaagttatgctgtcttcagggctcgcgttcatacccgagctcaaaatgtaattgcaggtcggatgacagtaattttagctccgttgacccaaccggttaacaaaaaatcaatatacattttctatgtctttccaaatagcaagaaattctagtgttttgaagactattttcttcctgtatcgtagaatcaggtatggtttctggaaatacaaaaaatactctagtatctttgaagggtcggttgactctaaacttgcttgttgatagtcatgtcagtcacgtgcaaagaaatacggtcacttgacccctcgcgagcggtaatatacacgctcaaagttgaaagggttcaagagctcgagtagctgggttcaaccccttgaagctcggcacttatcttatcggcatttcacgtgatacattagtcatctcagcgattccgccacccgctccgcgtcttgattccaaagcgctccgctcaacatctcagcgttccttctgtccttttactttgctttctctgggagattatttagaatctattgtctgtgtccaacatgccgcgcgcagaagctggatccacaaaggcgatcagcaacaagatcaaggctgtacgttgccctcttgtccacacttaaaacaacttactaacgtccaacagaaaggcttaggcagacttagatggtattgtcaggcttgttcgcgccagtgtcgcgatgagaacggatttcgctggtaagttctacaatttgtggaacatccaacgtctatgatactgacttttcaaagccatgtccagagtgaaagccatgtgcgccaggtgctgctaatcggcgaagaccccaagaaatacatcgaagactacagcaagcaattcctcgacaactttctcaatctactaaagaccggtcatggcgagaagaaagttcacataaaccagttctaccagcaagtcattgccgataaggaggttagtggtccgagtggtccttgcggaatgagtctgtcgctaatatacatgtagcacatccatatgaacgccacaaagtggaagagtctttcgcagtttgctgcatacctgggtcgcgagggtatttgccgtgtcgaggagacagagaagggcctgttcgtctcttatatcgatcggagtccggaggccatgagacgacaggaagctttgctcaagaaggaacgccaggaccggggagatgaggagcaggagcaacgacagattcgagagcagatcaagcgtgctcagcagagtgcgaaggaggaggaagaggtggaccctgaagctcgcaagctgcagcgcaaggagggtgagaaagtcaaactgaatatcggattcggttcgaagacaaacggtgattcgaagagcgagtcgccgaagcccgcatcgcctgaggaaaaggatagcggtgcatcggccacgccagagactaccgatgctgcacctgctcccgctgccgctgccgcccccgccccgcctgcgccacaggctgcgccaaaggtgtctttgtcattcggtggtggtggaaacaagccgaagaatgtctttgctgcggctgtaaagaagaaccctcttgcgggaaagaaggggccagtcatggaacagcccaagaagatgacggagcaggagcgcatcatgaagcaggagatggaggctatggagcggaaacgtatgcgtggttctgctgggttccctgacgcgaagcgcccgaagatctcttgagttggtcgttcgacaatgatattcctacgtgggttgtacccataactccacaccctcatcggcttcgatgccgctccgcccaggcgacgttaatgcatttgttcccgtcggccagtgggcaatggagaaacaccatgggggatattactatgacaagtcagacctcgatgacttttacgccgcgcgctctcgatgtcggtggcggcatttgcagcaacgcgttcttgcgataccgttcagtcggatatttgttgactgggacgcactctttctgctgggtacaatgactaggccattggcgtggtcaccttgagttcttcggtcgcctatgatagatttatgactagatagcgttggccaataacactgtcaactaatgaatatataacttgcatgttatatgtcgctgtatctttcagtagtgtctcgatgagtcaagtgcgtacatgtctccgaatgatgctatttgcctgccgccactctggatgtccttcacacgccacggtatagcggactgcctagatatattggtcgggcagggggagctttgcttcggtacccgcatctgtcttgtgccgtctctcgtttgggttatttggcagataatggctgtattggagtgatcattatgacggtgggaatcaataagttcttacccaaaatgtattacccggggttaaatatatattactagttactaccaaaccccatccacggaattactatttaacatcttgcaccattggaactcgctctgaacccgactcaagagaataataaaacccgaataatagtagtgatagagtaatatcatcacaagtcgaataacaaccaagaatatccatgatactccgccgaacgtactggtaggtcatttgcagtttgctgttatgatagatgttctactggccgctaataaagccaaagttagaggcagctaccataacaagcccgggtggtctagtggtatgattctcgcttagggatacaaacccaagcatatctgcgagaggtcccgcgttcgatccgcggctcgggccttgtaccttccttttttgcttttgttccgctctcgccaacacaattgtctctcccaagcaaggagagagagaagaagctgacgagaaaaagagtcaatgatcaaccagggaggcagcaaaatagttctttttcttttattagctgatgagctgtatctttgctccaaattgatatgaagcttttctttcgtcccgctcatgagcccgactcagcaggaatccgccatcagctcgcacttggcctcgaactctcctgcctgcgccgcccttctccacgtaccccatctagaatgtaacacagcgtgacctaatcagcatatgaatctgacacaagacgtgagggttcttgaactcaatccaatgcgttgtcaccaaccgacccaccacccccgcagtgagccataatgtctatctatcgttcgggatcacacccgagcccggcatgtcgcgccgtgccttttccctccactggcggagatacgttccgctggttgattgactcacccatcaattttcatttttttttttttttttttttttttttttttttttttttttttttttttttcgcatttgaattctggacatatacaaaaatcatacggcaatcgagagtcacacctacacacaccacaaagatcctactcaatccaaagatggccgtacaatcgctttccccagaggggaggcagaaaacactcgcttttatcggatgtggtatgtatctatcaccaacactacaatcaaacaatgatcgacaaacacccaatatctacaacctgctaatggcgaataaaggcaacatgggctccgccattctaagcggcctactggacgcaacgcgcacccaagcgggaaaaatcaaccacttcatcataagcaccaagaccgccgcatccgcggaacgtctccgcagccaatatgccgaggacgcatcccgcgtgaccatagcacatgactccaacctccgcgcaatgcgcgaagcagacatcatcatgctggcctgcaagccctttctagccaagggtattctctccgctccgggagtgggggaagcgttgtccggaaagttagtgattagtatcatggcggggatgacgcccactgacatactcgactgtctgagcgacggggatcgcgagagtgtcaagattgttcgggcgatgccgaatgttgcggcgcggttgcgccagtctatgactattgttgagcttcctgagacgaagccgctggaggaggagttggtggagattgtgacgtgggtgtttgaggtgattgggaaggtcaagttcttgagtgcggatttatttgatgttgggacgatgttggtcggggctgggataggcgttatgacggtgcctttggagggattgctggatgggtgtgtggtggaggggttgaggagggcggaggcgctggaaatggcggctcagatgctgtccgggatggcggcgttgttgaaggaggggtcgcatcctgctgttttaagggagaatatttcgtcgccgagagggtgtactattcaaggagtgatgacggtggagagagctggagcaagagcgacatttgcagatgcggtgattaatggcacgaggcatctgatgggggatcggtaggtgaggttactatactcggggtatgttcccgaatagattagatcgaaagatagagaacgatagcaacactcatagatagatagaacactgatagaaccccgtcaattgatatattatcctcgataagaacacacagcacccattggaccgtctcaactgctcccatatacctgatttcatcatcctgcagcggtacccttaaccgagtactaccggaaacacccaccgaaccagtccatcatccatcaacaccaactacaatgtacctagattcctgcagacacaacccccctcgcgtggaatcaagccaatcggtcaaaaaaccgtctgccgtgatcaacgaccacatactctgcgctggcgtccctacccctcactactatcatccggcagctttataacgaggggataaataagtagacagggaataccataagccctgaacgtagatggaaggcatctaaaccgttccttgaaatgagatcgaaagtattactctggccaaaacggcctactcctcttctctactaccaactcctccaccacccaccagtctactaccatgcctactacaacacctcgtcaacgtcaacaacaacaacccaccacacagtcccaccaccagcccccaagaccccctccccagcacccctatcagccctaccaacccggaccttcctccgctccctcctcttcacctccgtgatggcctccccgctcctcaaaccgtgtctctccttgctgaagtacatggtcgactcgaactccttgctctttagtccagctaagaacccagtcgtgaattatctgctgcgcaggacgatctatgatcacttctgcgccgggattaatgagagggaggtccggaatacggtgcaggagatgaagtcgctggggtttaagggtgttattctggggtatgcgagggagtcgattgctaaggtggaggatgtggatcgcattcagtcggctgaggagaagcaggaagcgctggatcgggcggtcgaggagtggagggtcggcacgttgaggacgttgggaatgtgtgggagggggaattatttggctgttaagtatgctttctctcttttcattacttattggatgggtgtggagggtaagtgaatgacgggtttgggctaatagtgtttgtttctctacgcaggtttaccggtgctggtcctgcggccgtggaggccctctcgcgcggggatcgtgttccgccaccccggattcaagaggccatgatggagatttgtgatgctgttgcggcgcagggctcgcgggtgtggattgatgctgagcagcagatcttccagggtgcgattgatgcgtgggcggtggatttgatgaggaaatataaccgggtgaatagggcggatgcgcctgttgttttgaatacctatcaggcatatttgaagtcgtctacggctaggcttaacgaacatctccagctcgcgcagagggaaggctgggctatgggtgtcaagcttgtcaggggagcgtatattgcgcatgaccatcgggaccgcattcatgacaccaaggccgatacggacaggaattatgatcatatcgtggagagtctgattacgagacagtatccgctgggcggggagcccggacagccgtttccgaaagtgcgtctgtttgtggcttcgcataacggggtgagtgtgcggaaggcgtgtgcgctgtatcggcagcgggcgcagagtggactgcctttgattccggtggaggttggtcagttgcagggaatggcggacgaagtgagcctggggatggtagagggatcgacggatggagcggctccgggggtgttcaagtgtttggcgtgggggtcgacggaggagtgtctgcatttcttgttgcggagggcggttgagaatcagtcggcgatggaacggacgagagatacggcgcgggcgctgagaggggaagcttggaggagactgggtgggggaagtgtaatgtaaccacgttcttccatcgttcagttcaatgtgaatatgattcgatgattatcgatgtagtgatagccagttgtatacttttcggctcggaaacccgaggtcggagggcgttccggagtctggattatctttggagtgaatgtttctttccttagaggaactataacttgtgcctgctatcgcagcactcggacttgggctcccgtaccttaacattatgcgtctgcccttatcagctagggatcgcctggacgctaagctaaaggatcggcccccgtctacttcgtaggatctccatagcctctgcataatcggcatcctcatcctccagcacagcttccctctcacatccctccagtatatctagcacgtagtcctgacaatcccactcgagggtctcgttgtccaccggtgtggcgtcgacaacatccttcacggtcgggatatcggggctgccgatctgacacacaaacaaagattctataaaacccagattatcggaaggaagcccattggacatcactttttggaagcagggatgctcgccgtcgacttcaaagatgaggtcttcggtgtttgagtggagatggagggcccagtgttgaaagttgccgtagcgggggtggtagatatccacggcgaggtatgggggtttcatggccagtgttgttgatgactggaagcaaggcgtactgttttgtttttgtggagtgactatgattatgtttgtatgaagggatgacctgccagtgtctgtcgtggcggggatcatctctactgtcagtaaggaagagggcgaggggagggacatcatgcctgaggcagagaggcagcaaggcagcaaggcaccgcagttgtgtgctttgcactgcttgagcctctttcccactttccctttcctctttcctctttcctctttcctttcccccctcatcccacttcaacttcctcatcactttcaccattcaccacatcatcatcttccgtcattcaattgtcttccccgccatcccgtgtctgttccttggttacctcccttttgccttcctttgtacccccggccgaccacgtcgctacccaatcatggcccactgcaggggcttgtccgtggcactgggcccaacgcgggatccccggacttccggcctcgcaccattccagggccttccgtaccccacaaaatgacctggtcgagtaggaatggcctgccctgaggaccgtgccagcaaagtgacgaaggtacttcggttcggttccatcatctcccgcggggtaattccatcaccgctgaccaagaagtcctcaagaattttctcaaggggcagtgcatttaatctcctggtgttcgcctgtctctcgttcatttcaccgatcgcccttggcattccctgtctcggacacgaggtggaccgactactgcaggataaaactccgatcgaatctcgcgtcgcactcaaatcttatttatatctcctatccttttctccttccccctcgactttttgagcggataaagcaaccgcatagcttcactaggctcccggcctttgcaagatgcaagtcaaggtatggttgagagcctagcccccgtaaacttgtcgctgatgcgcttgctagttcctggcaacgttgttgccgcttttgctgcatcttcctgcggctgtggacggtctgccaggaaagaatgcgcgtatttcggcgtccctgaagagacacgctgggcgcgacgtgccccaaacagctcttaactccaccaatgtctatcagaccaagttctcgggcgtgacctgggatgaggatcattggctgctcaccaccaccacgcctgaccagggccactaccagtcgcgtgggtctgttgcaaacggatacctgggaatcaatgttgctaatattggtcccttcttcgagcttgacgaaccggtcaatggcgatgtgatcaatggctggcccctctactcccggcgccagagtttcgctactatttccggtttctgggatagacaagcccacaccaacggctccaatttcccctggctttcgcagtatggagatgacagtgtaatcagtggtgttccgcactggagtggcctgattcttgacttgggcgatgacacgtacctcgacgctaccgtggataaccgcacgatctcgaactttaagtctacctatgacttcaagtcgggtgtgctgtcctggtcgtatacctggacaccccaaggaaacaaaggctcttatgcaatcacctaccgactcttcgcgcacaagctgtacgtgaaccgagccgtggtggacatggaaatcacccctctgacgaacggcaatgctacggtggttaacgtgctggatggctatgcagcagtccgcacagactttgtcgcatctggccaagaggagggtgcgatcttctctgcagtgcggccttggggggtcaacaacgtcacggcttacgtttatgcaactttggatggctccgacagtgtcgacttgtcttcgcgtaggatcgtcaccgacaagccttatgtgagcacaaacagctcgtcggtcgcacaggcggtcgatgttatgtttactgcgaatgagactgtccgcatcaccaagtttgtgggtggcgccaccacggactacttccttgccacgcaggagacagccaaggctgcatgcctggctggcttggctgatggctacgtcaagtcgctgcagtcgcatgttggggaatgggccacgattatgcacgaccactcggtcgatcgcttcacggatccagcgaccggtaagctacctgaagacagccacatcgtcgactcggccatcattgctgtcacgaacacctactatttgctgcagaacaccgccggaaccaatgcgatcgtggctgctggtgggattcctgtgaatgttgacagttgtgctcccggcggacttacctcggattcgtacggtggccagatcttctgggatgcggatctatggatgcagcctggtcttgtggcctcccatcctgagtcagctcagcggttcaccaactaccgtattgcattgcactaccaagctcaggccaacatcgaaactgcattcactggctcgaagaaccaaacttcgttcagctcttccgcagcgatttacccctggactagcggcagattcggcaactgcaccgcaaccggaccctgctgggactaccagtatcatttgaacggcgatattggcctggcgatgatcaaccaatgggttgcaagtggtgacacggcatggtttaagaactacctgttcccgatctatgacgcagcagccacactttactctgaactggtggagcggaatggctcctcctggacattgactaacatgactgatccggtaggtaatctgtccctgtcacatgatttagctgacctccgcaggatgagtatgccaacagcatcaatgcgggcggatacacaatgccgttgatcgccgaaacactgcagaacgccaacaagttgcgcaagcagttcggtcttgagccgaatgagacatgggacgagatcgcagaggacgttctgatcctccgtgagaacggtgtcaccctggaatatacgtcgatgaacggctctgctgtcgttaagcaggctgacattgtgctcaacacgtttccgttgacttatgagtcagacaactacacggccacgaattcgctgaccgacttggactacgtaagttgcaactccttatgtgacgtgctatgctaacaactacagtatgcaaacaagcaatccgcagatggaccggccatgacatatgccatcttcgccattgttgccagcgatgtttctccgtccggctgctctgccttcacctatcaccagtactcttacgctccatatgcacgtggcccgtggtaccagctgtctgagcagatgatcgacgatgccagcatcaatggtggaactcacccggcattcccgttcctgaccggccacggtggtgccaaccaggtagccctctatggttaccttggtctccgtctccacccagatgacaccatctacatcgacccgaatctcccgccccagatccctcatattacttaccggaccttctactggcatggctggccgatctctgcgtggtctaactatacacacaccaccatccagcgggattcgtctcttgcaccgctggcaagcgctgaccttctcttctccaacgttagcatcaaggtccaagtcggccagtccaccgcctcggccgatgaggcaactatttactaccttccactctccggagcactgactgtccctaatcgcatgatcgggtctgttaacacgactcctggcaatcaagtccagtgccatccagtttactcaccggatgcctacgaaccgggccagttccctatctctgctgtggacggcgctacttccaccaagtggcagccctcgacatctgacctgacttctttgacagtcactttgtctaccacggcagaggctggagccgaggaagtttccggcttctacttcgactggtctcaggcaccgcccgagaacctgactgtcatcttccacgattcgcccatcgggaacccctccactgtgttcgctgccgctggctcgaactctacaggataccgggtgattacatcgatgtccaacatcgtccagtctaagccgtacaacgccatctctgcggaggagctgaacgttgtctctatccctaccgccaacaccaccaccatcacactcgatgcgcccgtacagaaagcccggtacgccacacttctgatcgcaggcaaccaggccaacgagactgctggtgctaccgtggccgagtgggtcattctgggacagaacagcacttccagctcctcggcgcaggccaagcggaagatgagtgcgcggagcaaggccactttggctcaactcagctgaacagcttgcttgctctcgtatgagacgttcgcgtctgtatcataggtatcctaccatatctggaccagaagtacgtaataatcaattaatgctacataatatgaattacgatcgatcgatccttgccagccacaaccggctacaccgatccagtctttcgaccggccagtgtaccagccatgactagataatgtatgtatgcgagcacgctaatagatacaagaagacaaccccgccataatgccgctgtcataagagaacagcagaccataaatagatgtccctgacctcagagacactcatccgtccacccatcaccactcaccctcagtaagaacagctcggtcactcctcatcgagcgcaaaccgatccaggaacctaaacgtcctcaacccctccctaacactgtccacaaagtccgccccaatcgtctgccccaccacaacaccctctctctcatcatcaatccccgcattctgcaacgcgccctttccactcccaaccgcccccaccgtcttcccgaaccggaacgcatccaccagcacctgcaacggcctgcccgccggatacagcgtactcaccgcactcgctgtagaattaagctgcggcgccgtgaccgacccggacgcaaacaacccctccgccccaggcgccacaaccaccgcatcgaactgaatcgcgtctgaggctgaataagtctgatcgactccatcggtcaatctctctgcgacaaccaccacgtccacttcatcgtctttcagctccgtcgcgaggtcctgcgcggcggtgatagaagatggtgtttgcacggaggccagaaatccgactctcaggttcgagagcttcttcaacttcgtgccgaaggtgcctacgtcggcggtcttgttgtcgtggtagtatgttgggtcggggtccggggcggggacgtcaatggcgcgggcgacgcgacgggcaaggtcgttggagatgcggttgagttggatgatgacgttctggcgcacggtggtggatttgacgttgctcgtttcgaagcggatcgcgtcgattaggaattgttgttcggtgggcacgagcgagttgtagaagaggcgcggctgggaccagacgtcttggaaggtcggggaggtgctgcgcaggaggtgcccggaagtggtgcggccgggggatgtgaagaagccgttgccggttgtttggttggcttgtttgggggaggcggagttgagggtattgggggagtaggcgttcggattgagagggatgtacatttggcctatttatgggttagtcggttgttgtaggaagagggagatgggggagggatttacctgcaccatcacggttgttgttatggattgggacgcgaggctggttaatgggcagctgttcgaagttggggccgccgtggcggttcagctgggtgtcgaggtacgagaagagacggccctgcagcagagggtcttcggtaaagtcgactccgcggacgatgtggccgggttggaactggtgcggttagattggttcgtagcgtcggtaaggtccatgtaggttattcgggtggagagacaaggaagcaaggagggacataccatgacttgctcggtttccgcaaagtagttgagcgggttgcggttgagggtcattttacccagcttcgtgatgggcacgtactcttccggcacgatcttagtgggatcaaacaagtcgaacccgaagcgcagctggtcttcttcgtccatgatttgcacgccgagctgtggatgttagctgtaagctcgctgtaagggactgtgtcgcacatacctcccactccgggtaccgtccatactcaatcgatgtccacaggtcctggcgcataaagtccgagttcttgcccgagacctgttgcgcctcttcccagaccatactggccttgccctgaagcgacttccaatggaacttgaccagcttcgacgcgccactgtccgtcacaagccggtatgtgtgcacgccaaagccgtcaacatgccggaaggagcgcgggataccgtgtccagccattgcccagaatagagtatgcagagcgctgggctgctggctgaagaagtcccaggccgagtcgtgagcagtcgcggcttgcgggatctcactgtcacctctgggcttgacggcgtggatcaggtcggggaactggatggcatcctggatgaagaacacggggatgttgtttcccacgagatctgacgagttagtgtttggctaagagtacggtaaccaggggatagcttaccgaaattaccctcatcggtgtagaagcgagtggcaaaaccgtgcacatcgcgcgccagatcggtactgccacgactaccagcgacagtggagaagcgcacgaacatgggagtttccttgccctgttcagagaggaatgaggccgcggtgaggttggagaagtcgccgtaggagacgaagacaccgtgggcaccgacgccacgggcatgtacggcgcgttcgggaacctacattcttagtggtgcaattgcgtagtagataaacaaaaggacttactcgttcatgatcgaagcgctggatcttctggcggaagataaagtcctctagcagagtggggccgcgttcaccagcgctcaaactgttctggtcctcaatgggaccgcccacgtcggaagtgaggtaagtattattgtcattgaggtagtactgagagaggaattcctcagtggattctgaggcatctgaggagtcgcgagcagagaggtcacgactcatgtaagggcaggcggcattggcaaggccaatgaggccaacgagaccgatgggacgcatggtcgcgtggaagggaaggggggaagttggactacgtccagggaagatgaggcaattggagcagtgagaggagaaggaaggggaggggaggaggagagaagagaggggggaactgagggaattatatagagaggcattggcattggcattggcattggcagcagctactaattgactagattgtatgactagtaacgaatgtaggagccgtccgtcccagcatgttttgttcgataccaggcgtgtaccttacttgggatgatatctttcggtaaggaatcctgggatgcgtatcgagatgcagacacacggccaatggcgcgttgctcattggccggggggtccatgacccggccgaagggcaggcttggcgatgaggaggaggacgaagctgactggcggaagggcttggtaatcgggaggtctggatggaaagggactggcttggcagacgatgacgtgaattccactcgtgtcgtgccataatacaatcatgatgataataataataataataataatatcaaaatgggcagtgatgttgcacgaaatccggaaagggattggaaagtatcgggattgtcaattggtcttccccactcatgtaacaataacaataacagtaacaacaacgacaaccacaaatggtcttccccttgcaggtgagaacttctattcagcggtaactagcccaaatacccattgtactaactcaggcatgaactactaccaactcccagggacaggcttcatgcacgagggatacaatggtcaggacatgttcatgttccatctgcaagtccagctattaataacacccccgacggttccttacagcaactactagtactagcagtatgatcagaccattcagccaagcccacccccgcacccggggattcttggtcctgcaacgtgctggatttccatcacaccgacgcgtcgccaatacctgttaaatcataaatattctatttctgtacaacacctagtctatacaccacccatctctatcggtatatactatctaaaaatatttcggccaaaccgggtccgcccacgtccttctcccctttatcaactgactatccactccatccgccccagaagaaacatacaacaccttcgcctgcgccccctcattccaataccgatacgtcacacccttaggaacaaacaccacatctcccatctccactctcgcagtctcatactccccaatctgcacctgcacgctaccctccagcacctcaaacgctgccgggcccgccgtccacgtcggcgccgtcgcattgctcggctgccgactcatgatgatcgtcgacagggtatagttcgtatcttgggcctgcgtggccgtcaccaatggctgcacgatctggtacgccccgtactgcgagttgaggtacttgggaccgtagttgttggcgatgaagtacggcttgccggcggcgccgagggtatcggactcggtgtgccagccggaatcggagggggcggagccgttgacgatgtcccggcggggagtgaagtcgagctgggcgtagacgtcgtattgttgcaggccggagatggtgctgctgtcggggccggtggcggaggatgaagaggagttgccggagccaggtacgtagggggtttcggttccggaggtgtagttggtgccgagggcgtagaagaggtccctatttgttttcaacttggttactatactgatatgagaatgaatagatggggtttttggcttactcgaatccaccaggaacaatcactcccaccatctcggtgtccggatcgaggatctggaaggtgtgggtagtgttccggggaacagaaccatagtctccctgggtgaggagacgagcttcttgttctccatcgcccttttgggcccagagctggaagcggcccttgaagctgaagaagttctcatagtgtgtgcggtgaatgtgtggcaggacaccgagggagctgctcgagggcgcattggtgctcatcagggtaaaggcatagtcggaggaggggccggtgacggtaaatcggtagagctgggagtcgatcgtcacggcatgggagttctcatagtgagggaggatataggggcgaggggaggagggggcctcggagacgtagaggtcctcaacggatagggctgaggtgagagccaaaagcgaggagaagacgaaagaacgcatggcgatggagactttcagatttagcttccgatcagatctctgctgcttcttccatagatgttcttgctatgattctacaaacttatatacccttcgcgtggacaacgaagtccgatactcatcccggaaatcccgagattctgtaacatggccatctggtacgcgaaatgagctgccgactccatcacaggtttcgatctgctgaaactgcagatagacgagcaactggacaagactatagggcagacgaacctcggtgcctgaatgtatccgggcctcagtcccgggtatgacgaaacgccgtgtgtcggaaaatccgagagtaggatagcgatcaacaggtccactgcaggaactatccaagccaagggacgccgtccttggcggaagcagagtcaccctgccttggattcttcaccccgccagttgcagattatctgcagccacctatacctaccttaaactttccctcgtagtctataaaaggatcagtcacagagacatcaaatgcctacttactctacacctcttatatagaaaaccccaagaatactgctgaagaccaaaaggccccgatgtcgatcaccgtcgatcatcaaggcccgagagctccgataaacggcgggtcgtcaactcggcacttgtacttgcggaaaaactacacagccagcggggaaatgccgcatacccaatgtcaactggggatagatagtagcagtactccgtacactaaccagttctagtaagtctagacatcgcttgagagtcagctacggacggattcaggaacactgaccgtcaatccgcacgtaactagtgaggttgaagttgtctgaagattgactaagcggaacaatccggaaatagttaaccaactagccagtttctgtaggagggggacctgttgtagcagacttgggtcatttatgaggatcagcctggaccaagacttttggcagtgaccggctaaagtaaatagtctgctttgtagtgttgtgggagcgaggatggtggtggtaaaacgccaaggctactttgacgttgaaacggccgccagtttcatccgctcttccgctgacagactgtcgggtgtagacataccgaggagaccgctctcgaataaatccaatttgtatcttagcacgacatagttgtgaaatattgtgtaaaagtaaatagtgaaaaaaaaaaaaaaaaaaaaaaaaaaaaaagatgaatgcatgcatgggttgtcattattagttggggtgcgggtgcggaggaaaaaaagaacggcgaaaaaagatttgtccctgggcggggtcgaaccgccgatctcagtgattcctgtatgatgaaaccataagcactatgccttaaccacttggccacagggacaactgttggatgtggggaaaaccttactatggcttataccctacttctggcgtatccgtgtaactgtggtcatttgatccttgggtggagtatggggttgtggataaagctggggacgtttaaagtttggtactacatgaatttgctatagagtggtcttacttgtttggtgctgtgtagctatatctgaggtatttgtgtcgtggggtgagtgccaggtctcctttgactgacttccgaccgaaaatatataagcgcagtaagcaaggtaggctatctattcagcacttatttatctagctacagtacatttcaatcctccccatttgtcttcaacatccaacaatgcttgactatctgatcacggtccatatcgatcttctcagcagacacccccgacaaacaaaactgtcttcccgccatgagcgataggagtactagtttctaccacttccatcactcccatgagaccctctcatccggcgataaacggaatacacatcctgcactttatccttctcccaactaaccagaaacttattcctctggacaaagtccatagtgtttcgcatcttctcttccctcctttcacattctgtatccgacagctcgccatctgagcaccgcagatatatcttcaacatgctgaaacgcttatccttcggaagattgtaggtattgtaattctggttgatttttcggtggatggtgatgtcccatggatctttcctgtaacatcatcatcgttagtattccatgtctaagcatgatgacgatagtaatgggagaactcacgtatccagcgacatactctccgcgaccaccgcatcccaaatcatccccaccgggctcgccaaatccataacgatctgccgaacaggaacatccggagaacacgaaaacacaaaactttcgtcatcaaccaacagaaaagccttcggactatccagcacagtcattccgcaatcgcccagtaccttcttatccagcttcgtgtacgccggatcctgcagcagaatttcaatgtctgtcggtgtccatgccatttcctgcaacactcttcgtaacatgagcaggaaggcgtgctggtaggcacttcgctccctagcaaacttgtcaagcttggggctgcataggctgttgcatccgaaggcgatgatcttggtgacggggcgtttgatggtcggtagattgcggagagtagctagcatgttcttgtagatggcgctgtctgtccaggcgtggaatatggagttgaagctttcgtgtgcggctgctatttgtttgtcggtggggtcttcgtcttcgtcgtccgtgtcttcctcgtccagacggcggaatttgtggcccagggcgaggttcgagtatatgagtgagggatggcgcgttccggggttgggcgtgatgtagtctgttggggctgggaagaattcaaggaaatgcttcaggctggagtcatcaaattgattagtattttacatcgatagaagatgaatgaacacgtacccaacaatagctacaccctgtttattgcgctcaattctctcagtcatcacttcgaaatcaacattcgcgccatccaatgcagtggtatacacgacttcgccgggcttacacctctccactctcgcttgcgcctcttggatggcttctttggtccaccggggtgtcccctctggatatagttccttgtacctttgggccctgagatgggaggttaaaccagcatcgggcccaccaggtcgtagggaaggctgtaagccaatctccgaaacagcacggctttgggtggtttccgttagtggtgccaggtccatggggtcgcttgaggttgtagatgacgcgctatccatggactcatcgatgtccatgggatcgggggtatacacagtaccgggagtattcattgttgactgaggactgtgaagatgggaggtgcacgagggtgaagatcgaagctagatatggtgtagatgggtgaatgcgaaggctgctgacatagttttgatgaccagcgaaaaagacggcttaagaagagattgcatgctggagtaatttatatctgttttcaagagagtggagagaaaaatggtaaaggaaagttttcagaacaattgaccatattgcggctcttcccttcgcattcactgtcagctaggctgcaatttggagggtcctgaagattattactggacttaggtttccagggagattcgagaagagcaaaaggaaagtatgtcgtgtataggtggcaggtaccgcgtgataatgtagcttagtcctttgaagtgattagtgaaggtatcatgttttgatgctcaacaaagcagtcattatgggcattcattactcgcgctagctttgtattgcatgctattggctagcacataatgccattttttgcttgccttgcagtatttggtagccattgtgaatagatcgcctaggtaaaatgccgaggtctatatgttctgagacacttgatggatgtctcacagaaacttttttcgatgtccaaaagtgttgcgggattaaccacaaataatgctacacaagaaattgcccataagaaatgattgctggacgacctggatcagaatctaacaacgcaattataaaacaccacttctgtccgtgacccacgatgcgcctttagtggtattatgtgactcgaaggtgtagcaaacaacatctttattctatctccaatacatttatacgatagacatgtaaagagctcatcgcataccaagcagatcatagcaacctagtcaaagcctcccagatctgccatcacaatatccatgcctatgctctactcatccacctcttcggtgtcgggactctgagattctcttgacgcttccgcgctccgatcggccatcattctaccgagccgcctgaggtcgtcagttacatcattgggttggatgcagagttctaaaaacgcgagtttgtccggttcttcgtccactctatccagtgcttgcctcaaatctccgatagtcttgattttcaaggcgaacatggatggacttccttctcgctcctcatcttccttgctggcgtagggattgtgagacggagcgtgaggtttcgaggagaaagaactggctaatttgacatagtcccagttggcaatgtaattatacggcccctgatgcatagcggtctatttagttgtcagcgaggttcatgtagtattctcacttgacttgcctcaatctggtagccaagattgttgaaaacaaatataaccgggttagccttataacgaatcatactgctaactgcttgcgctgtcatctgaaaccctccatcaccaataaggatgattgatcgaccccgtgtccgagcaagttgggaaccaaatccagcaggtaatgcccatccgatagagcaatacggaaattgtagatggcagttggcttcagggggaagaagaatatgattagcgatgagccatgactctcctgcgtcgcagagcaacgtgtcatgccccttgataagtccctgaataccgctgatactgcttcttaaagtcaagggtgcctcgggtgtctccgtttcgtcgggaggcaaacaaccaagaagtggcttgggtcgcggaattgactcggtcttaggtttcattccagacatgatgagctgcgctaccaatgcaccaatattcacaggcttgatatgctttccatcgggtagctcgacccagtccttgtctacgttaatcatgcgatagttctcctgcttatggctactcatcacaacatgaagatcggaccaattcccaccaatgactagccaaaggtctgagctcatgacgatgtgctcaccttccgggtttgtcattccagcccagaactgaccgcaatactgcggatgagattcttcgatgcatcggccatcgggctgacaaagaaccgcacagccaagcttttctgctagaagttcaatatgaagacgagggagagatagacctgctaagcttccaagtaataatacaggtcttttcgatgagttccatatgcctgtaattgcttctgcggcctccttcaagacgtgtggttgggtcttccagttcaccttcctgctcagtggcgacggcggagtgcatgcagcgaaagcaagatcattggggatttcaatgtagactggcagactggagtctaggcatttacttatcgtgtcatccagtacgtcgggggcagtctcaactgattctagacggacagatgcagctgtgactcccatgaatgcctggagggcctgatctttattctttgcggtgggggcgtgatgcaggaatttgtcgctatcaacgacgccagtggcagggcaaccagaaagtacaatcaatctaacatattgcgaacaggcacctgatacagcgttgagagcggataggctgcctacaatgtaaggaacgacaacaaccgcaatgcgggctgatgaaacgcgagcataaccatcggcggcatagccagcgttcagctcgttgcagcatgtcaccatacgaagcttggggctcttcagcaaattgtcaaggaggaagaaattagtatcccctagtaggtgttagcaagcgatacgaacacatttgattgataaacaaacctggtacagcgaagtaatcgcggacacccagctcctccaaccggtaagccagaaatgtgccaatgttataatttgtttgatgaaaggtagacttaaaagtcggtggatatgctatcgtctggggcttgggagttgcttctctatgcggcatcttaatgactgcttcgccgagcaattgaccgccatgatgtaacgccggctctggggaggttccttcaggcatctcattctgcatagatttgagaacttgaggaagctggtcaagtgcaaaaacacgacatgattggtagaacctctccttggtaaaaacaagaatggcctcctctatctgttctcgagttccgccgtaaggcacaaccttgacctgtgccatccttgacaccaacttacatacgtcaattccaactggggaccctggaggcaagcccataacgacaactgttcctctgtgttgcacatactgggattggtgaggaggtagttatatcaggtaccatttagaaaatgactaacctgaagtgctcctttgagaagtgctcctgatccttctatcagtattgcagcgtcgggcccgttgccatttataccctggacttcagccacgatatcggctgagcaattgtagtctatatagtactccacaccaagcttcttcttatatagaagcccactatcatctcctgtcgatacaaccagaactcgacaaccgcgggccttagcgtattgacatgtcaatgttgttagtccgcctggcggtccggcaacagcttcatcgcgttaagtatgacccagttactgtagaattccatatatagacttacctacaaggctaccgggttgtgcgtcactctccagtaccgctctgaagcacgtagttccgacgcagataatctgattagaatattagcgaatcaagggtaactgacgacaaccttcagcttaccggggcaacaatatcaagagggaattgtttagggagtcgcacgacatggcatgcttggctgatacagtattcctcaaaggtgccatcaaccgaatatcctgtcattcgagcgatgtgggcacgagacgaaatctgatcgtttatctgcatcacagccaccacaggtcctattgatccactaattcaacattaggaggaaacttatgaagcagcagtgttagttattacctgtataccgacatgatcaccaatcttaatgtcctccacctcgttaccagcggctatcacaacacctgtcccctcgtgagcatcttatacccaaggtcagtataatgtgggaaagcttcaacagccgtgggcctgcacaccgacgcaatgccttttcctagtgacagaatttcctggactagtcagcacttgacatcaaatcctcgaccggataaggctaacctctccactgatgaagggtggagtgacagagtccggagaattttaggttgaccagcacctcgtccggacctggggacagacggagattgtttctgcgctctcgatctgctacatcagcaggcgcacgtaagcgacaagtagtctaagaaaaacgaagggccctcactagtagtaatgcgcggccgctcgaacagctgagggtgtggcattgatattgtgtgggctggggccattgttgtttcgacgttcacctaagctgtgaagtattaggaagagtagaagcagcaacaagcgctactgcgaagaaggatgacgacctgtggcaaagtataaaactgtaaactagccgattcgatccataaacctattctgctagcgatttcgccatccgccactctcgatcttgggcatgtatatatgaaatccatgagggacgtaaagcctgcacacagacatcggtatcatccagctgtaagacccaaaggccccttgatggcctgaatggattccaggaagtggaaacacctcagaaggacatactttctagaaacctggcacccgccaatgtggggagcgaagaggaaagagtccgccggtgggtcgaggagacctcaggtgattctgcttacatcacccagagctggacagggaactgggagttgaaagtcatgggacctcacactactttatgaacagtggccagaattgtatgtagactgcagcatctctcgttatacacgggagttgtgatcgcgatcaaggccattcagttgcgcagtgccttggctagtttgttaagccttgtccatgagagtattctctgggatagtcacgcttgatggccagctatcaagatagtctagacatccgctttgcttcacgggataatgacgtggcgcaaggaccgtgacatactcgacctctgtttgactgcacgctatagaaatgtctggtatgaacagcagtctgaaaagtgcgtaccgagattgccgggccaatgcgagtagaatagttgtctacgaaacctactacagggataaacaagattggcgctgctattctgaagattttgcatgtacttgtgcgctattcgtagatgatatcttggcttgatagcgagaagagggagattcaccgaaccttcggaggactgatcaaatacttccctgtaaggcctattttaggaagccgttgaccgcttgttcactgcgctggtacccgagaaagcgagtggggggatcggatcggaagacagagtcggggttttgtgggaactgtccgtcgctacatacatgcagctcgtgtccggaagctagggcccagtggctgtctgaaagatgagccatgccttttgtatggatcacccggggtggatatgggatatccagtgcaagccctgcagctaatgctaagtgctatttgagcagtcagtttgggggccagagccagctcagcatgcaacactgggatgttcctcttggcgaattcatatcatatgaacaatagcaaagtcgaaaggttttgcttttacgtgctgtggttaccatgactaattcttccacgaccattggcagcggttggaagtatgactggttcctagccaactttcgccgtctgcgagccaggaagttgaccgatcacaacgtgcagtccaagaattgatggcagattgtgtgtcatcaacaaagtatgtgctctagcggtcactgcagctcaagtatgcgatggcatacatcttggaagaatcgtctggtagaagagccggcaattacgtaattcgatgaaaggttgacctcgagccttatagggcggctccaaacgagccactccatagttcaaggcatccgatagacaagagccatgtagttgcaacaaggtagaattaagagcagccaggagccaccgcggagtcgcggggcccgatgtggtacgacagtaaattcctggggagttcgggagcgccctcccgcgatgactgccggctaccgaaaaaggggaagttcccgtaacgggccaaccagaaactagggattattatcagaatacccacttccggagataagggctgtctcaaattttttttttttctgcagcgtccaggcccgcaaaagcagatgcccaatatgcagggctcaataggctgagtggctgaagaccctttgtatagaccctttctggctatttaaaccggcttcctgtaacccgtactgtatccctgtcagttctcaatcgtcttaagagtgcattgggcgcttgtgcgaacatttccattctccgagggtaatccgaaagttaccaatctgggaatggctgatattgagacccatgcccgccatagcctggaccagggggcccacgcaactatagagaagtcggcctcacaggtaatagcaagggaggaacaagatgacactttcgacgagaaatatccagagggaggccttcaagcctggcttgtggtcctgggatcatggtgtgcaatggttccgtcaatgggattgctgaacaccatatcagtcctacatgcgtggacatctacccaccagctctcagaatattctgaatctagtgttggatggatttttggcgtcttcagcttcttcctatattttgcaggcgcccaggtcggtatgtttctcatcccattatgcacacatcaagcacagcggctgatttgacgacgccgacaggtccgatatttgacagccacggaccgctgccggttgtaattccggggtcaattggactggtggtcgcggtattctgcttcagtgcgagcacaggttagcattcattcttgattgttcgaggggactactaacgcaaaacagaatactaccaaattatgctctcttttagtgttctaggcggcctttcatcttgctgtctcttcactcctgctatctccgccatcgggcactggttcaatgttcgccgtggcattgccaccggaattgcctgtacagctggcggactcgggggcgtcttctttcccctcatcatattgtatgtcgccccgaagctagggttcgcgtgggccatgcgcatcattggaataatctgctttgtgctatgcggctttgcatgccttcttctgaagacacggctcaagcccgacgcaaagcgtggcgtggcgatcgaccttcgcgccctgcgagaacccaactatgccctcaccacgcttgcagtatggatggtcgaatttgctgtattcgtaccttatacctatctctgctcttacggtttatatgccaatattggagagtcactctcgtacaaactgtgcatcttcctcaatgtcggagccatccccggacgcgcattcccgggacttctcgccgatagactcggacggttcaacgtgatggccttcactgcattagtttgtgctattatgacacttgcattgtggtataatgctggcacgaacgatgctgccattatcgcgtactcggttatgttcggtttctggagtggcgcggctatcagcttgacacccgtttgtatcgcacaggtatgtcggactgaggacatcggcaagcgaaacggaacgacgttcactctggtgagctttgggaccctgactgcaattcctattgcgggagcgatacaagaaagggatgggggtgctttctggggactgatacttttcggtgggatcctgtatcttgcggcgtgtgctgcattcgtggttgcgcggggcgttgctggtggatggaggctgagaaccaaattttagacgtatataactgaggtcaaatctagaaaggcaacaatataatatatcaacatgctagcatgaagaattcaatgttgcagaatttgccgactgagtgtttgtaggtggagaacacaggaggctggcagagcttaggaaagcccccgcgccgcctcaatttcttggatagactgtcttgcggctgctgataagcgtcccaatattcccagtcgtagcatcatcattcatcaattatcactagaatctacagagtgccgtgaagcggaagccacagaagatcgaactcagaggacggtccagcagattattgggtggtaaaataaactgcctcaggcacataggattacgcgcctcctctccgtggcttccgggacaaatcacacgtttgtgctagtctataaacaggatttattccaaatcctccaaatttggagcacatcagaagtctctactttcttagtctatagcctggcaccaacaggaggcccgaatccgggaagtatactgtttgagcgactggaatcgataacataactggatgcttctgagccgtggtaggagccgggatgtcggtagagccagtgcagagggatatttttcagggaagcgccctagccggactcatagtcacttattgtgactttctgctcccaggaggactagtcagatctgacagacaaggatcatcagcgcacctgtcccgtgtctcgcagggaggcagcccccatttcctttggaaagtgctgtgaaagggatcaagagcttgcatcacgctgtttctctggacagaaacttccctcgagctgagtatgaatagttcacgcgttgcacaggatgcgagtccatacacgctaacctgagtggcgcggaatgcacgttccaaggactcgactaatgcgaaaaggatgcaacccatctgccttgttgatttcgaccactcaagcaggatgcaagacgaagccacagtgggtacattgcatccagacgagtcccttgccaataagtcctcaaagtaaggtatgggaaactggcctcatactggtctgaaagtagcgcatactcttttgattggcgtaacttgggctcagcatctgagacaggcatcaggtgcaaacgatgccgttggcaatattaatgacacaccgcggaaggtgtgtggagtgtcgcgaaccgtatgactcgatttctttactacagtgaacgtattgctccttatatccagggttttcggtgccaccgattggtggataggagaggaccggaagcattcgcaagtggacttctccttcgtgacttgagaagaaaaagaaacgagagcgcaccgtcctctccgtcctcgtaagctgcaatagacctcattatgtcagtgggggcaggtgcaccacggatgcctggcctctattctgatgactgcgaagttggcgtccagctgaattgtgatacgtgcgcaaggtgcctcatggtgggtaagcagtacgaatcgaaatctgtagcgtcaactgtgtgagtaccctgctatccggatttggagttcgacctcgccaatctcgaggccgaaaactcttacctgcactagtcaaaagcggcgaggaattgttggtcactaagagaccagacacaccggggcacttcggagcgtttcaggccgccagagagagtaggaaaaggagacagagcagaatgaggaccttgagtgaccgggaagacacgtgagtgccaccaaggtgctcatgctctcaaggtgctcattctctctccattttataagtattctgactctcaactcccgcacaatgtttcctctcgatctttcccttcctttcggtcatgaatgttggtcttctctcacctggcagggtgtccaagatgacagggatgaaggaggttgatcatcattcaccaacccgtgattagaatccactccaggcgacggctgctgacatttagcgtcttttctggtcaggcctatggtggggaaacaaggtcaggcaacgctatctcactaaccaaggtttaaccgtgctacgagagttgttgcagctgttatgtaactcgccattcagctgcctcaccccacagccgactcgagccagatgaggggctgcaccgtcatgcttggtgcagcgtgggatggtcataacgcgcggatagcgcagagaaatggcacgatggatgaaactggttgctctggaaggacataaataggccgtcgtgcctctgttgctcgatcttttctcatcaacacaactcaagttctcaagttctcaagcgaaagcaaaaccaatctcaaactacattagtacatctttcaccggttccataccaacttttgccaaaatgtctccctgctcctgcaactgctgctctggcaactgctccagctgctcctgctcctcttgcagcgtgagtaacccgtaatttggagccacccggttctgtaaaccagaggaaactgactcaatcgtgattagcattaaatgctgtcgatgctcacttcccggccatgaccttacaaccgcccctcagccatctctgccgataccaccaatttcaggctgcgtctctggcttgaaggcaacattctaaggatattgggatggtgaatttggaaatttgggtgcgcaagtgggagtgatttggatgccttgatgatatggattcatgattttagttgtcttttctatcatgtcacctacacttaagcctcaggtgtaccaaatctaatggaaaagacttaattggaggatacaattgatccgcagtaaataggttaaacatatatagagttattataaccgcaacggcatcaagcacctgcagacccgatgcagatgcacgtgtcgaatgcatgtagtgaaacgttagacagaactccacagggttgataccagtcgcgttcactaactcgacctccactagagaagggttcgagataatcgcgggaagagccgtaagagacactgagctcgtttgctgtgtgcagcatgagatgcatcatccacatgctggcggcggattccgcatcggagctttccccgataggaagcatccaacgtgactcaattggcaggacccacaaatagccaaagagatttcaagtattatagactttggaggactgaaacaggggtctcaactgtgtggacctttacagcatgcatctgccgacggagagctcggttaagctagattatgactgcatcatcgcagtgcgatatggggccaagacgcaagggggttttgacagcgtcacgtactgcacactgcaaaagactctttttataatcgcgtgttatgtatctcgtattgttcctgtccctgtccatgtatgtggtcttgatccccttgagtgatggcggcaatgctgaaggtaggaggtactactatcagtcactcacaagttaccagcctggtgtaccgacaaggatcgggttaagcaagaaggcaaacttcaggattagtgtaagagatggggctagagacttagcgaggtctagttcacgagggcgaatagagctaagaggaaagtgtgtaggagactgacagccatcggccactgtttcgcttgggtttaacagcgccaacttcggatttgtttcctgatcagttcgatcaactgtggcgttttctaggtttgtattagccgctgccgagtggtcccctatgaagtagggaatgatcaaatcttcctgaaggcgttccttatccatctaagacaaccgtgaatagaaggcttgcgattgggttaagaagatggtggactggtgtgagtacctgcttggtcgccgagaagtaagcaaatacctcacagcatccgtcggggaacatccgatatcacggctgaatctgggtttgggcagcaggggcacaccaaccaggctatgcacgcagcagagagggggcggacaatggatcgggccaaccggtggtatgcgcgacgagggatccggtgccttagtggaggccaaaaccatgctaaatccaggccaggcccggttgaggtgggctgggcttaatctctccgccgaccatcttcctcgcttcctccccacccgtatccacggcacctgtctgacagcccatcaccatcaccctcatcatcattaccaacgttctttatccgctgactttccaccaaggtcctacctgctccaattccctctcctgatcattgttcacagcgtggaatcaaatggtggtgtgatgggggtaagctggtgatggtccatactcgatttcctcccgaagaagatacctgctctaggagcgactttcttgcatgaggatgctgcagaaggtgggattttacaaatgaaattgactcagtcattggctgacacttgcaaaagcaatgaccagataagttaaatgaggaaacgagtcagaggcaggctaccttgttagtgtcggagaccgggcctgtccacgctctcaaggtcctcacaaggtcctcacctggaaaatctctgccacgcactcccgtcatataagaccgtgacgcaaggatgtgccaaacagaggaaatgatcagagccatccaattctgcttttccttatcctctttgatctgagtgacattcatcctcaatctttccaacatgtcgttcaatcctaatgatgtcgacctcgacacggccgacccaaccgagattatttgctatctcaacaagtcagaaaatgactacaacggccagttgggtgcccgcatctcggctattttcgtgatctttgccgtttcaactgcagtgacctttttccccgtcgtcgccaagcgcgtccccaggctgcatattccactctacgtctacctcttcgctcgttacttcggtgcaggtgtcatcattgcaacggctttcatccatcttctggaccccgcatactccgaaatcggcccgcagtcatgcgtcggaatgactggtaactgggccgattactcctggtgccctgcgatcgtcctgacctcgctcatgtgcatcttcctccttgacttcggtgccgagcgttatgtcgaagtcaagtatggcgtctgcagagaggaccccgagcccatcatgactagcgcagtggataactcgactgtagacaaggagtcgcctggaaacactagaaagggcgaggctgatgtggaggagttgtccaccagtgacacattgatcgagaagtccttcaagcaacagattgccgcgttcctcattctcgagttcggtgtcatcttccactccgtcattattggtctgaacctgggagtcactggcgacgaattcgcgacgctctacccggtccttgtcttccaccagtccttcgaaggtctgggtattggagctcgtatgtccgccatccccttccgtaagggcagctggctgccgtggatcctttgcagcttgtacggattgactacacccatctcgatcgctattggtctcggtgtcagaactacatacaactctggctcgtacaccgccaacgtggtctccggtgttctggatgccatttctgcgggtatcctgatttacactggtctggttgagcttttggctagagacttcctcttcgatcctcaccgctctcaagacaacaagcggttggcattcatggttatcaccatgctctggggtgctggtattatggctcttctcggaaaatgggcttaagttccattggagatgttgttgtgaatacgtgctgtgtcgcttctgttaagattatcccgctggctctgatatccgttgctcatgcaacctctcttcttgctcatattcactcccattgctgttcgaaataccctttgccattccattctcaagatttatttgtcatgtgcacatatgtatggacgataataattagctaggacaaaattcttcacattgatatatgatttatcttctcctcactgtcatccatggtgtcctattctgcagaaactgaactgagattttttcttccagccagttgctcgttatattcatctgaacggtactcgctttcagttctctcacagaatctccaagcaaagcgactaccaaactacccttttcttttcttttctttttttttctcgactcatattattggatccaacgtatgtggtaagacgtagcgctaaaacgcgaggtctttgttcagaagcacgtgtcgtcttagctgtccgctgaactagcctagtcattgcctatcaactaacccagagtaccgagaccgtttgtcgcaacgcgtcgtatcctcaaaccaacatattgaattgcaatacccgagtcataatctaaacagctcaactgtgtcaggtcttcctgcaggtgagtcaactgatctagcaatctccgctctcttcacattgactaactactattaccctgctagttagaacccctaatcgcacagcacccttcgagccacaccccccatcctcaccgataacggtcctccaatctaactagaaggcgccgtatccttaacagtcggataataatacccactctcatccaagctcgacgtgtcccagtacacctgataaacatcggagacattggtctccttgagacggaaaacatcgctcaactcgcccgatgactcctcccacatgagataagagccatagaagatgaagtcatcagtgacggcatctgaaggcgtatcgattccgttgccggtgaagccaacaggcaggatctcgtcagctgtgggacggatatagaacagggtgtcagagtcgagggtgacgccgtcggtggtggcggtggtgatgagttcggtgtcggtgatgacgactgcagacatggttagtaagatcgttctttgtatgtgattgaagggaatgctgacaggtgacgtcggtggtgacggatccatagggccagagagatgagtcgccggcgtaggcgagacctgatgcgaatgtcagcggttagtttacgaaatgactcgagaaggagatgtaccgtcagaatagaagaacttgagtcctgaagcggcgacaccccaggcatacagactgaaagatccgctggggttgcgcttctcaagattagattcgatctctgcagacggagcggcaagagcaccagcggccagagccaaggcggagataacagacgacttcatggtgagtaagaatgatcgcttgagtactgagaagctaatgaggaaactagatactttcttgactagagaacagtcctgcttttatatcttcagtcctcgatggagctttcttcacccaactgcataagccccactacgcaacatgattgcctaagcttaagttccttagggatttggggtccaaaaacaaaccaatgaccgacttaagatcaatatcctgctgtcttcagcctcgtatagactacaggcgtacgtatgcagaccaactgtatacgggatagtggcgactagcgctgggactcccggcttggcctcaagagtcctcggagggatatggactcagctacatacgcttaggtgacattccatgccttgaagatatgtcatgcagctgatcatacgacataattttactccccggatgttcatgtcggttagtatttgagccagcaccgactggcctgggtgaaatcatcgattgtggatgaagcgttacgaaacaagaacgaatagcttcaccccactacggttctcttcaatccttcgatgaggcgaaaagtggagaatctaacaaatatgctcacttataaatccttatctaatcgtgcgaaccaagattagcattgaaaccgaaacagaagcctaggtcgcggctcaagctcggaaatcccgagattctacaaacaaatcaatattgctattcctcaataacaagcaaatcgagccttctctatcccatacaacaaacacacagcactcagatcccaaatgatatcattaagctctattcatcaattgtcgtagacaccatctctatcatccaatacacacaatcaaatttactccggaacccccctcaaactaagcaccgtatccctcacactctccctcaactcgcgataaaccaaccccaaatccctaaccgacgccccattatcaaacccatacttcggtcctccctcaggatactccccatccctcaacgcctcacccaccggcaacccccccttaacctccggaaactcctccccaatgacctccacaatctccctattacaaaaccctccagaagtcaaaaaatacctcttcccatccgtctccccccccttctccaacgccaccgcatgcgccatcgccgcatccctaacatccacccaaaacgcactcccagtaggaggacacttctccctaaacctacccgccacgaaatccctaatcctcgtattcgacgtattcacctcccccagattcctcaacgaccctggcaccacaggcccaaatatcaacgaaggattcataacagtcaacccgaacgacggcttctccctctccataaacccccacgcttcccgctccgcaagcgccttactcgtccgataccctgcctgcccctgcgcattcgcaggactaaccgcctcttcccacgtaacattattccagtcactctcggagtacttgcttccagcaggtttactgggattccacatcgccgcgaacgacgaggtaatcacgactttcttgacagtgggcgcatatttatgcactgagcggagaatcccaatcgtgccgttgacagccgggtcgagcatgtcctttttgatgttgtcgatgctgtagtggaaggggctcgcggtgtggattacccctgttagagggggattattgaccacggcggagtcgaaagcagagaggagggagatgtcgggtacgattttgatggtgagccggtgtgaaggaatatctggacggagggatcggagctgggaggccttttctgcgctgcggactgttgtgattacgttgtggccgcgcgagagaagcacgtcgattagagtattggcgaggaagccggtgccgccagtgatgaggatttgggacattttgttgactttattagtagactggatggttgagatggttagtgtttggtatgatgaggaggagttggatgggctaagaggatatatttatactgctataaggttctctgattttgaaagcagggtttaattatcagtaagcacatactaagtagtagtaatcccctgataacaccgatattatcaccgcatagctccgatcggggagtttagcgggtggggattatgctaagctccgtgtccgggtatattattactaagactgccgcaaggatggggtctagatgcgtatgtatgttaatcagctgtgcggaattggaatccttcgcgcttgatggattggtgtaacggacttaggagtttatcgagggatttatggggcggggttgatcgtgctgtttgagggaatttctggtttcggatggtgtaccatggaggggttagggaatgacatcatggatcgggtctagattacttagatcgggggtttatgcttattagttggagtttagtcgaggtacttgctttggaagattgttgcttgtttgatgaggtgtcgtcggggtttggtctctatttgggattataggcatttatgtgatgagattagttttacgttgtcccgggtttagatgtcagctgttcgtggatgatcagttttacgagtggttgttactagtttgtctttgatgatgaatgcagatcgtagatactctaccctgtactacttgaggtacgaaatgattcatcgaatcgcatccctggctcggaagacggcccgacccgagtcatggagcacagtatacagtgggttctatagactcagggttctcaggtacgaaatgtgagatgaatgtagttatggatatcatagtcatacgcaataacaaacaaacgcatcatctcctaacagccctcacaatcctcatctcaaacctcgtcctattattcttctgcaacaccttccccatccgctcacaccaatacaccatcctctcatgcacctcatcgctctcaaccctcgctccccccgtttccacaaacttactctccatccactgccaaacaaacgccctcttggacacccactccaaatcccaccacttctgcactccaccctccatccacttcggctgctcccccacaacaagatgaatcagtcccaagatcgaaaataagtccatgatttcctccagaagcgtctcatccttcaaccagataacctcctcactcaccaccgccaacggcaacgaaaataccactctcgccgccttgccattcatatcgggctgctcgagacggtcccctgccccgaggatcaaatccacgatgttgttcgggacgaggtagagaaggtcgcagtctatgtcgaattggcgggagaaggggggtatatcttcgctactatcatcatcattgtacatctgatcttggatctgcttttcactgaggcagtttcttcgtggagcagtcacatttgacgcccatttctgcgcaatggctcgggattcgctgttcacgtgtagtaggggagtatggatctgtacacggtccagtagacccatgtcgaatattatttcgtagttgccattggggtcgttgacttgtcccaattccccggtgtaggggatgggtttggcgacccagcagccttttctatgggggagtaaggcggagggagggtgggagggttctggaagggcgaattgccagatctggtgtcggagttcggcggggaggaaggagaagagagggaatgtttttgctgcgttggctgttgtttgttttcttttgggagagctgtatggggtcgggtcgggtgaattaatggaaatgttcgacatttttgtagactgggttgtgtagaagcagtgtcgatccattctaggatggaattccacactgtggagaggcgatctgaggataataaacaagggaaagctgtcaaggctgactgatgggctacctttgtcactgggggtgaaactgcgccacggcccctcgcatgtgactagccggtcgcaaggttgcccgctgataagctttgagatggaaattgacagcgatggaaatgtgagcttgttgtcgctgtgataactttgttagacgtttttgatgattgaagtcagattggcgaggtaattggcatgcctaatggcttctttgagtaaggaggaacatacgcgaccgttgtaagcgtgcaccagtgaatccgaccgaccggagctttaactgaggcgctctctacttatcaggagatttctttcggaaataggagagagccatgaaaagtttatcacacgaatgtttggttttactaagcaccgagctcagtgagcgacgtgatcagaagggtatgaagatttgatgaaatgacctaggtcagggacaacaagcgctaaaaaattcaagagccagctcggagcaatgcagatcatgacagcgtgattgaatggaaacaaatagcacaaacgtgacttgcacgtttcacatctcagatgtgtatgagggaatctatgatgtgaacaaaggaaacaacagccagctaaagaaaatatcaaagtcatgaaaaagagacgtaaaagagaggaaaagagaggaagcaatagaagcattgggcaccagccctggctatactgtgggatcaacatgcacgcccaagcataggtcaatgaatgatgctgaatagtgtggatatagatcaggttggcataggacaggcggtagagggaacttgtagtcggtctttgctactatacaatcaggccagttagccatgcaatgtctccaaaactcaagggcagggagtattgtaccttgaaaattcgttcttgcttcgcgcagtgcactcatggcactgaacagatgcctttctgcctcttctatgtgagagtggataactgttacgtcgtaggcgtttcgatagtttgcgaggacgtggattctcgccttggctgagctgcatgaaccagatacgttagcatgattgcaagtaagactgtcttgatcgcgactggtgtcaccagagccagaggagatgggttaggaattacctaagagcagcctccccccactcaatggccaactgtatagacctcacatgctgatcaggggtggcctcaattgtcaacagcggttcgttcatgtagattgcctttctctggataaagatcttgtcaaggtatttataatgctcataagcatcggtgagctcccccgaccaaggacattgtttgcggtaggttataggatctatagtgtcgaaccattgacggagtaatgcaattgtcttatgattatcgcgaatttatatttcatatgtcgaagagtccacggacaggaccaaggaacgtatgaatagctcctggtgtggcgaccgaaagctgaccccgcacacaattttgacctcaatgtaggccgtttggctatgtaattcatgtgttctggcggtgaggggagattcgctgatagaggggtagttaactcttgaataaatacggactatgaagggctgtggatgcgtagagggtgttatgggagttggttgcgttcctgcgcagctagcattaagaatttgaatgaggagaagaatgtggacagagcaggtacctctcagtctgttttaaagggagctccagcttgtgctcctggcgtctacaggggtgttaccccgcatcttcggtgttgcttatgtcaccccatgatgcgccggggaacgtcatgcgaccagtaaatgatccattccactgttctgcacggccaagatagtcaattactagcagtccttcaggacactttagtaaagatttctcgtgaacatgccgatggttgaagaatcaaggatttgtcatttcacattagaagcgaaagagtatttgacgtagtcccatgaatgatggatcttgtgctcccgttgggtgctacttccgcccgatgatcgacaatcaggcacaacaaagcggcagttgcaccgatgcaagtagcacagccaggctgtccaatctagtgagaatttgagtatacattcgtggttttccagtgcttttattgtcgctacgtccacctgttgtgtcaccccaatcaaagatcagcttgcctgatgatcgctaattacccgcatactaccgtcggtcggcatccagatcctgcatttctctattcgtcttatccaagcagcacacagtgacattaggctgaatagtggtattacaatgaaccaagtagtcagactgttggttgacccagaagtatagaaagagttgttgctcggcctcctcatcacacatggatcgaaaccatcgccgtgcgcttactagtatactctagtgtctactttctgcttagaggatccgcatcggaggttcggcttcattgctaattctcaggtctaatttgaatacttcagtgattaatgatataaaagcagaaaagcgcctcgcataaacttataaaaattctctttggtctcttggatcctgatcttcatcccagaacgaactaacaaactgccttagcaatacttcctttgcaccagtgcgctctaaccgggccgcatcccacataacgtacccccacttgggaatctcatcgggtatatagtttccaaacatattgctgtacgttcctttccataatagcgtccatgccaatggcgggtacgctccgtccgactcgtctaccttgtcccccctgaatggcaatggctctctccgctcctccctctcatctcgctcagaaggtgccacaatacggcgatcgtcctgtgttaagtaatcgagcgcgccaaggccggatgcacatataaacgttgatgtgcgaagaatcaagctctcctccattatagcaactagacgtgagtggtcctgaatctcgaagaagatcttttggagatgatcgagaccttgtgttataagcccaataagataagagtcttcgtagtctatcatgggttgcccgcggttagctaacatctagtatcaggtcacaaaattacgtagccgcaaagttgcacatccaggggcttactcttaatatcaaatgctccccgcggagtgggcggtcgattctggtcagcaaacttcgggttagtttcatggaaatcccaggtgacagactttaggacttccaggcccttgatttgtgcaaagacattgacgcagtttatctcctccaattcccaaggctcatacaaactctctagcatcatcagcacttcgtgagactcgaacttgatccatggttcgaaaatatcaattttatccgtgtgcttatgtggacctgtacccaataggttgcagaataactggaagcggtacagagcgcggattattctgtgttcttcagtgatactcggaggctcattgatcttagcatgtgatgtttcaggctcttttgccagattgctcaatgcccactctgaatagtgccgcgcaaagggctttaagacaaagcggtaaaaggtcaccatgtctatggtgtcattcaatgtgaaagcttttatttgagtggcgtcagggggcggggcgcgcttctttcggagagactgaacgaaactcgaaatagtgtccatgctgcgcgcccgtctgaagctcagcgagctggtctcctgaacagcgcaggcatcaataaacatgtttcctagagtgatcttcaggcatgcgaagaggagacgcttgcgatcgagaagatactggtcatgatagacgggagatgctcgaaccagcgcttcgagcccttccaagtccagtaaatcaagaatttgtactctcagctctgctgggagggtttcaaggtgtatatgtgagtccgaatggcaggtgtcttttgtgaattggctttcgcgtaagtccgagaagtttgagctattcgtcgttgggctctcgggcaagtccgaaaggtttgagtcatccgtcagtatgctttcagaaaagtccgagagttttgtatcatctgtcagtatgcttccagacaagcctgagtgttctgagctatctgccagtaggattccccacaggttcgcggggttcgagtgatctgccgataagctttgagattcagctgaaaggttcgagccatccgtcgttgagacttcggggatgacttcgtcgatagcagctaattccgtaacagaagtcatggtgaaagaagccagcaaaggctaaggaaaagtaaaagagttttttggtgtctcaggtgattgcaaggtaggagtccgagagtaaagaggtaatagagtcattgacagacagcctgctcttaaggcgcttagttcgatgacataagcgccaccattaactgactagttaactattaggagcagctacaatagttcctcggccgttcaccatgacgggctagaactgtaaaaattgaataaaccctctgaagggcctatggatctatggtgaaggagggaaggaactaaccataacacttgctgtaccttgactactcactaggttagtagatactaagtgctctatcgttctacgaattcacctccccaacgaattcaaactggtattaacatgacactcacagaatgaaagagtggaaagcatcggaaggtatgaagatatatttggatcgcccgttaaatctccatcaatgaatcttcctggactaatatacaatttgctctgctctatgaactaaaccaacataacatccacattgtgaggaagaattattacgctcgagatgccgtatattaagcattagtggcgcgagaacaatgggtaggagtccactcctcgatgcccatatgcctggaataacagccatgtgccttaacaacataacgcagatatttccaggttgctttacataccctgtctcactaatagtcgacacttatccagtatatctgagaatacgccatttaatgatagtatatttcaatttcaaattcagatgttcccaccaggggcgtccagtatggtttgggtaccacttttagatttaaggagcagctttcgctaatccaaaatgattcggcatcactggaatcttggtgtttgttcattcttcttatttatagggaaagctattgaaactgaaaataggaattatatgtccaattcacttgtattcggagccctcctccacttgcttgtgtattcacataccatgtcacatataccgcctttgaagactgattcaatgtcactataacacattcgctctgatactacttgccttactcattgagcatcttcctcattcgctcgtatccaagccgtaccatatttggctgccacgtttacaaagacaatacaggttgcaaaagcatatcatttttatcctacctttcttgtcaaacaagtttccatttatcgtgaacagtcagccgtctagataatgaggttgcactcaaatccctccatcactgccagagcagagtcggacgaagaggcagaaattctccggcctttaaacaatctacacaagatcatccgagagatgtttcacgagatagaatcccaccacacaaccattcaatccctaagagaatgggcccaaatgattgatccgctggcgtttgcgaagatggacccatggccacagtcccttatttcagcctgggaagagtataagttttttgtccaactcataaacgccaagaagttggctttcgtcaattatcggagtgccggtgatgaagatcttgcagacaccagcgattggcggttcaaacgtgtacatttggcaatagagtggggaaaagtggccctcaggtatgattaagcgtctggcatctccttccctttctcccatcttctttttcaccctatatatgatatgagggttggttatggctaactaaccaatttttcgatatcaaccagtgcgactgaggcacggcttcatgttctttgtacataccaaaacgcctttgagaataccaaggctatcgatggccatatagaacaggcaaatgcgaacttgaatagcgccagggacgccgtgcgcgaggcagggattaattaccgtagtaagtatgaggatgaatttacattggaagaattctggaaggcgtttcggaggctaattcaatggtgcgactagggtactgggccaatatggcccgagagccaccttgtaagaagggtattccttatgaggattacgatgaagagtctaatcctcattagaggttgagcccgttgctcgtgtgaaattcccagcctactgacattgtgcgttgaaatccaagggtgggaaccgtcctaagtcagtgggacgtcagtctgcgtgaatcattggggtttacgaaagtatctacgaaggccgtcctaaaaaatggcatgaatacaggcagggtctttatttgaagttgcattacctcgcttattttcagttcaatgagcctaacaaaccacccaaatttcatgctaactagaccaattggtgcgcctggtatggtaggcctgcaagctatctagaatgggaaagcatcgagttatctcgcgtcttcttgaaagtctgagattctttcaaggcaaaggctaactcagtttgtaaaggcgaatactcacactatatccttcgtctaatattgcgacaagactgtcgtggcctgacaagtccgtagatcacaatccgttacctgttttcaagttctactaatcatagtcgtagtcatgtctctggaagaatcctcggaaatatctattgacccatcttacactcccgtgctcacttatctcgggcatagcagcaacacctgcgagctcattgatctataaatttcaagagtatttctatgatctcttcttttcaatattgtgtttatgtttctgttcggtatctctcacattcctcgccccctcactcgcttaattcgttccactcatgtgctatatccccatgcaccataagctgcggatttccagctacacgaagggccacacattttagtataccacatcaactcacggagcatatgtgagacgtacaaggcagcccggatattcctgcattctcctgtcgaacctagcaaatataaaggctcacatggactcttttaggagcatggttaattgtatgggatttagcaatttttgtccatgcgaaagccgtaggtaggggctaagcgtgctggtgctgaattgtgtgtttgcaaggcagtgcggaaaaacccttatgtattcgcggagtgatatataagaaatgaatcatatccgatgaaagcgagatacaagcaggatgtcaaacttcatttaaggcacataccagtgccttaagtctctctttacacttcaatcccggcaccggaggtgaccaaacgacagagtcgacgtttggatgggctatcgaccttgaaaatgtcttctgagggtcgctgtatacacacagtcgcccagtatcctgatcaacccttggataagccgttgaaggcgtctcatacgagtttcggtagtgccaccgagcatttctctgtcgatctggcgctcatactcaaagtaggcttcatgagtcgggtttattatatcaagatatgttttatatctcccacatgcgttgatgagatcctggtgccaaggtatcatcttccgatatgttctcggatcaatgccctcggcccattcatttaaggaggcaacggttcctccatgcctttgtacttcgtgatacatggtttgtattatggcatgaagctcgttcaatggccatgcctttaggaaggtggcactcccaagtgtcgcttaaatgcaacttttcgggttgtgtcatcgccgcctgttgacttgagtaatttgtctgaagcggagctgcaacagattacttcacgcctggattttctttcacagcgatgcagccacattgttcacaatgcttctgagcggcaacatgcgccgaatctaaggacagcagtgcgcagaccttggcattgagggggattggttgtacgggagacaatgtcccagacccttctcatgtaacctgaaaggcacgatggacggatagtgtattgcgtagaagccgttgtatgagattcgagagatgtaatgagaacgaagggtcagatgcaattcgttaccacttcaacatcttgagttgactgactgcatctcaatcggcacacccaaaggataagtagtcagagtatctcatttctttctcgcctttcgatactgcttctccctgtgatcgaggacaagaacaagacgagggatgtgtggtgatctcgacgctgccgcaccccaggatgagattgaggttgcctctgtgcgtctaatacttgaagccaacgcccgtatgtggtagcagacaacataacagaagtctcttgtgagttcttaaaatcaagctgaccatgagagggatggtccattgcatccaaagcttgtatgagctgcacgggttgtcatgacagaatctatcgtggtgcttgtggtgcttgtggtgctcgttttggaggcgcccgggagcacgataagcccccaaatcggcgacatatcttctctgatctgtacgtaatccatgttgtagagaacgtggttcttgcttcccttcgcagatgtgcttgatctgtcaacatctccaccagcttgtcttggtccgtggttcgcctgccggggtggagtgggggctgcacgctatttcccacatacgcggcggatgggttctccccgctgctggccctccgaggacgtcggcaccaccagtccgtgcgggtcgagcttggccccggtctcgggcagctcgcctgccgacagcgcggtagatgggtctgagcgatactttggtgccctcgcgaagtacgaggcttggatcagaatatctcaattccgaccattgggacaattcggatacccaattagtttggtaattaaacatgctagggagatgtttgctctggagatggctccagcatattggtaaaccgggcacagagtctgagtcgtaggtcgcataccccggaccacccagacatccctttgcaccagacattgatctcaaggaggacagatggcgacaaaatagctttgtgaatggtaccacacaacggtcggaagagaattggcgtggtaagtctgaaggcgagcttcatgcggaggcttgctgtggaatagatggtagtcttcatatactagatatggagagttccaatgcccatctgttgcaagaaatgcggccataagccggctggcagcatcgacagcaaggaactttgcaaattatatttgtttcgaagatcacccacggattcgtcgtgaaagggagcgcggtctttgtaaccaacatcgaaagtgtttcacatgtcgacaagctcttagaactcgtagagcgacaagtcggtgtcctgaattgcagattagcatcggatgtcatattgaagtgggcgtatgactgagctaaatgaatttcataaagtcaattgtaaaagctaatttaggtttcagaactggtatgtatagtgggacgagcatgtctctcccttcaatacagcacagactgcgcaaacgtcgggaatgctttccttcacattaggagaataggtggcgcaggagatgtggtattgagctgattgacccaatgttaggtgatacaaggtgcatcttttcttcactccatagaaggtcgcacgcggaaggtactctaacagaagaaagtccggcttgggatatatgacctagccaatcatgggatcttacacttaggatggcaagtggaatcccagcgaatgctttatagcgatttcgaaactgtgtggaaaagaagataggcgtgaagtagtatgaagttacagaactcatgatccggagcttcaaggccctgatgcagtctttctgcatctgtttatcgaaggtgtcgggcgtattcacagatgtggttgagggcgaaaccatctattaatgaacgcctcatgtattatatctggtagctcttcggtcccgctgttgggagccaatgtagtgcttgttgagaaggcggaatagcccaaatcgtcttgtaaagggaacagttgtgaattcgccctgttggaagtcatgtccatgacacatgattttaatggcttagaaaaacttgatttgatagatgatgaagccattatacaggctataaggcatgagataccaaggtaaaggacgcatcacggagtacatatattgtgactgcaacgcagcaatgggtttgaatgcagtgtcaaaagcatttctgattctgatggtgtactgggagacgagcgaagattttatattcgagcggtaagagttaggtgaagcagtcggcattagtgaaatggggacagtgactgagagaggtgatggcgaatgtcgattgaatatgatttgtgttcatggattcccaggaccatagggaatgggaagctatggagtctctgttgcaggggcttgatatccttcacacccgcaatccagcgactacgtacattgatcatagattaatgatcacgaacgtggtcacaccaccactcaggcggtcctagcaaccgtccctggttgtgcgttggtttctccaggtgaagacacagattgcgcttccctagagctccaggaacaactcactcgagggatgagagaccccatcaattgattctatcattggagtcttcggttttgtttttttcttggccgcgcccttgcgagtagacggccaccgagtgttcgaacaccgtatcctgtctgcctgtcgtgatggaaattcaattctgtacatttaattcctcgcaacaattcggtccacactgtaaagaaatccagcgcttgatccggttatctgcagccatataccgatgggttcccatacatctgccacgatcggacagtgccagaagaaatactagtgtctcgcaaagcatgacgccttgagtcctcaccgggtttcattcatatctctcctgtttggatttcgctcagcagcagttctcagtagcggtcgttgagtttgagatagtcaagtttcctgtggtatggaccttgacacaggccaatatgcccgtgcgattcttccagtctcattgatatcggagtcatcatcggactggggatcaaaagcgtaaacagactggtatacagtcaattcatgccccagaaatcgtctgaagtactcttagcgtcggagatattgcacgcgtcttattgatctatatatatgaaggttttctcgcgattgctgaaccaatgctggatgacttgtcgcgagaaagtctcgagtgaagtggctttttggtgagataaccttcccagggcattgcaatatcccaaagacgtcctctttcagaataaaacctcggatttggcctgagcaataatatggttgtattttgagatacccgcacatcagtaagattcaacatgtgggttggccgttgtgaaaaggtctcgcagacgaatttttaaatttcgattcgacaagcatctgctctaactaagagagcatgttgagtctgaaaatgtaggttcaaaagattcgttgtagacatgaatgtgagagacggttggaaaatctgatagtcgaagtcatccacactttgtataacggatgacatcaggcgttgccgtttagcttttgtagaactggaagatcgcggtgcccagatagatttttccttggctgttttcccgacacccagagccattcggaattggtgatatactaaggccctgggtgtcggcaatatctccttaataccagatttggcaggaggaagataagagaatatgtttgtactggctgtcacgccagcacccggtaccaattctgcttggtgataggaaagtgtctcattgttgatgaacgatccatcatagacacttgggaccgaagcaggggagattttcatagatatgagatgaatggacatgatagctgtccaccatttcttggtaaaccatacatcaagccacagtttcgtcttgcgttttgttcctttattgcgtggagttacgagacaacccactggtaaagccacaatgaccacagtgcttcgccgaacagtagtcaccaccgttcctgatccgcctcccgtgaaaagaacggagaacatgttcattcaagccccctcagcagcaggtcagtccacgttgtgggaagattgagcagcagacccgtgatctgccgccaaatgctgtggataaatcccaaaccgcttttgttatggggtagtgctaaaacagatgttctgcgactcacattgtgtgacaccttggaaagtcgtgatgttccatccatggctcccctgtccgcatcttgttcagcatcagcttccagtagagacccatgactttggggtacttgatcttccggtggtaaagacctttccacagacgctccggagatacgtctgttatgtctgtgccctctgccacagactagtctttaggctcgaaggttaacccgaataagggtatattccgcacgaataaagaagcagaaggaaacgaagttcttcagggttggattcggtatcctgaagcaccactgacgaaaagctttcatacggaacccgggagacttagatgtctcgtccgactcacttcaagaacattcatatgccttgatctttgcggtccatttctagccagatatctcagtgtctggatgagcaagatagctgcctaaggccgccaaggtgtatcctagcttgatgaataggatggttgagtagacgaccatcaaactcaaaagccatgttactagtatatcgacaacaccgattgacggcggtcggcagttcccttgtcgccattctgcttcttgttgctctgtggatctgcaggtgcaaccttcacattgtccttctgattatccaaggagcagttatgcattctccaagaatgttttggttgagcttgtggtgaaatggttgattgggcactagtaggttcattccccgctgtgtatcatgaatgatgagcagccctgtacaatcagagggcataaaccggcagacacagcaatgagggtactgaatggtattacttttattggagttagttgacgatgtccggcgatgggacgtggtgttgatgttctgacttacgggtaaccgcctgataagcggtttctccgaagcccataaattttgggagcgcgtccacttttcatcggctattcataaagagtgttgaaagcgcaggaggatctatagcatgtctgcttgattggtccagtttccatggactgaggagctggtgaaatgaacccctgttggaactcgcagcctgaggaagaacctaacaaggcttgcttattggatcgtgaagaagagaatggagtccaaagcgaaagacataggtattttgagccacaccctggtattccaccttgtccttgactgccaacaagaagcaatatccgtcattgtcaaggggcaagcaatgattcattgttgggaaggaacaacatccaaagagagtcagtgtgcaaccgccaacgtcacccagctcatcagtatccatgttatagggataggcatgggtatttgtcgaccgatcatgcacgaaagcccaagagcaagaatgaatctggttgtggatcttatatacggccaaagaaagcggcatcatcaggactattttgaatttgttcacccagagtaaccgttcgggctgcaacgctattgagacatctatatgtcgggaactggctcaaatgaatccacaagacagacagcgtcataggggtgactcaattgaagtaatgttaagaaacccccaatgatcttgtcttcgtatcaaaccagtattcgtggctacgccacaatcctgactgcatgaaatcgactattcatggccatgcgtagctgattgaacaaagcttagaagtcgcatagattgaataatgccacagattaggaggtaactgcatagttcgcaacatgagtcaggaagccgggtcatacgcgtgtagtgccagggacacactaccataagcattgatgaatgcaatcatggtatgctgtgttgaaccaagtacctgcaaggcgtttttcgtagcgttgccctatgtaaaaggcttcagtaattgcagttgtggctatatgctgtcgagtgttgtttgcatagaggtaaagaatattgagtgctcgaggactcagactaggtcaagtaataggcggcgaagaaggctgagagaaaagagtttaagcaaagagaatgctagtcatggtgagcactttggatactgcagcatgacatgaactggtaatttctgggtttgaatgcaattacttcagtccccatatccgaagcaacgcaatgaaaggattagacgagcgctgactggaatgaggaaaaccttaaccccctcaagtgcatgtgccaattattctaacagtagacacagcaaaagaggcttcctgagtaaggaaggtcatagatgagctgtatcactcttcccatagcccgtctatcttcctgtgcatattttatatgctagtgtattgcaataggcacagactgctgtccttttcagcttctaggggcaagctttgcagtagagcgcgctctgtattattctcctcgcggatcggcagctatcagcggaagcgacgtgagtggatagactgaatctttccatcattctggaagacccgcaaatctttcgagttgttccgtccttgaacgacatgttgacggacctgacttgggtctcgtttggttcaccattgacctgcgtgtgggacgaggaatatgtgatttgtgagcatcacactaactcgaataaaccagtgagataccctgtcacgaatatcaagtgtcttcattggtaaaccctggcttgcgggtatgtaccgtcagccattatctttgggctcggagcgcgctgtcgagccttcagtgccccgcaaagggagcatgttggagggaacttaagaacatttccaggtgcgaggatttgccagaggcagtaccctttatacattttcgacaattgtgcgttttggtgaccaggaatcataatctgggtggtctcttagtgggtgccgaaggacaagtcccgatgcgaggactagcccgaggcaaagtcctttatatctttatggagaatttgtgcgttttggcgaccatgcatcataacccgggtggtttcagagaccacccgagcaacccgtgtagtcgtcaaggacaaagcgcaacgagatagtgtcaagacgtaccacgaggctcgatcgacatgtcagggtgtacggtataggagggccgcattcaatgtcaatatagccgtgaagcccatcttcatccccgtgtgccggtaaaaggtcttatataccaaacggtatgtcttcggaggcattctgttctcggagtaggaacaggtgcctgacaacatagtatagcgttatatagctcacagaacgcgcaaagccaaatcactctttgtatctcgcatcgtactcggagcattaggacaacaatcgatttgccgaggtggtggcccccaacagagacactggaaggtcactttgtgacttcccgtcaggatggtagttgaaaggcaacgcgtcacttggagattgataagaggtgagaaagtagcaccgcgttgtatcttcttctgtacggctgagattctcaataaatggcacaatggtgaacaacacttgagataatgcccagatgttagtgggggagcagagaacacattcgcagagtaaccaaccagcaggaagcccaagcaacatggtgactatattgcattctttccattgggaccaaaccatgccctccttgtgaaaaaggagacagattcgcatcatttgtgacaatgtgcccgtttcaatatctgtctcctgttcgacgggacaaaaggcttagggagtgtcttcggcaatcaaggaagagagatgtgcgtcgtcgagtctaggcttgcaacatctggttcctggccattgtcgacctggaaatggccgacaatggcatggggaggttgttcatgatttgattatatactattgctctgtcttgctctgtaaagaatagaacagaagagaagcagtagaggaaagaatgggggcggcctttatagttttggaccagtctgggatattgcgcttgctgtgagtttggaggagaatttcggaaaacgccattcgtatattcggtaatagagacatggctgtctcttcaagcatgcgtacagagtggaatgtcccgaggactttcttggggacttgccggattatatagccaaaaaaaaatcagtctgaatgttagattcacctacgtacttcgcctttgacataattacaaattcgaagcgcattgattaattctacgtgaaggcgacaggggacgcgtaggtgctccactcgatatcatcttcacggagtctagtggagtaggagtgctatagatagactgtatggcacctaggtaccttgaacttcttaggatggagcatatctcactgaacgagaattcactggagtctacatccaacgctaagcggtttaggctatttctcccgtaccgcgtgaatgttttaatattatttgttaggcgctatgtttagcctgtaagaatatttgatctttatccctaccctcgtcacttacatgaccttattcacgtcccaaaacataaaagtatcacgggaaaaggagaaaaaaggtcatagatttaatatgataatttgtcattcagcgacgccaaataaattaggaataggaagatcaagccaacacacccatcggatcccacctgggcaagaccttcggactttggtccagaattgcgcgcacttcactcgaaacgaagtctgaatcaaccacagcctgaagtgtatattcatccatccagcgatccgtcatcacaaaccagcccttatcaccagcagcttcgccccacgaattctcgacccgccagcgcacaggctttccatcttcaatatgcacacctgtaataaccatggcatgggtcattgctgactctccgctcaccaatctctgggccttgctcattcccagcgagatgttgaatccaagtgtaaggtcaatgatatcaagatccatgatccccagcgtactattgctgaatttacctacgtcgcagccaaagaagacggggtgaccggctttgagcattgagatgacggcttgtttgaggatctgtgatgggcctgcgttaatgacagaaattaattaaagatgatatgttgacataccttcatctccacattgacatacgtgagtggtcgtccttccagcacatttcccaacctctccacagtcaacaaccggttatattcattgcgcggatcattaactaagctgaacaagcgcgcaggagcgacgctgcccttcctaacagctcccagactcgttgcctgacgtccaaattcgcgtggtgtaagtctaatttctttagacttcccttccgcatcataatactgccacacgaaccgctcatcaggactaggaggcggccccaaaagaagggtaaccatggagtggatttctttcaagaaccgctccttagcatccgccaatccggcggcatcaccactccgcaccagccgtctcagcacaagcgcctgctcacgcagcttagccgtgagcaaccaattcatcttggagctattctgcgcatgatatgcatccggatatagatcatgcgggacgagaccatacttctcgatcagattgacgaccatatcccactggccgccatcactgacggggtcttcaagaagcttctgcaccagacgaccggatagatcctcgtcagctgtggtgatgatctgctcgaagaaccagttcgcctcctccagcttgtcccagtagaagagatacgcctggctcagctcaaagtcctttaggttgtacgccttcatcaacggcacgcggtatacgttggtcgatgcgaagagccagcatcggccggaggatcgctgattcgtgatcggggaaccttcaatgggaaccttgatattgaatatgtggaggtcggattggagagcggggcggttggcgaggacttcggtgtagggctggctggcaaggctggatatcgcaagacggttctgttgttatccgcaacagagttagtgtggttacgaatgagagagctgcacgggttgctatacttgccttggcgtttcccagtaaggtctcgttccagtcttggacgtgatggagggagagagaggaagcacgttcgcgcacatggtatggcggtgctgtgatcgtgagcgtgtaccctatggacgaatgaagcgggcgctatcttacgagcctgggctgattcctttgtatagagcggtagagagcaactatcggcatcttcaacccactctcggtgcgagcgcttttcctcgctattatagttacggggatctggcttggaataactggcgcccatcgtgaccggatatgattgttcgtggattgagaatagaaatgaacttggaggaataccttatggggaaacgagagaagataactgataaggaagcaagcaggcggaagcggtcattcataagcgtgaaggacccggggagccagcgagcggggaatcgaacagctctggataagatatggttgtttaattggcctgctgggcaagggattatcggctaattgctgataattggccgctctggcggctaagcaaggcttgacgctcggacggggcaaccattgaggatgatcacattcctggcttggattccgacatgcaacacctgctgacctttaaggcatcaatgtcgtgtgagactgttctctatacacaacgaagcgaagtgatgggcagtttactacgcaggaaagcagatctaaattatttggaaacttgaaaacatgatttgagatcagtcagtcaacataacgacggttgtcaattattgtggctagctacgaaattattgttcataaagccagcaacaaccaacataatgtgtctgttttgacgatactagtatagcttcacatattcatgcgctcgaataggtcgaacgcctagccaaaaatcagccttaatctagtacgagcgacgtcgcatgtccaataatcagatattcgactccatcgagttgtaagtaatagcacatggaaagccagaagggactaaattctcgagcccaggatcggcgatcactttggtggccctataattgcgaagtcgtaattcatgcctcatcgtgtgtagtgcttctctggtattggcttcctccagaccatcgtgtcaagaagcaaagtgtaatgctcacggcacatgagtgctgcagtatgcccggaaatgtgaggcagataaaatgcgtccaaggcaaggataaagtcgtctctgccgtccaccaagccctctatactatcgaaggtacgggctatatccctgtattcggggtcatcactgtagaacgtgtcgttggaagtgacaaaaccttctgacatgatgaacgcacttgcatagttgacaaacccccagtcagctgcatcagccatttcttctgtgtccggaatgacacgaaaccttctaacacgggatagacgacagaatggcaataagacttcgttgaagtcgtacccaagaccttcagtgcaaaacgtcgaagtaagttggccgtcgctaatccagtcaacaccattatgcttgcgtaggcgaatcaccatagatatgaaagtttcggggctaggttcgctgtgacgtaatcgttcgtaacccagcccacaccaatatatgtagtaatttcttgagacgtctgcgtggcacagcattcgggtcagtcttgatatcttctcccagagcaagatgaattggccgcaatcgtcaggatcaggcgcatatatgtgaacaacaagttttaccttgtcgtatggtacccttgtcagatcactaaatttgagaaaatcttgtcttccgatcacccagctggcgcatagtcgtttgcagcgaatttcgatccacggatcttctagaagtgtggtaagatggatatcaaatgtgtcgtaaagacggtcggctatatcgtggtaaattgcctgactagttcgaagaatcgcaagggatccccctttaacaagctcctcccagatgagcaagcgtatttcggagggcaaaccggtgaaacgaccaaatggtgaagcggacatggtcgatatggtgttggttgaatgcctgattgatgaagagagtaaggatagttgtactgggtgacatagactatagctgagaccagacaaaaactgggctgaccaagaaatgatagaattatgatcatcgtgacatgaaaatgccaacttagcgcttacgttcaattagccttgaaggcatcatgatgatttccatgacaaaaaagcaggaaaaaaaaattctattcctatacagcgtcgtcatgatatatagtacggttttttatttcgccgcgattcggctcatcatgatttgtagtacgcaaatttcactaaatagtccgtgatcgttccatataatctcgctcttcttgtcgctaggatcctcttgaatactcctcagcgtatctgagatttttttttacaactcacatactatttccctccatccaagacgtggccctcatttcatcatactgttcatcttcttccacacacctacgcgactttgcattagcccggacaaaatacagagagaaaaggaagaagtggacaccgcgtactctcgaaggagacaaatccagtcttgtcttcatcatagaagttgaacatggcctccaactgcatatcgttcagttgactgccgctgctgctacccttcacggcggccttgaactcggggagagcgagctttcctaattatgatagaagcagcatcagtatcaggaagccaatcatgaacatcctaaacttgatatttaccttcgccggatttatcctgcattgcgcattagtgcctaatgacccaggtgattttagctacaacttaccgcctgctggaagagagccttcagctcatcgtaaaaaccctgtgttcccttggattcctacgaaatcaggatgagtccatgacggggaataactccacctaaggagagcaaatactaaccgaagcagacattttggatatgctgatagtcacagattactactaaatagatactaaaattgatgcgttaagcaaggccggatcgatgtcgtggaatttttcatctccacttttcctgctcggatgcgcgacactcactcgctgtaggggagacccacttgcttatttggttcatacccatagattaagttgacgggcaccaatactcccttcccggattctccctgtcgagtgagtgacaccgatgttatgaggttgtcttcaaagagctggttctcatgttgctcattgcttgtctattttttggcactgattttgatagaaggtttttctcagtgcctctatcaattatcccaccatcgaccttcatcgaggccctcgcgatagatttatgaaggaggtttacgtgaagaaagtattagcaggcagatacgtttctacatgatctctctgctgaaccgctatagtttcctgtatagaatttactatctcgcatgcggattttgaccatgctatgcaatcgaaattcaacacctcggctacaacttcagatctgtctaagtgaggacttcgcgaccgtgcattcgaccttagactttctgcgtagaagtagtctcctagaaagcccaggttcaccatttataattgatacattttctacatgcttctacgggaagagagctgccctaagcacaggtgcagtcaccaacttagaaccccgcaacaacacaagtccagcctaagttgatcacttccacatgtagcatcaaatgagcgatatacaaagtgttctctgcttttcgaataatcaagaatgccagacaattgggctgtgccaatatagccccgataagaaaagtaagcatcaggatcaggaccacacatcttggcacgaacatccccgacggacctgcgccggaaccccggtgacacgataagctgcagaccgcaggatgcacgggatgtgacctaccactgcggggttcactaaagagatgtctcacattgctaatcggttattgatcttgcctcactttttctttttcctccgagccgtgtgaaatcccccgttacgggaggttcaggaacacgtccagcaatttcgggaagttaggcgttccgagaccggtgacgggatcccatctattttgttcaccgattgttagcatggctccatatatcgaagcacggtaataaaggaataaaagatcgagaggaaaatacatacccaggagcagtatagaacccctccgttccacaacccggattcgacccgttcgtaatatcattcaacgcccacgcattccgatacagaaccgggttcaggaagcctagtgggccctttcctgccgcgatgcgcttctcaatgatgcggttaatcacggaggagaagatcggggtaccttttgattattgtcattagtaattgaaatataacggagttgggtggatgtagtagggtagtaacgtactagcactagttccaccctcaagtatgaattctcccgcgttgtactccgcgatgttgtcgccgttcgctgccacgtcggggtacccacgtccaagacggttgtagacaccgccgtttttgccgaagctggcgttgccttcgtagtaaggatagggcgggttgtgctttttgaagtatctgaatgggggttgttagattgcgcgtataggatgatagaaaagaacctactctgctactgcttcggcttgatagtctggaatagtatagatgttgctgaagccaccaccagaggagaatgcgaccgagtaggggtggccggccgggtcgacgacggcgctttccccgtctgcgatggtctttccggggtagagtttggtggctccgacattagtcacccaggggcaactagagaagttagatgtggttgttgcaaggatattgcaagagaagaaaacatacgaattggggaacgcaggactgaagatggttccatttccgagacacccgttagtcgagtcgtcgcctgggggccctgcgacgccatcatcgccagaggcgaagaggatggaaattccctggagaccgagcttgaggaatctattcctgttgttaatttggggctgtataaacagaggcggggatggcatactcattgcattgtcgctgctggtagtaagccgggaggtcggcctcctggccaccataagagacggagatgacattcgtgggcttataaacaccgcacatcaactgtcccttgtaccctccggtggagttatctgggtaagtgggatcgagagtcgggctgtctccgcattccccataggcacagtaggtgcagtatgactgaatcattagctaaatccgaaaattccagaggccaacttaccccatcaacagcatcaagaaaggtgttaaagaatccatcagtctcaacctccccacttgcatagtcatagtcatctgtctgatacagcgtgatggtctgagggtaaacaattggatacgcaagctgaaagtccaaatccgactccgcaccagcatcggcaacgctcacgggcgctgaggctccatcgataaatgccggcttagggtgtgttcccttcggaatgtacggggtgaagttgcggaaaaagagatccagatcttcctgggcgtagtagtctccttcttcgaagattccaagcgaattgcttgcactgacgttgccgcttgcgtgagggatcttgtacagagcggcgacacaagctggagtgatgacctcgtcgcacgtggtgagagacgtggcgttgactgatgtctgcttcaagggtttgtacttcttggtgtgcttggcagatgggcccttggaggtcaatgggagaagaacgccgggtttaatgaagtcgatgtgttgttggatcttctgggggacgcggtatctggtcgtcttgttagtatactatatctctgagaatgaatgggagacatactcttccgctgcgagtgtcttgaagccagaaatccggtcagtgtagtggtaatacttggtgtggaggagattttccgcttctttggtggttgcatcaaacacaatccagccttggtttttggtgtgaaccaagcgcgactcatccacaccggattcaataagccagttgcgcacagcgttgacagtctcattcgacggcgcaaaggtactgtgcacctcttctggagtccagaatttgccgtagttaggcgacacggagtcagacctgactagtcagtcggaacaatatagggtaaaggaagcaacgtacacgctcatgagatactcataggctcgatcaagattgttctgcgtcagaccgatgcgcaccaagacatgctcagtaccattgacccgactgatcttctcccatcgagatggggtagcagatcgcttctcatgaataacatggtcagaagttggcaaggccaacgcagagaccgcaagggtcaaactgcagattgtcgagaagaacttcattctgactccttatcccgtctgtaccctacttcagtgcaagagtactgtgaacatcacatactgctaccctgatatttataatgaaatagactccgacgcatctccgtatacactccgacggggttgcatcctttcggcatccaattcatgttagggcacgggaactagcaacgtctcacttccgtgaggagaacggacccttatcagaccatggtcaatatatagttatgtaactaaatgtatcttatccgtcattgcaaccaatgatggccattgattggtgaaggatgaattaatgtcttgcttttagacattaatggcgccatgtaagtgcggacacctgacgggtggttaattaagcagagaggggtatctgtgcctgcacgggataagaactatcacacacagccctaataaccagctttgcaaacccgaccacttgcagatcaatttatgttggctgcccgcttgacgggctcaaccgctattcatccttatcggaagaaagacttggccgaaaatagaaagtcatctaatgcgcaagcgataacggaggatcaagcccgggaatttgctaggaaaattggatgtcatcttgtggaggggaaggggccaatgggagggtttaaggacgcatgacctgtatgtatgtgttgagcatagggatttctatccaccgtctacccatctgtacgagaaacctagaaatgattcccggacagttagcatcgaaatgggtattacggtgtatttccagcagactttagtcgccttccctttctgctctagtacgccgggtattagcgggcatctggcaaatctgatttttgagaccgccgtagtccaggccgaatttggcgccactttttgctgcctggcaacagcttgggaggtggattgtggataaaggtgcgtggcaagagtaactgttccggccacaaaggagaacgcctaagcgatcttctatagagctcaaagtctattttatcgaagtatgttaaatacttcaacgtgtaaaatgaatatacgaaagtacagtaaccatcatagcacctgaaaatatcaattagattcgaacatttatcctagttatagaaataggatttcagtagggaaaattcacactaagacgcacataagttagtatatgtaactcggctgaaattcggcttgtgcgggtggtagaaaagtatgactcagacaggtaattgcttgcagacattcctcggaaaatgaatccggcggggaggaatgtctatagcgtggttcgtaggcttttttctgctctagcatccaagcaatgcgtactgctattttacgcttgtggcactttctgcctcacggcagcagctcatcaatatattagcgatcttgctcctgcatttaggacagacttatggagcctacaatctaggaagtgaagagagatcacaaggtatgattctacttggtctcgatgatattactgttactaccacaaggcgcatcggaatgttatcgtcgcaattagaaacatgttcaaacatatttgaattctctatcgatcacacctggttgtagcggtgcaattatgctagtatcgtagtttgtagccacccatctcaacagtcatttggaagaacacattcaagagcctggagtgatgtaagctaagagatacctaatagtagtgccatataacctacatcgctgtagatatatccatctttacatttacaccccgggatgcatgcaatcacacagttggatgggttcggattagaacatgttgcaggacagggtgtgccacagagagagaactcttgatttgttccctcataaaccataactgttagcttgatgagagagatggtacaagggtattagggccatacacagttgggtgcggcagcagccaggagcgaggtgccgagaaggctgatggaaaagaagaatgagagagtcttcatttttataagttcggtgaggagcgttttgagagcgagtgtgcttgaggattgtagaattgacttggcggagaacaaaggggttccatggtatttatagctttgaatagcacgatggcaagcacaaaatgcattcttttggaatgaattcctgctttctaaccaggttacctacattccacctcgtgtaacgatggttgataaatgaaggggcgaactgacacggtcataatccgaggtccgcgaaggtcgtgtgatgggaatcaatagtatgatagggtctacttagtagagtgccgatcttgtaagacatgacgtacaaaacctgcttaagagtcaagaaacctagtggaataagccctttcaggtcagaagatctttgtaccgttcttcaggttagatggttttctcgtctagcttggcgtgaattggcagtatttctacctttgtagggcataatgctaagacaacataacatacctcattacaatgattccccgtaaatgttgatcagggcttttacattttcctatgcatcttttgtaacgaggaaaattgaacattttagtcttcaactaacaggatgataagtctacagaaactttgggcatattgtgtgataagacctgatggtttcagttcaatagctggccacctagtgaaagttgacacacaatagacactgaaaagtaaacacctctattttgcaacagtattaaaaccccggaaacatggagatatgcattataggaacctatgatgtcatcagcaacctgccagctcgagagggctgggttcccaagggtgagtgtcctgtacttggatacaggctagtgactcttgtaccacatgcctcatctgttctgcagacaatgcatccaatcttgtggaagaacacaatggccgccctattatgtcattagctaagataattctcggataatctgtactgtaccaccgacaacctttgcaacataacctagtttacattcacatctctgaacacattccgaagagcaagcaatatgaggatcaggcttggtatcacatgtcactggacaacctgtggcacagaacttccactctgcattttccacctgaatgaaccttgttagtttgtatacagaatactcaattggaaatgatggttccatgcataatcccacgcagcagtcagaagaggactcccaagaaggccaagggcgaagaggactgtagaagccttccttatagtagtaatagttgaattggataagatggcaagggtgggtgtgattcaatgagatcattattttggtggaaacagtgcagcgagatgattgtaatattgatatgtttccaaagcttataggcaaacctcatatcgtacggtctatcttcctaagcaagttcctgaaggcctagcggtgaagaaattaagtaatagtgtaataaggttcaatagtatgggtaattatgtactagagctactggaaaagaagcaatatgggcttgctgatacctcacttgactcaactttgcagacatccgtgtaccactttgcaacggttactggcctcggaagcttcaaaaagttgacatatgcatgattcgaaggtatgcggtcaataatatgacccgcgactaggtaccgcttcttttcctcattgtccacggatgcgcaaaagctcgcccacaccaaggtgccggacaagtcagattgttgtgatgctgacagcaccggcagcagagtggacgagggttgactcgcctgactgcagacgtgtgcagtacttaggcgcgtacatggctgtgcaaaagacaatcaggacacctgccagttatggtcgacttgatacagcttcaggatgggactgtctggtaggtttcgaaatgatcattgtccataactgctctcctgtaaccagcggcggaatattgcccacacctaaggtaacaatgtgtcctgtgaactcaagactgcaggtggcattcttcgttgggactcgtccagccatggcatagacatttttttagtgtctttaccaatacaaccgaccttaaaggcattgtgatccgctgccagcacgggagaggatggccgctgtacgaactgggttgaactgagttaacctggctctggcactgacaggtaggcgtttccagcttgagcgagtggtttgggtacagcagtcacattgttgtgtcccgattcgagcgcttatccggcacaacgaactgatcaggaggtgttagccattccgaatatctgaaatgcatacataactgtgactcagattcgcaatgtcagaataacaatctacgagaagagtacttctataaaggccaacattgaggtctggggctctggtacagtcccaaggcttttgaaaaaggtgctcagagcgagaagtggcccgcccactgtggactgtctgaaaaggttagtggggagccggtttgtcgacgtgaaagacagcagtgaactgttaaaggtcacagggaaaacagttgatcgagatctggatatggcgcaatcatctttaagctagataaaaatagtactaagtaagaagtatgacgccgaagtacggcatggtgtggttactggttttggcggccgacagtagtgcgagagaacaattcagtgtcaatggttcgataaacgcggctgcacccgcgccctccccaagtcccaaccccctcgccaagccccccactatcttcatcgcatgtgtttggagcagttatatcacgctactccacctgcttgcatgccaaagccaacacagcaagtcgctggcttggatttctgcctgggcgatcccaagatgtccgtttacccgttttctcgacctacttttcccaatttacgaaggttgaagcaattcgctaatccgaaaggtgaagttgtagctatgttatgattgctatgcaagaacacagcattctgtagctcgataagtggaggtagaaacatttgaatttcttgctgttcgaggaaagaggagtagaatgaaaaaaaattcctgatcatttgatctcgcctactggtgacctgctagtcttgcgttccaatactgtatataggttagaggcactggcagctgtgacccaatcaagggaaacaccgacggagggtggtggagcgtactaatagagaatacatgcatccttgattcatatcatccaatcagacacgggaagtgatgtatttaaacgggtcctttcgaaggacgttttgactacgggaagtctactgagaggtactctatacaggtctctagagtccagcaaaagtatcgcagcgaatgatattgtaagtgagaattgtactttagtgctccttggccacactagtaaatggaagcccgaacatctttacttgaagaggaaggtgaagatgcggggttggcaaatcgtaacaagaccatcctacgaaatacacaggacacctgattattcgcttgctgagttagagtgaatgataaggcctagtttacactgaattgggggttcggttggatggaaactccagtgccatttcgcctttcaaccagggacacggagtctctgcatcgcattgacgtgctccggtgtctaatcaaccttcttccacttcgcccctccaccaccaccatcgacacccgtctcacaacgggtggactccgagtcaggaacatctacagcaagactcaccacctcactccaacaactacacatgaacatctcctccacaactgtatcaagaccaagaacagcaactatgctctcaaccctcctcgcatccctctgtccatgctaacgatagctttcttttgcatgatatttgcatgagacaagtgcagaaggggattgttgttctcctcacctcaatttgctatagctcctttgagtatggtcacataaatgcaggaaagggcgaattttggactatgcaggtactgagataatgagagatgggtgatggggatcggcgtgcttcttggtcgtctgaatgtaggctgcatagcctgcagaaatcggagacaggccttatacctagaagatggacaatgcaaagcttccagagtgccgatactctcttcgctcaggagtgggttgtccagccaccccgaggattttacagagggtcggcgccagtcgggagctttcatcgccgactataatcttttccgcgggtagggacgactaggatgcttagcaaatgatccaataaccgaataaccccaataccacaaaataaattatgagtggcacagggcccaattgaaatgcggcaggtagctagcacagcctagcctgcgcactagatgtgaaagtgacctacagataatctgcgtcggcggctacaggaatgaacaaggatgagacaattcaagcctgccatgctgtgccataaggtcccccataaaccttgcttgtgccgttgtgggctgtgcctaggctttctttaagaatgctcccacctcggtcaccggtacgtccaactcaagctgggatttcataaaatcgtgaaaggtcgcctacatggtaagcagcggcaggaatagatgcagtaaaagcgaatcattcttcagggccatcaccgtggaacccctagtggtgtgctgacacttgtgaccgggccatggctggggtagtgcatcgatgaaaaagagaaaacaataacccactccggccgccctctcagaagcataatgcgggctgtttcgtgcattggaggcaagggctggcggagggagtccccttgaagcttgaccattacccctctcagtcctaatgatccttgttacattagcgttgatctggtgccttatggcttctccactcagcccctccaacgtcacttttcccccaacatggccaggccatacaacattgatcatttatagtttatagggccccagtaatgtccccttttgctcttcattttcctggtgatacttctcgcactgttcacattcactctcgttgactgtactatccatggcgctagacattcccagtggtactcctgattgcggagaaggaatcatgatcacattcatcgtcctaatcgtcctcacaacgctattcacggcgcttcgggtcatcagtaaatttattacccagcaagactggtggtgggatgacttcttcgcgatcctcgcattggtatgcatgcttcaatgcacagtgaaagtattacacgcttctgactggtttgtgattctccgtagccgatggaattagccgtcctttcccttctgacggcgtggagacaaattggcatgggttatcatagtgaggtagtagctgcgatcaacccagaatacctcatggccggcgcccgctatctctacgtggcatactttttcttcgacggctcagtcagtgtgcccaagctctcagccgtgttcttttacgcccgcgtgtttcgatctaacaaccgttccttccgcacacacctttggatcgcgggtggactgacatctgcatggctattagcggcctggatatccaccatacttgaatgccgtcccattgcaaaggcttggaacactgcattaccgggaacatgtatcgcccaattccaatggtatttgtcaacggccattctctcatgcatgattgacttctacatcttgttccttccggttccaatgatttggggcttgcaggctagtgtaaagcgccgcatatacctccttgtttccttcatgatggcctactcggtcgttgtgttgtcgcttggccgtctcgtcgccgtggttcagctcacccccgttatgaaccaggatcttacatggaactttgtgccatatgcttactggactgttcttgagggttcgatttctgtcatttcgatcagtgttcccagctgcatagcactggtcaaagccctgcgggatcgtccccggtcgacagttggctcgggcagcaagggagtgtgtgcgaaaccaatcaactatatgagcttacatcctggtgcacgaaagatagtcaacttgtggcagaagggacatgcaagcagcgacagtactgataagctcatttcggatacccatgtcagcccgggtgagtacggccatcgtcgggatacgtatactccacttatggttcacgttgaaacggatattgacgtcagctggcttttataatattattctatagttgtacatagaacgatggcaacagtatatactctagatccattaccacaactatatcgaatgttgataggaacaaatgtttccttctacacctaaacatcgctatacctcgtatcatcctactcaccacgtcttgacagacacgatactagaccttaaccacacgagttcttccgttctagtatatcaagtccatcttcactccccacccttctgtctctcaccctccacccctcttgcctccccaggaaacctaggtggtcctcccaaactacacaaaaccgcctccccatccgccgtcaacccatccaacacccccaactcctccactccaaaccacctcggtacaacccacactctaaacggaatcaacccaatgatcaaaatcgggaacccaattgccgcaatagtctgcgagatcgccacgcacgcggcaactccaataacctggcacatcacatagagcataatcttccgcctcggaacacggagtaacttctcattccgcgggataaatcgatcctcacgaaggagaaagatgatcttgtgcagaatgccgttcgattctatggatccccagcctacaatgaagaagacacctgcgaacacggcggcgggcatggtgtgtaggactatcagaagaggtccggtcatggtgccaattatggcgagacccattaggaagtgggagatgcgttgctcgataacagctgtcggggtaatgatgggtcggcagatttcggtgccctcggactctgggtctgagatagggatgatgtgaagggtggtttcagtaacggttagggaggtggtgtggacgggtgcctggattggtgggtatgtaagtaaggagtttgtgtgcttgaaagtggggggttgtacctgtgggacgaggccgttgggcattgggatgccagtgataccggcgatgaaggtggtgcagcctaggagaaagaagtcccagtggaatccggctggcttttccagtgggtattgtcggccttgagctccgagactgctgacgttctgttcgatgttattatgtcactagggggaagtaatattcgcgttgactggggaattacttacatggtcataatagaagagcagcatgaccaagaatccgaaaggcagggctgcaaagacccattttgtctccagttcccagaagtgaattagccagccacgcggctgtgttggatagaatgcccgagtgatgggcacgaatgagatgccagtggctttgagattgccggggatatgcgcgaatcctacccagaagattgttccgatctggcgaatagtgagccggaggtttacaggcgtagaaaggaggtaaatcctaccacataagcataatctgcaagtagttcacgaagccatggtcgacaaatcgtgctggatcctaccaattctaggccatatattgtgaagaaatacagtatagcaatcatgcagctcatgaagcctgcggttggaccgtagacagtgaactcattcaccagctcttcgactccctttactactcgacttagtagccgtccctacaagaaggtataccgttcctgacttactgcaatagatgattccaacatatgcaccaaacgattcagatgaaaagtccgtgacatagcgcatataatcgcagaggttgcacacggcaacaatccaatgaaagatcgctgcccagatagcagtccagcacatgaagttggcatatatagccggctcatagatgactatgatatcatatatggtatagttgaacagcgatattagtcctgtgataccaacgatagtgagtggttgtgcgcccaagacgctgaaaaccatagccgcgagagcagaggaaaacagcgcttcgttgatgccatagaactctccggttcggcgatacatatccaaggtgtaggcgatagctgggagaatactggatattttcagtaaggacaacaccaaagtggtctatttaggggcctacttgatgaagtatatgcgaattgtacttgcaatggttcgataggtgagcgcatctcgaatatcactccagtagtggggtagtcgtcgacggacatcgtgatacatgcctctgcatggattcagcatacgaaagcgtctccttctgtccgattgtcgtaggagtaggtatatggactctgcccaccgaagtacttagtgccgggcatggtcggttaatgtgtgtcttgtataagtaaggaacggtaggtgaggtgtttctcttatttattattggaattgattggggcttggaccagacataaaatccctttcgcttctacacatttcccaaccgacctagccgattctgtagggcagaattggcaattctcatgttgggggggggtcagcccccctggatgatggatgcatctccacaacaaaatgcttgcacccctgcagaaagcaagctctagctctaagataccctacacttgagcctatccattctatatatcaacattaaaggacctgcctaacttgctgaaccaaagaacaatcttgggcaactgggctgagtgatgggcgataaaattagtcagcattctgcccgagcagaatctgcccttcttggcatccccaagatcagccgatagccgagtaaagaccatttgattgtcgtacgttgtcaatatcctcaataataagctattgttgaaatataatggactatatagcaccatcactgatctcacaattgtccagcattcttcaaaatccatctttcccagcacatcttcagtcagccgtacatgctgtctggcacagccaggatagcaggcagaagagtgcaagtgaggaaaatggctacccacagctccaccttcgaattgaagcatcaatagtcactgacgtgacgacgtctaaacagacaagtgatttagtcttggtatttatatcaatttaatattagatttaggattctcgcctaactttgtctagggatacattgatcttcgaagtgggcaggcagtgccgttgccacccacacccgtttcaacgcctgactctacagtaggttaactagaaagctgaaaatagaatgagataagtaacggattgtatagattaatacagaatatgctaccatcagcaccgactcgaacggcggccgtgataatagcactgctcagagccatcctcacaagcggcgcaagaccgtaagcgcgcttcgaccagcaaaggcgacaaccattcagccagatgagtcaagagatcatgaatacgaaagcttagatttggaagccgctgccgattctagtggaaccaagccatctgtacgacaggtccacagtgacacccggtttccgcaacggaagaacccacggcaggagtattcattacctgtgctggaaccgacttcagccgacaagcttatagcaggaatatggcgacaactacattcacctgtgaaacttagccgacttccctcggtatggcatctcacggaaagtactatgtttcagacactaagaaaaacagatcatacaatcaaacacggatatccgcactggtgttagtctcgaggtaggttttctggtgatactaactcggacttggctgacatcagtaggtatcccgtgagataaatacattatgcctgaaatactacaatcaaagccagtcctctcgtgctctggaaatgatcgtccaagcatactggatagaatgtttcgaagcacgcgttgccgtcgttcgactagagaagcctcatctttcgacaacagatgcgcgaatgatggttcttaaggaggcttgcgtggttctaaactggaaggaaaaggatctccgtaatcgaatgtactgcttccgcctcccattgacagagcgcattattgacacacatgtagggcaatctggcgcggttacaaagaaatcaaagatacaggcggttgggcctgcctgatattcgccagtactggcatctaccgattctgcaaatatcgcacagaattcggcgagggactatttacccgtctacggcatctccaatccagcttcgaggtagcagctgatactcttcacccgggatggagggacctcctacaggtcattagacagaatacgtcgtgtgtctatcatggccatccgcatgagtgggttaatatgtcggagggtgctgctgtccccctagcttcgacatacgagcatcttgaccttcctcagggattgcagtaccagttcattgaagagtgtgtgctagaccgtactcattttggaacacatgatccacgtcgggtaccagaactagaccccgatctgtgtctcgtatgcaaggaaagacagtcggacgagattcagaagaaccagtgcctgtgtttcccggcgttattcggtggcgttcgtcatccggtgccagttcaggtctttcgcacgtcgactggcaagaataatggcgttattgcgcgctgtgtgagttaaccatttccttcactaggattcgtgatttccattcgcttttccctagcaccgtgcgtgcctttccctgacagtttactgacgcagaagtagaacttcgatcgcggaacagtaataggcgaattcacgggcctcatcacaaacggcatagaaggagtagatgtgatgctaggtggttcgcgcggtcgagcataccaaatatatcaggggcagatgggcaatttcacccgatttatcaaccactcctgtcggccgaacagccagttccaacggttctactggcggggcatggagcgcattatagtagtctcacggggcattttagcaggaagcgaaatcactgtcgactattcggataattattggcgccagctaagcaagaaatgtctttgtggagagtcgtgttgtcggtttgctgggagggagggatgattgttgctatctggcatatagtcccaggtttgtaaaatctaggcttgggcgggttttctggtgctcggattccgaagcgatgggtagatacgattcaaatattaatttgttcgaaatgtttgctccgcagctatcatccccctcgacgctactagagtgttgtgcagtcgtctcccaaatcagcctgtgcaatgtcacactgcaggtcaaggctctaatacgctctgtgtatacatcgtcagcatagcggtttttatgtgtccaagaaatgcagaatactacttcatgaggaagggaatctggtccatattattgccgcttagggctttcaaagtggctcccgatctggacaaccgtgccaaagcaagtcgaaatgtacgatcttctgctaggttcacatttcaagtccgactcctaccacgcataccttccatctccacctccacagttacttcgctccctggctcctctaaccgactatccccccgccccctctccacccccaacacggcaccctcattctccctcctcaagtcatgagccctcacaaacagcgtaatcaccgacgccaaccccgcaaacgcaacatacataacccagaccattcgcagagcctgaaagtacgtctccctcacaatgatctgttcactctcctcgagcgcaccaattcgctccacatttgacgccgcaaggtccccattaaactccttcgctaatgcaccatcaccatcaagtctatcagtcagtgcaccattagcagatgtcatctcattctgaaataccacgcccccaactactactgctatagctgttgcaagcgagcggacgaatcccattgtcgctgtgactgcggcggtgtcccggacggtggtagctgcctgggcggcgaggattggtgcttcgatgttcatgcctactccgattccagcgagtgtttgaaagatgataagacgggtaagtgaggtctcgaagcggaggtcgattaggagaccagtgcctatcatgaggagtatctgcgcgatgtacatgaccggtatgtaccgtcctgtctgttgcatgtatacccctgcggcagctgcagctagtgcgcaggagactatcagtgggaggaggtagaggcctgaggctagtgcgcttgcgcctagcacggactgtgcatataatggtaagtaatatgccagcccaataaagacgtagttgttacacgcgaagacgatataaggggctgcttttgtaggtgaagagaagagccagaatgggatgacggggttgcgggcaagtttgtattcgtttactccgaagagacccatgcataggatgccgaatattatcaggcagattatggtcgctgaggaccagggatagactacatcgcctaggtcgagggcgaggaggatcatgagtgcggagccgacgattaggaggatgccagtccagtcgatggcttttaggcctgttgttaggggggttcggggattggggacgtggaggtagagaaggaggacggtgaaggaaatagcgccgatgggtactgcgattaatcagagattaggctatgggtagactggtggatgtggtcttacagttgatccagaaacaccatcgccaactgagctttgtcgcaaagacgcctcccagcacaggaccgacagcacttccgacagcccatactaacgaagtgatggcaaggtagagccctctgtctcgtagtgaaaacaaatcacttatgattatattgaccataatccccatgccggagccacctagaccctgaaacacccgaccagcgagcaggacgtccatagacggtgctagcgcgcataacagactacccccaaggaagacagccatggcaatcaaaatgacgggttttcggccccatatgtcggcgacggtcccccagatgggtgttacagcggcgtaggcgagggtgtaggcgccgcctatccaggtgtagccggtggcggagttgaaggtacctactatggaagggatggcggttgtgatgattgtaaggtctagggcggagagaagcacggagaggcagagggagagcattgtgcatgttatggttgttttgttgttaatggtgttggttgtttgattggcggtggggacagagttagttgtttgttcattgttaactgtggttggtggtggcttgcgggtgctggagttggttgagatatcggggccaatggtgttgttctgggtggtggatacaggggagccgatttcgatctcttgagtctgtgttgcggatgccatggcatacagtaaagatgatcgagggatcttgactggttcaggttagagctatggaattttgtggttaaataaaagcagttaatcacgtgctgacggacgaacgagcaaggatcggaatccttctttgtttattctggatttatgaaggagggactccagcacagcataatgtagaagttcaagtagctttaattgggcgaacatgtcgatgttttcagttgttattccaagttggttagttgataggtatttatatgtttggaagagttaacgattgctggttatatagaaggataacattcacaaagaatatatattcataaatatgtgttgcagcagcacaacgcctcatcagtagagatatgtacactctagtatactctatctatctcacaaaatatctatcgatcaatcgatgtatcatcacaaacgatgaacgtgagtacaagtacaaacgtgatacccttactcatccagcgcaaaccggtccacaaagcggaaagtgtagagtccctccaagacctccttggcgatcttctccgtcgtctcgctcgagccagtgtacacaccagagcgggaggaatcgataccagcgttcttgagcgcaacactgccactgccgacagcagccacgggcttaccgtacctgaaagaatcgaccaggatctggaaaggtctggcaggggggtagagagtagaggtggcggtagagttcatctggttagcgagagcaggggaggcaaagaggctctggacaccatcggcaatgatgagggcgtcaaagtcgatggcatcagacagggcataggtggtgttgacaccatcggcgtaggcctcggagacaatgttcaggtcgacgccagcggcagagaactgcgcggccatggcctggccctgcttgatggattcagggtgggagttcgaggccaggaagccgacctgcagaccctcgatgctgaggaggggcttgccgaaggtaccgacgttggaggtcttgttggaggtgtagtaggtcgggttgggggagggctcatcgagaccaagaccacgagcgacacggacggcgaggttgttgttgaccatgttcagctggttgacaacgttcttgcgaacgtgggggctgttgaccttggagttctggaagacaatggcgttaacaaccatctgctgctcagcggggatcagagagttccagaacatggcgggctgggaccagtggtcattgaaggtcgggctggtctggcggacaagatggccggaagcgtagcggtagggcgcggtgaagaaaccgtggccctgggtctggttggcttgcatggggtaaccgttgctcatgctgttgggggtgtaggcccagttgttggtggggatctgctgctggccgaagccgtcacggttgttgttgtgaacgggcttgcgaggacggttgacggggatttgctcgaagttgggaccgccgtgacgggtcaactgggtgtccaagtaggagaagagacgaccttgcagcagggggtcatcggtgaagtcaatgccaggaacgacgtgaccgggttggaactgcagaggttagtttatgtctggcattttttgaactggggatacatacaccagcctgctcaacttcagcaaagtagttggtggggttggcgttgagctccatcattccgagaggagtgtaagggacaacctcctcggggaccaacttggtgggatccagaaggtcgaagccgaaacgaagcatgtcagcctcatccatgatctgggcttggagctaggggactgtcagcaaaaggctctatcgatcgacatgaaggggttagctgacctcgtatttcgggtagtggccattggcgatcgcattgtacagatcctggcggtggtaatcactgttcttaccagcagcggcctgagcttcatcccacaccagactggcgacaccctgctgggacttccagcggtagcgaaccaccttggaagtgccgttggcagcgacaaagcggaagctgtggactccgtagccgttcatgtggcggaaagaacgaggaataccgttaccagacatcagccacaaggcactgtggagggcagtgctctgctggctgaagaagtcccaagcggaagtgtgtgcagtagcggcctgggggatctcgttgttgggcatgggcttgatggcgtggacaagatcggggaactggatggcgtcctggatgaagaagggggcgaagttgataccgacgatgtctagtagagacatatctgttagcatgtattggattattgttgggtttccatatcaagcataccatagttaccctcgtcagtgtagaactgacaagcgtgaccgtgaacatcacgcgcagtgtcaacactaccacggaaaccgaccacagtagagaagcgacagaacataggggtctccttgtcgttggcactcaagaaatcggcagccgtgacgttcgaccagtcggcgtaggatttgaaagtaccatatgcaccggcaccacgggcgtggacgacgcgctcagggacctaattgaaaaccacttggtcaatttattgttactacacaccgcagcagttcctgtacttacacgctcatggtcgaaccgctgaagcttctgacggaagataaagtcctccaacagggtaggaccacggggtccggccttgagactggtctggtcggagatcggagtgccaaagtcggtagtcatgtagctaccagtgtcattgacatacagggtgttgtcaatgggctgctccgtgacctcaatggtatcgccagcattgtcctgctcctgggtgaaactcatttcacccgacaggtaggggcattgagccccagcgataccagcaacagctggcaaaagccagaaatgacgcatggcggagtaaacgaagactaggagaattcagagtgctgcgatcttccgacgaaagtcaccagggggggagtccccctggggtccttatatcggcatccatggcgaggcccgttaacagaccacgcgtcttagttaagctacgaatccagaatttgagtcgaattacagccaaacggtgtcgggacttggtaatccggaccctcctgttgggagacgaagggggctccactagggtcatgcaatgttgatcactcgatgtgatgagacgagaggaacgcgatgtgctcaagatcaccacaacaagtgacaaacaggcactcggtgacaggaacaggtaccttgtgcatgaggctaatcggaaagtacacccacgttgagttagcacatgggatttctataggttaccaaggacttcgcgtcatactagtttgggaggattagcgctgtgcctgctgcaaagccgaatagtagagtgctgagcgggtggcttgcaggcatgccaaggccgtgggttagacgtgggttacttcagcaagcggttctggacacgcgctgcttggtaagaagccaagccgatggacatcatcatctccactgacttggtttcaagaggttagggctggtggcccgattggtgcggctgcttggtaatccccagaatctggatcgttccgttggttccactgccagaccagctacccagacactcttatctacatgttgcgaacgaggtttctgaaggtttctgaggtttctgagctctggacctctttcagttattaatcggccatcatcccatgccttgaacctggtgcgtcatcgagggtgggaggatcgccgatgccagatgacaagatacaaagccgatcaggtcatcatccgctcacgtgatcgggtctggagcggtggggggtgccttcattagtagcatacattattcatcgttttcccccagggttagtgatgagttatgcagtaactaactcgccacgggtgttccttcactaaacctcctttgtaagaaggccagcctggaggcatctaccgtgactgcgcgagggtcgcacggtccttcaccaatgcaccaatctggctcgcttaattgcagagcagaggaagttcctcgatgctggctggctctctccccgcacttgccactcttagtcacttgcagcactgcacctctggcaccacccagacttcctcaattctccaatcgttctagctacaatcccttgactcagcagccgatgaccaagcacctccccggatttgcagatccttgcggggtgagtaatccggcgactttgagctgccgcagtccgggtgctacgagggcgtgtgaccgggccatttcgggccagccagagagggggtgatgaggggaaagtgcagagggaggggaaaagcctatataaggtgcatcccagggaccggcagggagtagtcactggaaagtctatcgtggcaccatcatcatcatcattatcatcatccttgtctgagtatcatccatccatcagacatctgccatagatatcacatctccgcatatcccacatccaacatccaaccatggccgaggctaagtgtccttttagccaaagcaggtctaacgccaacgttgctggtggaggcacccgtaacaccgactggtggcctgatcagttgaacttgggcatccttcgccagcatgctccggcatccaaccctttcgagcgggacttcgactacaccgccgctttcaacagcctcgattactatgccctaaaaaaagacctccatgccttgatgaccgactcacaggactggtggcctgctgatttcggtcactatggcggcttgttcatccgcatggcctggcacagtgccggtacctaccgggtcttcgatggccgcggtggtggaggtcagggtcaacaacggttcgctcctcttaacagctggcctgataatgctagcttggacaaggctcgtcgcttgctttggcccatcaagcagaagtacggagcaaagatttcctgggcggacctgatgctgctggccggtaatgtggccctggagtcgatgggcttcaagacatatggattctccggtggccgtgcagatacatgggaggcggacgagtcggtctactggggtggagagtcgacctggatgggtaacgatgtacgttactccgacggtttcccaggcgtcaccaagcatggtgcactctctggggatgaaccaccccatcgcaacattcacacccgcgatctggagaagcctctggctgcttcgcacatgggcttgatttacgttaaccccgagggtcccgatggcaacccagacccggttgccgccgcgcgcgacatccgcaccaccttcggtcgcatgggtatgaacgacgaggagacggtcgctctgatcgctggtggccacagtttcggcaagacacacggtgctgcctcatccgagaatgtcgatgtcgaacccgctgctgctggtctcgaaaaccaagggttgggatggtccaaccgctaccagtccggcaaagggccacacaccatcactagcggtatcgaagtgacctggaccaagactccgaccaagtggagccatgcattcctcgaatacttgttccgcttcgactgggagctcaccaagagtcctgggggcgccaaccagtggcaggccaagaacaccgaggccatcattcccgatgcctatgacccttccaagaagcacctccccaagatgttgaccaccgatttgtcgctccgttacgaccccgcctacgagaagatcgcccggcgcttcctggaccaccctgacgagttcgccgatgctttctctcgcgcttggttcaagctcctccaccgcgacatgggtccccgaacccggtacatcgggcctgaggcacccaccgaggacctgatctggcaggaccctatccccgctgttaaccacactctggttgatgccaacgacatcgctgctctgaagcgcactatccttgacactggtttgaacaagtctaattttgtatccaccgcctgggcctccgcgtccaccttccgcggtaccgacaagcgcggtggtgcgaacggggcccgcatccgcctggcaccccagcgccagtgggaggtcaacaaccaaccatggctggaggagaccctgtctgcgctcgagaagatccagaaggatttcaatgatcgggtttcttccaccggaaagaagatctccctcgctgatctcatcgtcctggccggttgcgcagccgtcgaaaaggccgctcaagaggccggccagaccatcaccgttccattcactcctggccgcatggacgccagccaagaacagacggaagtggaatctttctcccaccttgagcctgtggccgatggattccgcaactacggaaagtcctcgtcacgcgtccgcgccgaacactatctcgtcgacaaggcacacctgttgacgctgactgcgcccgaaatgaccgtcctggtgggtggcttgcgcgttctgaacaccaactacgatggttcgaagcatggtgtcttgacctcctctcctggccgcttgaccaatgacttcttcaccaacgtccttgacatgaacacggcctggaaggctaaggatggtggtcgcgatctctatgagggtacggatcgtaagacgggtcagccgaagtggacggcgacacgggcagatctggtcttcggatcgcatgctgagctgcgcgctttggcagaggtttatggaagctcggatggacaggaaaagtttgtcaaggactttgtttccgcttgggataaggtcatgaatctggaccggtttgacctgaagggctcgggcattgcgcgctccaagctgtgaatagtgcttgcattcggttcaaattgatttagctaggatgagtaatgaaatagtgtaatgaatggaatttaatatattgttctcacagttgtccaagtatcatttcaagtgagtaccctgtagagctactactcccatccggaggttgcacaggtgcgccttcccgaggagactttgttgtccccggcgggtttccaatcttgcacgtcacaagccatcttcgggttatatagtcgagcctctcgggagacttactgggtctgtgttcttgaaagacaatactcgaacttccctgaatagatgatcgtgaatcccaaagccatggctcttcaactcctttctctactctgtcttatcctcaccacagcagccttccccgtctccgaagtggacgtcgcaatcatcggcgcaggcttatccggcctttccgccgccaaggacctcgccgccgccggcaggtcttttgctatacttgaagcccgcgatcgcgtcggaggccgtgtcctgaacgtcgaacttccaggcggtattgttgaggaagttggggccgagtttgtgggtccaacgcaggaccgggttctagcacttgctgctgagctcggtttgactacctatccgacctataacactggaaactgcactttactaagaaacggtacggttaccaattatccatgcgaattgggtagtggtagccttcctcccttgaccactgaggctttaatcgaggttttcacactccagcagcaactgaatgccctcgccgccgaaatcgatgtggagacaccctgggaccatcccaacgcctctatatgggacactatgactctggagacctttctcgcctcgcagcttacattgtctgatgcgaggtttctcctcaatacattcgttactgggatcttggctactgaggctaatgagccgtcgctgctttatatgctcgcttatatcgcggcgagtgggaatgagactgaggtcggaactttggatcggcttattgatgtggcgggaggagcgcaagagagtcgtatagttggcggaacgcagctgatagcgttgagattagcagacagacttggagcagagaatattaacctccgcagtcctgttcagagagtcctgcactgtaacggacggtacatgatcaacacaaacggtacccaaatcagcgcaaagcgagtcatcgtcgcaatgtccccacccatggctgcacgcatctcgtacgacccgcccctccccccagcacgagaccaactcactcagcgcatgggcatgggctcaatcggcaaagcaatcgctatttatcccaccccttggtggcgtgaacaggggtggaatgcgcaagcgctggctgatacaggcattatccgcatcacgtttgacaacaccccggctgatgtatcctttggggctatcatggggttcattgtcggggacgaaatgagacgcgtggacaagatgaacaagacggagattgaagcagcagtcattgacagcttcgtgggtatgtttggtccacaagctgcgcatcccgaccgtgtgatcgttcagcgttgggactgggaggagtattcgcgcggcggtccggtcgcatatgcgcctcctagtgtgctcactgattatggagcgcatcttagggagtcggtggatggaatttactttgctgggacggaggcgtccttctactggactgggtatatggatggggctgttcggtccggggaacgtgtggcggcggaggtgttgagatcgttgcagtgactggttatacttagtttagttgttaagagggcattaggttatatcataagatagtctctcatatggggtcacttggcggcaaatgcagttgcgcagcactcctgatctggggacggcgtgggtagacggccgagggatattatgcgctttatatcgtcaaattatatacgctaatcagtctgaatactatatcaccggcatcgtgatactattagtgctgagatgatgaaagacaaacatcgtgtgcaacttccgaaacccacatactactactcaatttccgcaaagatatgtatttccagattcattcaatgtttcatcccaaacaaagcgactgctcctacacccggtcactactagtatgctaattccgttttgtcaatttaatgagaaccagaactaatcaacctgtgtatcttatagcaggactgtagcttccaactacatgcgagctatccgcaaacggcagttccgaccaccgagtcacatgactctacttatgagaaaccacccccgtacaagtgcaggaacccgaaagtcacccctatgaactgaacggagtccgcaaggtgctgcttcaatctcattgctccggcgatctgttcaatggggcgccagctggccattgtggtagcccgagcggctccgtgtcaaatcatagcaaaagaatgcccgtcagacccaccgcgaacaaaagtgcagccccaccacatatcagctcgacagctgagctgaaagttgagcagtcatgtgtcttgagattcacccaatatttctctcttttggagcgcttgacaaaacacgcctatcaactacaatagaacggtaatgcgtctcctgaatgccaaaaccctcaaattagaggaattcgtgggccatgacatccctgcctacgctatactgtctcatacctggggagaggatgaagtctcttttcaagacatgcaggctccaactgtcactgagaaaaggggttatgccaaaattgagtattcatgcgaacgggctctgcaagatggcctgagttatgtttgggtggacacctgctgcatagataaaactagcagtgccgagctctctgaagctatcaactcgatgatggcatggtatgcgcaatctaggatttgctatgcccacttagcagatgttcccccaatcaccgatcaagattttgataaagccgccttttctcagagtcgatggttcactcgcggatggactcttcaggagctaatcgcaccatgtgagctggtatttttggctcaggattggtcattcttagtcgcacgggagactgtcgctgagtttataagtgacatcacgggcatcagtcacttattcttagaagcgagaccagataatgaagatctcaaatccaacctgatgtcaacaagcatcgctgaacgaatgagctgggcatcggaacgtgaaacgactcgaacagaggatatggcatattccttgctgggtatactccaagttaacatgccacttctatatggagagggatctgcagcattccggagactacaagaagaaatcatcaaacattcggacgatcagtcattgtttgcgtggggctttgggacacccgaccatgacttgagccataaacgaccatggtctgcagctcagtcgtcgcttgcgaaaatagtgtccttcttcaaagagtattctgctcctccagaagcaactggagcgatggatatggatatttcagacatgtccgggatcctcgcggaatctccagcggcatttagaggttgtggagacatagttccatgcgacgtcaagagaccaactccttctttctcgatgacgaataggggcctgagtatagaattgccagttcttcagctcgcagatggctacttctctctccttcagtgtcaaatgaagaaagacccaaccaagctcatagctctgccaatacggcgcctacgagacaatacgttctgccgatccaagagagggaattacgtagccagtcattcagcctggttaacgtggtcatggactcagctttattttattcccagtaacgattcagctattgcacgttttctggacagtccactctactccattgctatcaagagccttccgcccaatcttcggatagcagaaatactcccagctaggccattcaggcaggccgactcaatggtcatatacaccaagagccctggagtaagtgacttcgatgctaatatctttgtacggtttgaggacttgggtaataataacctatcgttcatattgcttgtcatggtgatcaatccctcctgggcccgccaacccctcccatctgccttaataccttacctgtatcttctgccccctccagacgacagctctccactagtgagagacatacgatcttggatccggcagaaagatagagaatatctagggccagttccatactcggtcaaaattacgacgcaaaccttgtctcagagtggcctctggatgattgatatcataccggaatcgcgggacaagaaagcgatgtacctagagatgcgcaaaatgagatcctgggtaggcatattgcgctgggtcttgagaagggacccacttgtggagaatgtctatggaaagtggctcgattacttgtgtgaaagaggctttcgcctttcccaagtgcttatgctctcacctttgtgtttcacttttccatttgatctcgtactcgaggtttgtattgggtctgtagtaccacacatcatggccaacaaagcaaattttgcagcgattgtctcggcaagctatttactattcaaagatgctcctaccatgcacaaaattcgcagctggttgttcaagaaaatcaattcggaaggtaccagaaacttgcttctactatacattatgtgcaaatgtatcccctcacacatgctcctttctctcgctggggaagagggggcctatcatgaagattgaaaactaagctacgttagggataccatagatcaaataatattctatttaactttcgtaagagggctgcgaagtttgtattcattgatatctatccaccattactaatttgagtgacacctctgccatggacaatataatgaacctaagatggtggggcccaagcaagaaggaataggcgatgagcgaactcgttgagatttaaccacatctaatgcgtgccagcactatagtacaaagattacacctcaccctccgacacctgtctatacaccttcaactcaaccacactacccggctgcctatccaaaagatccctctctgtatcattagaccctctcacgaccccctcatcgttaacccccctcacatccccatcaccagtatcgcctctcctcgcccccctcccaacagcactaacatgaacaccaacacccccctccttcatccacttccaactccaactccgactcctccccacactccaactccacgaccccaccccactcccgccactactcccccccttcctccctccaccacaccccacactcctcacaaaaacattaacccccggcaaacacgaacaccccaccgcaacatccacttccaacatcgccagcacccaacaataccaaacctcccaactagtatcgtaactgacataaaacatgcgatacaaaaaccacaccctaaccccagccacaacagcagccaaataccccaacccaaacaccaccccattcaacaacaccttctgcctcaacctcatctgcaagccccagcaaagcaccgccggcagtgtcgtggccagaatatcctgcagaagacttataaacgtcgcggtgatcaaatgcacaggttcattgtaacatttgtacttgtgcgtggcggtatactcggggtcgacttccatccagtaagctgagaacggacgacaggcgacccagattactatgaagaaggcgagcgtgtaggctgctacgctggcgatgctgaggtagatgatgttgaggaagcgaggggagatggtggtgcggtggcccatgcggcggtagaaaagtagcacggagatcttggtgaagcacgaggcgaggatgtagaagagttcttgcgcgatggcgagtttgcgcgactggaggagttgggggagcgtgttgtcccatacgtggtggttttcgccgtagttgtaggctcctttaagagtattttgttagttgggggttgggttggtgggacaggtggtgtaggtaccgagggggaagctgatgttgagcccgatggctgggatctggggattgttggttagaaggtgttgggttgtgttaggagagggttggcttacgagtgctaatgcgatgaagaagtcatcaagttttccctgtcgctgaatgacgcagcgtgcccagaggcgaagtatgactgccgtgacggcgatggatccgaagatagcaggaagcacaatggacgctgaaccatgggattccggattgatggtgttgcgcgcgggccatgactccatgaccgacagcggtggatgcaggccccctggcatgatgaagggatggttacggagtagaactgacaggatggcagcctgcagtaggactctgcgacaaccaggaacctcatcctttacataccccccgtcgcatccatgatttaagcttctatgaaatcaaaattagctcaacgcgcaaaaatatgcgatccgcaaagcaagactccctataatggattccagcagcaaatgacacgatcgaacttgccaattcaatataaccatgacaccaacgactcgagagaaccaataaggcccggaagcccaaaaatgggacagcccgttgtggggcggcaaccctaaattgaccgtcgatctggggcgtttcagcatgaaacgcccgcacgaactcgagctggtggtcctggcacctgtcaactggattagcctgcaggtgggtatcataatggcatgaaggtagtagatgtatcaacattgcaagtccggcttgtggtctccagtcccggattgattgcacgggccgattctgatttttgatggatcaacaggcaacttcgggattccctcgttatcttgcttcttataggtagccgtccgttgatattattcgtcagatatggttcctggccgttgatcaaatcccgacgtccacggtagataactttaatggctttaccggccctgctttgaacgttgatcgcactttagtttcggccgaaaggacatggccatatccccactagcatgatcccagtttgacgtcttgaatagcaggcatttcgggactttactattgttaactagctatactatggctcaacccatcgataaggtccatgtcatgagagggaaggaagttcataattttgggagggcttatattagttccccaccaccccctcattagggtgtcaaagggccaatctttgaacaatagcctcgatcgactccagtccgaccgggcggcaaaagcgtcaagtgaaactcctatctgaaagtgtgcagtttttcggcttgttgtggcaggtcttgcaggttatgatctcggtatgactagtcagtaggccagacgagtcaaagctgccaagccccctttcaccgagacatcgtcaagaggtactcctttgggcagggcaaaccttgccgcagccattgtgaaatttccggctggaaaaacggtgctttcgggataaagagcacgatggctgcgctagccctgcaggtgtcaggagaaattcccgaccgtgcctgtccggaactgcgtaccatcacaatggcgtgcattcatccccatctgcagctcgttgttccgccaatcacaacagcgtatctatccgttgccgccctatgaatttcaagcagtattcagcttcgatgaagagaatggcatcctgatcctcttaagaatgctcgaaaggaagtggatatgccttcaagtctaagctcctctgtcaatatgcgatgactggctaattcggaggctgctccgtgataaatcagtcacgcagcaacatctgaccccatctcattagaattaatctattcggctattcggtccttttcccgggtatatttcttcgaccctggttctgcagaatcatgttgttcattgcggagcaggtcaagattcgtccgaccacacaatgccttggtccgttccaggtgaggtatagcatcttcgttcaagtcaactaatgcagggccaactgcacgtcacacatgaacgcacctcgtcacccgtaggattgtgcctgaagggcagcttcaatgcttgagcctgctggatatttaagctccatgttctcccacatagattgacaagttgtcagggcaccaactcggtcaacattcactcgtcaccatgcggcgtacattcgcagccctcgtagcgggctacctgctggactcggtccacgctgccgcatcgcaggcatatacctggaagaatgtagtcacagggggtatgacatatcttgcaatgtgagggattgacaagctaattgatcaggcggcggaggcttcacgccgggtatcgtcttcaacccttcagctaaaggtgtcgcgtatgctcgcaccgacatcggcggtgcatatcggttgaactcggacgatacatggaccccgttgatggactgggccaataactccaactggtacgtaagctcctcttacgagatgcctaggctcattgtccaggcacgactggggcattgatgcgatcgcgaccgaccccgtcgataccgatcgggtgtatgttgcagttggcatgtacaccaacgactgggatcccaatgacggctccatcctgcggtcgactgaccagggcgatacctgggaagagacaaagcttcccttcaaggttggagggaatatgcccggtcggggagttggcgaagtaagtcccatgtctttctcttgtcagcatacattgaccactgcagcgtctggctgtggatccaaatgacaacagcatcttgtactttggtgcccggagtggcaatggcttgtggaaaagcacggactacggcgagacatggtccaatgtgactgccttcaagtggaccggcacttatttccaagattccagctcgacctacacgtctgatccggtgggaattgcctgggtcaccttcgactcgacctcagggtccagtggctctccgactccgcgcatctttgtcggtatgtgaaaaattttagatatttcaggacagcccactgaccattacaggtgtggtggacactggagaatccgtctttgtttccgaagatgctggcgaaacttgtaagcttctccacgatcgcaattaaacccatctaaccaacttagggacttgggtatctggagagcccatgtacggcttcctcccccataaaggcatcctgtcgccttctgagcacacactctacatttcctactccaacggcgccggtccatacgatggcaccaatggcaccgtccacaagtacaacatcaccagcggcgtctggaccgacatcagtcccacctccatgacagacacctactatggctatggcggactggcagtcgatctccaagtgcccggaactgtcatggtagcagcactcaactgctggtggcctgatgagctgatctggcgcagcacggattctggggccacctggtcacccatctgggcttggaacggctatcccagcatcaactactactactcttatgacatctccaacgccccatggctacaagacgacacatctacagacgaatttcccgtccgcgtcggctggatggtcgaagccctcgccattgatcccttcgactctgaccactggctttacggcactggcgagaccatctacggcggccatgacctccaaaattgggacagcgaacacaacgtaactatcgaatctcttgccgtaggcatcgaagaaatggctgttctgggtctcatcactcccccaggcgggcctgcccttctctctgcggtcggcgacgatggcggcttctaccacacttccctgaccaccgccccatcacaatactaccacaccccgacttacagttcaacaaacggcatcgactacgccggcaacaagcccgctaacatcgtccgctctggatccagcgattccgaccctactctcgctttatcctccagtttcggcgaatcctggtacgccgactacgctgcttcttcctctactgcgaccggccaagtcgccctctcagccgatgcagacaccatcctcctcatgaacagcgacggtgcctatcgctccgcaaactcggctactcttagcgcagtctcctctctgccctctggagctgtcatcgcctccgacaaagctaacaacacctacttctacggagcctccggctcttccttctatctttcatccgacaccgccgcgaccttcactgtcaccaccaccctcggcagtagcacaaccgccaacgccatccgcgcgcacccctctctcgcaggcgatgtctgggtcagtacagacacaggtctcttccactcaaccaactacggcaaatccttcacccatattgggagcggatgcacagaggggtggagtttcggattcggaaagccctcttcggacggcgactacccggtcctatttggattctttaccgtcgatggtgttaccggtctcttcaaaaccgaagatcagggtgttaattggcagataatttccgacgccgagcacgggttcgggtctgcttcggcaaatgtagtcaatggggatcttcagaactatggcagggtgtttgttgggacaaatgggcgaggaatcttctatggtgatccgagtgggactctgccgagtgcgactgctactgcgtctagtgcttcgtcgacagcggtgaagagttcgacttcggcttcaacatccaaggtaggttcgagcacaactgtttcttcgagtacagctacaactatcactacgagcagtattaagtcgaccactttgacgacgactacaaagtcgagtagttcgactacttcgacgtcatccactgctactgggacggcctcggcatatgggcagtgcggtgggagcgggtttacgggaccgacgcagtgcccgagtgggtggacgtgcacgtatgagaatgagtattattcgcagtgtaagtttattcctggtatattgacggacaggggctgatatatgcaggtctggagggatgagtgagagtagggcggtttgagttgtgttgatgttgggggtatatttgaattcgactgtttgaattgtagtacttgataacaaatatttatcgatactagcccagtatgcagttctattcctaggacgcgttgatatcaagacagtgccatcccttccataccatcatatatatataacagtctatacacacatctactctctgaccaggcaatccctattcaaatcttctttcttcacactcctgatcccccccaaatgcaacgacaactgcacctcccccaataaactcctcagaacatgcctgacgccctcctccccagcaatcgccaacccataaacatacggcctgcccacaagcaccatcttcgcccccaacgccagcgccttgacaacatccgcaccacacctaaccccggaatcaaacaacacctcaatcttctccccaacggcatctacaatccccggcaacaccgtcaatgacccaacccctccatccatctgcctgcccccatgattcgaaaccacaatgccctgcataccacactccaccgctctcctcgcatcccccacactctgcacccccttcaacacaatcgggccctcccaatggcttctcaaaaacgccaaatcctcccatgaatgcgacacccccgggaacacaatcttcgtccactcccccgcagcagtccccttatcctcctcgacctccttcccaaacttatctcggatatatctcctaaacaccggatcactgaaccccatctccaccccgatactatctgccctcaggaacggattatacccattatccatatccgtcggcctccatcccaatatatacgtgtccagcgtcacaaccaacacatcatacccgctcttcttcgcccgctccagcaaactaaccgttatatcattatgttcattcccaggccaatacagctggaaccacctcttcccgtccgccccattcgcttcagctacatcctctgtggaagtcgctgtcgccgtgctcaacgtatacggcacatccagccccgccgcggcgcgcgcaacagcacgctcaccttccgggtggaagatagtttgtacccctacgggcgcgatggcaataggcgaggcgtatttcttcccgaaaagggtggtcgatagatcggggaactcggccgagggaaccaggcgggaaggtatcacggaccagctctggaatgcggaccggttcttgcggtcggtttctcccgtcccggccgacccgtgcacgtagctgaagctgttggcggagaggcgcgcgcgggcgaggttctcccattcgctggcgatgaaggttatagctggtttctggtcgcgtaggccgtgcgtgtagacttcggattggtaggtgtaggggggtgggggtggcattttggttgtgtaggttttggaaggtttgtgtgagagattttaggtgagagtaagggttgtagggggtaattgatgggaatagaggctaagggagtgtaattgggagatttatgtgtcaagggctgctgcatttcaggttttgggggacaggatgaggattgatatcagcgatgacgacatgcatggagcggttggtgtcgggtggggcggatcctcaggcaccgatcatgtgcagcggttcatgctgctggaaatttatactctttcttaccttggtatgatgaaactaccatactgagcgacgcagaaagcagaaacattatacttgtgatggagtgatcgcgtacgggctggggtgagtcgtgactaagggtcccgctgtagtgttcttagaggcatattacccctccgcagcgtctgtctcgacaaccacttatcctcggacaggctaagtaagttatctaacaaccggatggttatcttgcgtaattgttctgttgcttcaaatagattcgtgcttagtacacacgatactaatgaacccttgacgctcagagatgaggtcgctccactatacagcctgacggacagttagacttgtatcttagagatgggtattattgggggtccattaccatgaagtaaagataaggaaattaccctctgctggcaccaatatcagcgccgtaatatagggtcgttgctctcctgactgaatacactcatttctcccctcaatggtaggataccaaccacgattgcttagctgccagcagtcctattagtggagcggtcagtatctgtcagcgctgtcaacgacactaccactatcatcccatgaaaggatcacagctggtgccaaacagacctcttaactccatcaaccagatagtcaagcaagataggctggatggtccgtggcacagtggggcgaggtggatcatccgtgacttggctcagagttttgatgctctagaacgccactggtgatccacccgctaagactttgtctaggccttccaggtcccatttatcgccatgtcccatccttcagccttctagacttttggtaaacaaagccctcaccgccacctcaactctatctttgcttccctctcagctccgactagctggagatatccacatcgccgctgccgtccaggtgccttccacccgtgtccggtccgctgccccgttagggtatggtgccccgacgagagcgtggtggagatggtgccaaaggcaaccaattgagcagtgtgatctcgatagtagactgccagttgtttaatctctatcattcatcttagtgtcttgggtaacagctatggacaggccagacctggtctatggggaacttactttagattgcggatccttgtacggtcgcttgggcatgcttcggtcaagagcgcgttagaagcggccatttctgccatagaatgcgcttgagcagacagtcgcccatgtcaatgacgaaagtaccagggacactcaggtatatcggacaatattatcacgcccagaaagcaaaagcagtagctttccgccaaacatccggggtctgacagttctgcctaaacgcatactccatgatgaagaatgatcaccaaacatgcatgcaatgaatggacataaaagacatgatcatcaatcagactgacagtcaggtcaggggagggagggggtaagtgaaattagcgtttcagccatcacacttataaccagatctagcatcactttgaagcatgaccataccgcagagtacgtcactaccatccaatttcgcttcacttgctatactataaaaactgtcagcctggaaaaccagccctttcagtcgcggcttggtggggcttgtgatacaccacatcaaattattggcaagtcggccttgaaagttgggggcgcccctggcattggaatccgggtgtctgtcgtcatctcattcaaggggaatccgagacatggggatagttggtcaaaacagggttatctaggcaccgttttcttggccccggttaccacacgtttccgtgggcaagtctgccgagaattcctggcgataacagaaacgatatggatggaatttgacacgctagcagatttcatttactgtggtttggttggttggtgagggaaatctctagcttcactatcaccgctactattgatatactacattgacagattttttatttagtgctttctttttttttcttcctgacccgccatccattcaacgtgggccagtcaatgcgagatccataatcacactgtcgaggtgcatagatagtatagttcaaatatcaatagctccatagcattacagtatcattaatcaactagccgggggacgcgatgacccatagggttgtgttggttataatgcttcattataattatagagtaaatcagtggattcaacggacatgtcgctccgcttggctaaaacggttgttgcttgaactgcatacatactatggggatctgccacctctcattctgatctctcccccctctcagcccctccaaagtactgacaaaaaaagccacccttgcgggatcaatgggtgatcatggtgatcatgacgaatcctctgcatacttacctacccctgagtacgcaatgtgcggagattaacatggcggacatcaaaaagcggtcgcgcaacaaaagggtcctgattttaccggatgcggtcagggcggttagggtaatcattcagggccggtgggtttgttgtctcggcccgatagtttcggcattgaagcttctcactatttgtcgatcgacccaacgggaacgacggcttgggtctcgggatggaagggaagggcaaaggaaaagcgagcaagtaagcaagcagtggaaaagggactggtttagcttcccgccgcacacgggttcatcccggaggatgatcactgcagtagtggctagttagagataggggtgctagggattccagacactcccagaccagcgagagcacgcaatcaggtttcgctgactggttgaataatccattccaaatttttagagctgttgtaatttttcctttctaagtcttatccacttcgccgatcgatgagcagctggtcacacaagcttttcaaagcaaatccattcaatcagtgccccttcacagaccacatgtcagccggcgatcgtggagcaggaaagcatttggttatccaccccgtaatccactatcgatagcatcgttgtagcgatccactccgtggcgagcatgtgaacagttactcgactctgctggagtcgtaaccctcgtctggaaaagggaagaggagaaaggatggaggggggggtggtagtgttattcagcagggaggcgaatgagaaatcacaggcgcgatccaccagagacaatgtggtcgcacttccgcactgcagggtgagactggaggaggagccagataagccagtagactattaataaactagcgataatgcgataaacgcaatggcagggtcaactgaactatgctggacgcgcaatcgatgaagaaatgctgcaacaccagaaattagggcacggagcgcgaccgaaaaagaagtgtggacggagagaaagtctatcgatgccacaccatcactgccttcccccagctgcgaaaacccacttttccctcagattctttacagactttttttccttgcgccccgctaatctactatttaaaaaatgacccggctgtccctgtctcgtcggttcctcgattcaggatctctatcaaaatggccatcctagaccttttgcgaggccgcgcgcaggagcaacagccgcaccagtttgacggcgatactccgtccaaatttcctcaattcactatcttttctcgtccgggctcctcactaggtgatgacagtagcacaccttcatcgggtattgccaccccaattgaagagaagcagctcacgaagctgggaccatgtcccgaaatcggtcgtctggcttcgtggaaaggcgccctcatcctgctcgtcacctcgggctcccagttcctcgacaatgtcttcatgaccagtgccaatgtcgctttgtcatctatccaagagaactttgacgtgtcggacaccaatctccaatggatgatctccgcatacacccttacgtttggtgggttcttgctccttgcgggtgttctgtccgaccggtacgtaccatgtccccttgagacaatgaccgtcatcatactaactatagactttcttatccaggtatggtcgcaagttgatcctctgtctgggcctgacctggctctccatctggactctggccattggcttcggccagtcattcatccaactcacagtcttccgcggtctgcagggcatgggagctgcgctcacggtgccctcagcgatcggaatcatcagctcctacttcagtggacttgatcggacccgcgcactgtccatctacgcctcctccggaactgtggggttctgcgtgggtcttatttttggtggcttccttacttcctctctgggatggcgatacatcttctacttcatcgtcatcatcaccggctcgctaggcatcctgggtgccattgtccttcccaaggacaaccttggtggcaaggaaaagcccaagatggactatgtcggcgccatgctctccactgcgggtctcattctcctccaattcgtgctgtccagtggtggctcgtatggctggggtacacccttcatcattgtcctgctggtgctagccgtcgccctgctggtgtcttttaccctctgggagaaattcatctcctacccacttatgcctctgggcttgtggaagctccctaactttgctggtctgtggatcgcaggattcagtgagttcctccatccccaagcttcccacatgcagagtactaacctacccatctagcctgctacggcagctaccagaacgtcatctactacatcgtcctaatggcacaagaagtggacaagctgtccgccggcgacaccgcactccgcttccttcccatgggagtgatcggctttatcgcctccatgggcactggcaaggcccttgaatacatcaacgggaaatacaccctgctggcagggttgatcctcactgttcttgcaccagtcccgagcgctatcacatccagcccggaaacaagtttgtacgtgacccactcgttatcccctggatgaaatgaatactaatgatttacatctagctgggtcaatgtcctccccacctccctgatcagcatcactgccgtgtctctcatcttcgttaccaccagcactgccatcctcactaccgtcccggtgcatgtgaagagtctatgcggtggaatggtaagctttaccttcctcctatatatcacattggaatcccgaaactaatgagggaaatagctcaacacagccttccaaatcggctccggcgttgctctcgccatctccgcggccgtcgctgaagaagtagatatcaaaaaaggacatgatctcgcgcatcagtaccgcacaggactgtggtgttctgctggcctagcgggtctaggcctgattattgcattctttagtgtgagcaggagggggattggtccaggtgatagagatgatactgtttgcgcgatataaatagactttttcttttctttctattccttttacttctgtggttcgattttttttctattgatgattcccttcttactggatttgatttaagatctgttgtgtttggtgttggcatgagtatctcctgatccattagatgaattaggaaagtatctcaactggggttgtagctcagtggtagagcgctcgctttgcatgcgagaggtcaagggttcgatccccttcagctccattttttgtttttttggccccctctcttctcagttatccatactatctacccatcacgactaagtaacttcccagagtagaatttttatcctttttttttttattgatgtgagatatttccattactgatgaaaagtaaataaaggaataaagttccaccagaacaaaaatcatgcttctggatcgcttcgcttatagactagatttgcaatgaaaaactttaatcggggcgggtccggcagacgggagggaggggaaccactatctattatccactgtctatccagtaaccagtgatagccattttcagggactcgtggatgggattggaccatgaatgggcgggttggattcttggttttgtttattagggggattggagtggcaaacatcgtggaagtcggaatgggttagctggtttctgttatttcaaattcggttgtactagtgttgttgaaatatatttctgctacgtagtaggatgtaggctagcgaacatggatttcgctcacgaagtgtactactgaaaggttactgtctgaactgaagtatgatgtactcgacattcagaatgctgatcaaaggtatcatcttcacttcgcactcccccacaacttaacatcccccatcatccctacaaacccctccccgatcctctgcactggtgcctcgatcgcaatgggcgcccacactagcgactccccattcacccctagtctcgctagaaactccatcttttcgccaccatcaacggaaagaaaagttttattaccctttccgattaaactaacatccgaccatttaccgaccggaagactgtaattcaatgtgtatggattcccgccgctcaccagggtaatattactaattgacccgttgccgttgaggagtgtcgagtctctccccgagaataaaggtgacgggtgagttgtggaaggatatacagaaaaagagagggtatagtctctccctttgctctggatgggtgtagtgagggtgcatgttcctgtgaacctgattgttgagttagaagtatcgatgggacaggtgtgattgaatgtggcgtggtagttattccctgataagtctggaactgtggttccagtggcattggcgaagttgtagtgcagaatcaaatcggttttgcttgggacatggcgatccaagttctgccctgggatcacagcatgaagagcatcgaacacatcatcatattcttcttccaggatatcaccgccccattgcttgtccgctagtgcggggagaacatcacgccaggagtaatacgcctcgaggtaggtcgttgcgttgggcccgtagtcgttccagagggcggcgatgtggccgagtacgtaggggttatttcttggagggttgtcggttgcgttgctggtagagaagatgttgggggcgtagggaccgttgtttgctggatcaccgtggaagactcgcgtcttgttgaggtactgtgggtagcttccggaccatttcccgacaatgtagaaggcgtcgtcggagttgaggaccgagtagttattcttgatgtagtcgaagtaggggttgtcttcgaagtattcccagtgctggatggtgacggctttggagacattggcgccctctgatggggtgaaggtgccccagatgcgggtgtctttgtcggattgctcggcgatgtaggtgtgcatgtcgttgacgaagtcggtgtagtcggctacgtaggaggaggaatattcgtctgcgccgaggtggacggttttgctgtggaaccaggggaggaaggttttccagatggatttcatggtcgggatggtgtctggatggctgatgttgagcatgctgagatcagtgaggccgagttcaggtcgccattgcacgatggcgagggcatgcccgggggcttctatctcagggatgatagtgacaccgcgacgggcgcattggcgctggatgtgatcgaattggctgcgcgtgtaggattcgttggctcgtttgttgagcccagatacggcgggatcgtcggaccagggccggaatgctgcgtagaggtccatggattcctgggtggagtagaggtcgacgttgttgtagagattgtcgctgaggtggaggtggaagacgttctgcttgaagaacgacaggtacgagcacatttcgatcaaaaagtcgggtgggtagtagtgacgtccggcatcgagcttatcggttagatgttggttgtatagtggtaatgggagggcttaccatgacaccgcgtgtttcccatcctggagcatcgattgcagagccctgaggaaggtcgtgtttgctgactacagcggcctggattagtgagcgcgttccccaccagacgcctaggggactcgctccagagatggtgattcctttgttgtcgatgtgcaaggcatatgcctccgctgtgaagcgtcctgcaacatcgcggaagcccgtgttattggagagggtcaggaagattgtattgtcgctggaggtgctactggagacgagtgggagattgattccaagcgaagatcgaaggtcctcttggaacgtcgcagcaaactctctcaatgttggcgggattaatgtttgaccttgagtatccacagtactggcgtggcgagtatccacgacaatcttggtgagctgggacagtgcataggtgccattattatcatcgaatggaatagtggggaccgtcaccagacgggcgaaccctgtgattgtaagaaactacatgagttatgatagatcaaggcgcataccgcagatggtgaagtcaagaacaagactaagtgtgcccagtgccctccaccgcatggtgataacttaatgtgttttggagtatttggaacgggcgtgcgccgctgaataaatagtaccctggcaggtccgttatagcgcatgtaacctggaaatactggagaagacttgcagaatgatagcaaggttgcagctcggctagcagggttatattgaccgtttcatgcaaactggaagtagcgtcctcaagagatccttgattggttatgattgtgaagttgagggctaagcgggaaccccgcacggagttgatatgcgcttcacagagataacctatgaggtatcgggttactatcggattgccccgacagttgactgcagatcatgtactagagcatactagtagtgtcaccttcccctcttcatgtaacgtaccactgtgaagaagatattgatagatcgaggttcttcagtgggtggatgtaacatataggccagggaaggtctgtgtcgaaagaaccgataagctaaagcagcgccggatacgatgtagaccctgataaaggtatacgtcattctacaaggcgcatgtctcaatagtgtgagtagctttatctacgtggatgtactgataggaggtgggatgagagatagagggtaggaaacccacaattaagtcaataattttccggcaacagctgaaaaagcccaaaatgtatatccggacgcaatatcctgttgcgttagccagcaacactcatataagcttcacatgttagtatcaatataccaaagccaacgacaccatacccacatcccagtcatgatgttcagacacagtatatccatcggatttacatcgagcctatcattctactggaacaaagtctcaaaatcctccttttcagcttcaatttcacgctccgagtccgcatccccatcactttcctgcaccttaaccttcgcagcaggagaaaaacgatgtttcggactcttcgccaccggactctttgtcgcatgatgctgatggggatgctgctcactttccttcacctcctcctcttccgaggtttcattctcctcagctttgacggccttcctgatagcctttacttgatccaaccctctcttcagtcgatccagcatttctgtgaggttaattagctgcaggtccagggcatcgcggacctcgtcaaggtgatccaacaatgcgccagtttggaaggatatgaagtagtggatgctcggagccagtccttcctgtatgtctttcaagtcatttgcgaggtcgtcgaggtcctcggggctgaagtctcttgatggggaggacatgttgttgaggctgatgctaaggggtgagtggtgaacgcgatgtattgaatggtgagtggtgagtgggagagctcgagttgatcggtccaagttacatagaataggaatgggacagaagattagaaggatataacagccatatttaagttatcaaggtgaaaatcgagattgtagtcctaaattcatcaacatctctatcccccggaacattcctcttaatatcaaaacaccatccccaaacccccaaatccggaaattcccttccctaccagacccccaacatccaaatccacctccaaacaaaaaccaatactacacatcatcacactcccctccatccaacccacaagaaagtaaactctccgcctcgctcccaccactctccaccaaactctccggatactccacccggcaacaagcacacgcgcacgcacacccagacgcacattcacactcactgccatcaagactcggatcaatttccacctccgtctcggaattgctctcctcagtttccgtctcggactcggtgtctccctcgctgctatccttctttccgtttcccttgctctgaatgtacgcaggttcctgtttcttttcgtgcacaattgcaattcccctcatagaacattcggcttccgcatcaatagcatcgttaatgacttcgtgccatatatccctgcatttgtctttcagggtccgggagcacccctgctcggtcattttcgacatgtagattttgcggacttcgccgagtgaggaggctgagatggagggtttgcgggtgagattgttggacatggtgcttgcttcggtgagggttttattggcggtatagcttgggggtgcggggatgaggaggatggggtgggatgaagagatgggtggaggtggtagggagaggggtggagttggttatctttgttttgttgaatgtcgttatgtttaaagaaggagagggaggatgaaagtagaggtagacgggcaaagaagcgttagagtacgaaaaactgacgctgagacgagggatacggaacgtcaatgaggcgtcagtttgagttctctgtattggggattgtgttgctacctagcggggggcatgggatacccgtgataatggcccggcgatggtgaatgggctaatattagtcgttatagcgggtcaccttacaagagtgtgcacgctcagggcaaacatgaaagattgaactgcgtgaacggatgcatagtattcaaatctgatatcacaacctgattcaataatgggaagcaccgcctctccaaaaataaactgtctatagcatacatctgtgcgcgatgggctggaatcttgcccgaatccgatcgccgtaggacaaagtagaaagaagggaaagggaaatgggaacctccgctgtctcgttgtctggatcgtgaacggctgttggcgtggactcgattgcaagagcgcataggcttgtaccgtgtcgggatggtcgaagtcaagaatatcatccacatcggatgtctcgtgctatatcgacgtccctagacgaaaaaggaacatgaaactgccgggcatattttctggcgttggggcggggcgcgtgcggcactatccgcgggagtcttggcgatcgattggtcgaaccattgtcaaaaggtgcatgggcattgggagatctccgaagtgtcgcgttgggtcgtatccatcatgccactcaaggctttaacggggccacaataaacgcaagcaaacattctcaacagcaagcacctggtaaaatcaaaacttgcaagaattgcaagaacttttggaacagtatatacagaacaacaagcaagtaaacacgtctcctacacaaggcgaaacctcatgtgaagagaaaccttcctacatctgggccactaaacatttttctggttgctggggcatcgatgcgatcagtccattgtcgcaagggtaattcggtacattcacgggcttcgggttgtcgcttcggatcgtcgctacagggctttgttgaacggaggtcgctagggatggcatccaaatgggggatcagtattcacgtagcgctggggatatctgataatcgctgggaaggccggttgtcgcaagggatccaatgggttgctgaagggcttggtatgggaatgttatgtcgttgggtatataacagggcgctgggtataaggattgctgcggggctcgcttggctcggcatacgggttgtcgctcaagggatcgattcgtacacgggcttgttgcaggggttcgctcgggtatcatgtcgcgggggtaaatgaagtaatgggggtgtgtcggagagcgcctcgggcaaacataatggccgttcatcagttctcttgtccgtccttttccgatttggcgtcgccgggtaggttgctttcggaggctgaatctgctacaactgcttcggtaatggggccatggtagaagcgcttgccgctgatgaaccagtaaaccagcgcaaacagcaagacaaacaccaggaacacacaggcatagttcatctgagggagggtgatttggtcagcccaaagagagcacgggtatgcaatcaaatccacttacgttgtcaggggtcacgggacggtccgtgggcagaacgaaaataatgctgacgaatagtgtccaaagacaggcccaggcatttacgaccgtgctaaagatgcccatgtgccaaggtccgggtttgaattggccaaacagcaatttgcacagaacggggatgcaataactccagtcaagagcgatggagcagagggtgaaaacggcatcaactgccgtgtaggatcccagagcgataagattgatcgcaatgcagaaaaacacggagatccagaccgcatagaggggagtcccggtgatgggagataccttgacccacacgttggaaaagggaagcatgcggtcacgtgaaaatgcaaacacagtccggccaagcgactgcatggctgtgaaggtgacaaacttgataatgagcagagcagaaatggtgaagaagatggcaccgccctttccaaggctgttatagaagatctgtgcgactggctgctccatcttggagttgagaatggcgttcgggtcacccatgcagaagcacagaacgatattgaacaggaagccagccagataagtgaacaacatagccatcgaaattgcccaaggcgccttgatctcagggttgctgatctcctcggtgatatgggccgtggcatcatagtccgtcatggtccagctgacagacaggaagccaaacagccaactgaaaccgatcggcttccaaccagtggtcgattcgacatgggtgaagacgtacgaggcatcgtgcttatcgtccgtcatgacaagaagagcaatcgcacaagcgacgaggatgcagacgtgaaagatgacatagaacttggtcatcttttccatccagtatgtagacagagagttaaccagaccggtgatgacagtcaaaccagccatcacaccaacggtagtggtggttttgatttcgtaattgtccattcccttgcacatcgagacaatggccaggagcatttgcgcaccaccatactcggatgaggcaacaccacaaatttggccaaggaagtttaaccaaccagtcaccctaaagagtatcaacaatcattctctgagacaaaataattgtcttggaacatcaaggtttccataccaactgatcgatgggacccaatcatgtggagcaagtctagagatcgtgaaatacctgtcgcttagggtcagcggctgtcgttccgagcgaacggtgacacttacaggcctccagaggtcggataggcggatacaagctcagcaaccgaaagctgcagcgggtttgatcagcctctgtacccacgccgcatagcgcattgttatatcggattacctaccgcgatacacatgcacccggctcccgaaacaagccaacaccataccaccgcgctgcttcctcccgcctcgagaggataggacatggtggtcatgatggttgcaaacaaaccactgatactgactgcgaacgaaaaggtggagaggtaaccgaactctcgcttgaagacgggcttgtaaccaaactctgcggcgagttgggtgtcggcctgattcgtaccggcgatgcggaccttctcgagttcggcaccgtcagtctccatggctggattcgcgggtgctttgatgtctgccatgattgcttgtcgattatacagcgtggttgaggcagaatatccagggcaagcagggttaggaagcgttaactgcagaatacaaagagaagaaaaaaaacttttgagagaaactgaaaagattttaaaagttcatgcaaggcgtcagcgatagtgaaatcggtctaagatatatccggtatagtcgcatatcggcaagaccaagttgcgcgtcggtgggacgaattataacgaagctcaatggtcaagagacgcagagacctggtaagcttcgccggcgggtcgtatagaacgccgctacggagtaccgggggctgtattgctgtgtcgggcgtgcccctctatctccctattccacggacatgaggcacaggaacaagggcaagtggattctagtggatcaccatgacatcccgtccgcgtttcctggctgtttcgcgggacagctttcctacacccagtttagcgggtgcaccggacctccattccacggcctccccaatggccagcccgcccccgccggcgttcatttcccagaggctctcctcgtctatcgctgcccctgattggtgttggccgttagccacgacgccacgtgggacccccgataccgctgatgtcattgcacgggcccggggtcctctggtaactcggctaacatgcctagtgtggtgataatagaaactattggaaaggcagagtaaattgcatgtgagaggtgaatgagtcgtatgaatcctggttgtgattttacgtgattctctcaggtaaacctcgctgagaataggggagagacagaggcagtcttagcgcagcgaactaattaatcggaccgaatgtcttggtgggacaactgctggcttacctaactggcttatcttgtagctgggaaatgccattggcggattgtccgataggagtgcgtcttggctgcagtgacggaaaggcttgtcttactggccagataaggtgtcggggccgtatctttccgatgctgacaatgaccgacacagtaaggatgagcatcttcggagcaactcgccccttgtcacgtgcagacgtaccggaacaggcaaggttttccaggatggctgaccagccggccgtgtgtatatagtcctgccatgttatacccttacactatcccaacaatagaatggtcgatattgtctaaggtttcatcgacatagtagatatgtggaaactctcactatatcgggaagcattagccatgatccatgatagaacagcagtgcttatctgtagtggcgcggtccgcgaccgtgtctccgaccttcaattgattaaacccgaacgctagtctgcagacccattggttgataccagcaatgtgcaggtcctcgtatgatcagcgacccggctaggtcggtttgtctgcccgtgttccgtctgaagcgcctcaacatattgcgatatactccacatgggacggtccgtagtccctggccaggagcggggacgggaaagcttgcggtacgggactttggtcggagatctcgcagatagtacgaaaatcgattgagagatatggctatcagatggagatagcgtgagacgtgataaaacgatgacaaacgtcttgacagttgatgacttggtaatggtgagttgatggcaagattaagagcggaatgagatgaggtgaaactagcaggaactcggtcacctgagacggcgtgactgctaactgctacaaaccgttcaaactctccgcggtattcggactcataactactagtatacgttgaaagatcttgtccagcaggattattccgggagatcagcgctttattgatgctattatcaatgattcccgatcatatgaaaataaccatagaaccccgaatcgtgtctagagcaaccgcagcctcttcgcaagcaagcaacaaaccataacaaacgcgcacatacaccctacgataccaaaaaaccatcccagattatccacattctgtccaggcacctcgacgttcataccaaacaacccagtaaccatgtgcaagggtacgaagattgtcgccaggatagtcaccttactcaagactgcattcacgtcataactcaaccggatattgttgacgctcaactgggccaggaagttcgactgtgaccggcccacaatttcatcgaaatgggacaaactggtcaatgtggtcacgagatgatcttgtacgtcgcccagatacaccaagagatcgccgtccgggaacattgggtttctgtcttttgcctgacaacgcttgacgaagccacttaagacgtcgtacttgccggtcaggcagcggatgagctgagtgatactcttgcggaggctatcaagttgaggaatgagcgctttgacgtcgtcgacgcgggcgatgaacacttgatcttcgatcgcatcggcttcacgttctgctgcgcgcatgtacggttcgaaatcatcgataatttcgtcactggattttggttttagttggagtctgggaggatcaggacaaggaatagcgggcgtacataagagcgtagcagatccaatcactcgacaccaaatgtgtgtcctgagtccgacggatccggtcccggactcgggcgatgtggtgacatccactgggagaaaaggtcaccgtggcgttcttgaacaccagtatatagaaacccgcggagccggggatggacgatgatggcttgaggcttcgagaactcttaaagtcgtctgttggaagcagggtttgaaaagatattaggtagtagttgcgaaacgcctcaatcttctcgcgaggttcccgggtcgcgatgtcctctgccgtcaggggatggatcgataatgcctggcagacagtgctgacctcctcctcagtggcgtcgcagatgtcaacccaccacgtatcccgctctgaccctttcgtatcagcagacagggtggactgctcgatgagcaaaccctcccaggtggacgaggtgacgacctgctgggtccgacaggaaaagtgggaaaaccggtggagtcccttggcgtccatcttgtgaatccagactgagcagccacctcagggagcgaaagagcgacagtaaaaattattcacacacaagcgtatctaaccacagtgaaaacgcacaaagccagagaagggcaggaaaggcgtacactcagcccattctatgatataaacgcttgttgactgatcgaacaagcaaaacgtcatagatcgtcgacacggttttcatccgtaaacggctgggccaaggtagacagagagcgagtgactttggatttaaagagaaagcagtaagaaaaaggacatccacgttgcgcaaggccaggggtcaactgatatttcacaaaagtgcagcggcagccttgtagggctgagggagcgggcccctttcccctcccgaggagccaatagtggagacccccagcaaagtcttccggctgccctgcccagtcactcttcgcatctggcgcgaattgacccagccagctcttctggttggccagctcccgaggaccccgtggacaactttcggaaagtcggaaggcaggatttggtaggattatcgggttcaggcagcatttttaccacaggctttcctgaatgggattagaggattctatctaaagatccaatgtctttggcgcggtgcaacgtttacccccgctgctgtggctcggacgagacccgttgggaatgacgatagcaggctgccaccttggcaatggcgcaagcaaatgggatataaccttgacataagagccttggcttgtttcccactttcaaggatcatgtctgaatcgatttgctcatccttgaagtttcaaaacctttcctcaatagtaccacaaggactctttgttcgttgagagaaaaaaacgcccatcactaaacgagatgtcttccacctccactctcatgtaagctgcagcacaatggtcaactaaattcaactagcgtgctgaccagttttaaacagatccgccataggggtcgtgtggagatatgcctggtttctggcgtttcgtccattggccatcctcgtgctgacgggtgcaaccatatcccttattcgatctggtgtctcactttgcaaagatattccctccatggcctatgagatgtaggtatctgcttgacttgagctttacgatttccgctaattctgcttatcccagattcatgtggttcacctcctaagggtttggggagaaggatgtgttaatacctgcattacgtactggagcgagggtatcttggcgttgatttgtcataaatgcattgttcattggttaaagcgattcaatcctgcattgcatatgtacattgtataatttttctgccagcatctgctgttcagactatgtgtcacatttattggagttcagtgtcaattcaagctgtgattgtttatcagtacataaaacctgtcaaattgggccttgaaatcttccataataaataatttgaaaatctcacatgttctgctttagcaaggatttaaacatatttgtcaggtagattgaaagacaccaatgattcggatagtgactgccgggtatggagaggagggaatggagagagcgaccggatttgaccaaatcttgagaaggtcacatgacgcaagtctatctccaaagatggatattccgaactcacagaaaatactagactgttccctgtagtagaaaatatggaagattaagagacccgcatgaccacgtctttatggcacattgcactatttaccaggaatgtatatgacgattcgtctatagacagaatctcagtctaggatagactttcgatacatcaagcctcatcacattagcattgtacacaatgattacttactgccatgcaaaccggtcgctggcagcgaaaactggaattgggagaagcacccaaatccatccaatcagatgcgatgactttcgaatcaaaagcacgcacaattccgaccaatcagtaatccccggaattgaatccgcttcgcatcttatagcctgaggcatcaacacaacctttcacagccccccaccaccgtccaatccgagctgatatcaccaataccactgaccaccatcaattcaacaacaacacaatggatagcctcaacttccccacccaagaccgcgccttcttggaaccccatctcccacccaaatatggcaacccatcatcatcatcatctctccccttcaccaccctcaccttcgccacatccctcgactcacaattagctctttccccgggcacccggaccgtgctgtccggcccgcaatccaaagccatgacgcactatctacgctcacgccatgacgccattctcatcggcgtaggcactgccgtggctgacaacccgggcctgaactgtcgattggcaggggtaggcggatacggctccgaaggtttagcgggccagccccgaccaattatcatcgacccctcagccagatgggagtttacggcgcactcgaaaatcttcgagctggcgaggaatgggcggggcagggctccgttcatcattacggctgcggagacggtgccttctgcacctcagagggaggttttggagagtcatggggggaagtttattgcgttgccggtgggggtcggttcggatggtgcgcatcggatcgattggactgcgttgttggagtgtcttgtgcgtgaggggttacggagcgtgatgattgaggggggcgggtctattattaactcgttgcttgagccggggtgtcagacgctggtggattcagtgattgttacgattgctccaacttggctggggcagggaggtgtggtggtttcgccaaggaggagggttgaagggggtatggttgttccagcttcgagattgaccggggtcaaatggtatccgtttggggaggatgtggtgctttgtgggaggatcaaggggtctgattaggggggtctccgttcgccaaaacgcatattcattcatgcagtatagaaaagatggttcctgagtcatgatgcttccctatgaatcagatttccctgttgcagcatattcacggtatccagtatgttgtccatgcagttgaagagataccgccgaatacgcagtgcttcatttccgtagatctgttcctctagcttgagacatagcctcttgtaagcatccttattcactgggaggcctcgtacctcgaaaaagttgttgacaatcctaaagtaccaaaaggtggtgctcacgcgaacacctaatgctcgctcagctctggccacggtgcgagaagggcgataatcaagaattatgtagaggacctccatgggcaacttgcacactatgagaggtatctgctcttcctttttccggcgagataggtagagtctctttaaccaattgcgtcttttaccctgcattgcgccgtaaactgcactcgaaacacgctttgtgcggacaaggatctagtgcattcagtctgttatcaaggtgtacaagagcacacatactgcctttacacaagctgagtcttaccttccgcaaacatcttatgttcccaacgtttgcatggactaccaaccacacggcgtctatatcgaagggcagcgatgacagcaggcagatcagtctccgcgacgcgacccagcgcatggtgcgacagcagttcccagcagcgggcatgaacggtacaacctacccaatccgctggagacgttgccttcatacccatacaatacactttgggatcaacgtagactcttttccccttgaccatgataggaacacacaacctccaagtctcttgttctaataagtatgtaccagaaactctatatgtggacttcgcttccctatggataactgacatttattatcagcttcaaacttcgaaaccaccttgagtcatgtaacactcactcatccgttgccacatccaccatcggttcggcacatattcaatatgccgtagccgttcttcttctatgccttcggcctgagcaacggctttgtaatttggatgacgagggtaacttttgtccccccgtaccctatacgagacagggcgcatgccccaggagtcattgtactggaagccacatatgtagcagcagcaatagttatatccgcagaacggattcctggctcgagcatagtgctcttcccagtcatccgctaggaactcctccggaatagagcttatattgctcaccttgttccccatggtaattcttcgtggttgaggaaagaagagatggaatcaaccagcgtttatatatgtacggtatgctgcccctgacggcaatgatgacaaaaaggcgggaatttatttccgggcaaactaaatgagtaggcctccatctttcccttacactgtgacttgttggatttgggagcatttcgctggctacactggggagagagcggctccatgaacctagttcgtcggcttcagggcgaaccagtcgttagtcagattgtagttgagtaatgtgaccgccatcgtgactccatttcattactaaaccccgcttattaggtacttcttccacggatatctgaccgggactatggttcgtcatgtctttagctggatgcccagttctatcgtctgcgcaatccataccactggcccctcccttgcaacacaaaaagagttgcaagggacaagatgtatcttctaccatcagtcatgatcttttgcttcgttttcagtaattaataaaataacattatgcggcacatgttcttacaagaaagtatatttgccggccaatcctaaaaaaaagttgtatataaccacgaaaaacagcttgtatgtgctcttcgttcttgctggatgacaatccattcccgcttctaggcctggtgtagcttacctatgtggattcttcctctcaaaatcttgcttctttcgaagccttccgaactgcgcttttcagtgaagctattctttccggggagtctggcgaaagcaagcacagattctcactatgccagcatgtgatgtttaagtgacttcacagaacagtgagttatttctaggccctcgggatatgccagcaaatgccgaaatagcacaggtttgccaaacattttatcattgtgctggcttgtactagttcaactattggatctcataaacataaacataatattcccaaagacattcatcacacaaaatagtattatagatcggcatatcccaagtcctcagtaatattacgacaaagatttgatcgtggagcctttataaggtgctctgattctatggataattataagcccctttatatatcgtcacagacccatatacacaacgacatccaataggcccgcattcaattgactaccgcgatgcctgattttcaggatgtcgaagatgtctggcatgagatatgcgagtatctcgagaccagagacctcttcaatatttgcttgacatcccgcactatcaatcatgttggcactcgctatctctatcgaaagatcaagtgggattggaagggaaagaagtctcgataccgaattatgtcgctgtggacagcccttgtccaagataaggacaaacgcagccgcctgtgtggctctgtccgggaggtgcatttactggggagcactcctcccaaggatactcggatcgttgaatgccccgagatccaagagggtaaccctagctcactctctatcatcagaagtgataaggtgcccttttaccaggagatcgactatctcagagatgttgtgagtagcgtcgttgaaagcccgaagggccgtttagcatggctcgagtccattgcagcgcgaaacgtctatgctttggtggccctcctcctacctttactccataacctgaggtctctcaagctcgattacaccttcgctgtcaatggcggatatcctggacaaatgattgaatctcttacctctggtaaagagatacattccgcagagttgcagaataactttgagcacctcgaagtcttcgattatggaacaaatgcactgcacaacaatctgccgcattcgtgcgataatacacatattcggatgcgttattcatcacaattgatcccgatattccagttacagcaggtcaagcaccttaaggtctggctacgtagccggcacggccttcttctcgcgcggattccagatgttcagatgaaccactgggcactcgaaacccttgttttagaccatatttcagtaatggactgcgcgctattcaaggtcttcaaaagaacgaacaagcttcgcagccttcaccttggtatgaacgccgaagagaaagatttctggtatgttggtataccctctgcagatgatagcaaatacatctggaacggactgagagcattgtgtggttgtctggagcacctgtcgatcagtttctctatcacaccaagaagtcgggagtatcgcattgacaccataatgtggggccctcttttcagacatatgacggctggattctttcaggattttactcggctcaagacacttgaattgccgatccagatgcttaatggattcagggatataatggaggttggtatacagcaagatttgccagtaacactggaaaagcttggcctgcggtgggacttccgtgacgtagaaagctacgatgtgccgacagctacagtgcgcattctctgggtattgacggaattccttcggttgccggaccgtcatcaacgggtgcctctattgcaggaggtgattatccgtctatttatcggcgaggatgggcttagtaggacagtggtagattgtgacgacctgattgagcaattcaacatgtatgtgagagttcgcgctgaccatatgcgactaggactgtggacgaacggaccttgatgctcaacgacgtatcactggacatacgcgggattatgccaaaccatcgacgacaatcctacccaagctcaactcattattctctcttgttaccagaccgccagacataaggaggaaaagtatgcttcatttatatacttgaattgctacacgaaagtaacatgcaaaatgacatagcctcagccctacgtaagatatacctatcatgctgtgatacagatgcagcattatcatgatctaaaaaacatgaactgtcaatcaaactactgctttatcaattcagaatgaagctttggcacgacagcactattaagtaaatctttgtgtcgcattacaaagtccccagtaaacgccgtctcagtagtggttctatcagttagaatcatcgcatcatctgccgtccgatcatcagcttattgccgcagacccaatatatattttcaaaatctttttcctaacacctcggctatttactactactaaccaaacccccatcaaacaatggaataaactcagagaccctccaaataccgatattgcacgtgccttcacccgcagcctcgtatctcactcagccagtcagcatagccacatcatgcattccaaaccatgcaagcacgagatgaggcggagtaatccgtatgactttgcccatcacgcccatcagcagccttgtgtaacttgaaaaaggctgaggctcaacctggtatatataatatgatgaaccccctctctgctccatctcccatgctacaatacaatctttatccttttatacactaagaatctgaaaaccatatataaaattcaagatagacaaggcattttccgacccaacaaactccacattccacatcaccccacattgatataccgaacccataacataaataccaccaactatctcacccaaaatccctgcaaaatccaagacaatgtgcttcacctcatattctgacgaacccgtttccccggcccgtcctcgacccacatccaccaacggtactacttctcgacctggtcagggaacagcctggcccaacccttcaagaacaagaaggagacgaggccgacgatactatggaggaggctatgttcctggcgcagcttgtggcggagggggaggtggggcaggctgtggtggtggtggaggaggaggaggaggaggaggaggctgctgaggaggaagagatgatggtggagggggaagctgaagatgagttttgatgatgttgttcattttggttgggttgttgttcttctggtccggtgggtttgggggaggttttaaggatgggggtgggaaggatagatgtttgactagattgtttacagacgcatagggcttaattgatttgctgatttgctgatttgcctctggtatccggataagatacaatatacgaagtgtgaaatttggtctatattgccctgatcggactttgaatgaactatcgcaaaaggaatagatggattagtgatgagttttccatcgagtaggcgtcgacagacctaaatccgcagagacgatggatctctgtgtatcacatattctgatcagatgtagcctggcatgattggagcgtaaatattcgatgtcattgagacagatgagcaaaaagccgtctcggaattcggaaggagaacactctgagccccatcagcagccataacacacagacaaaaccccactcgctagcaaaatctcttctcgaatacttcgatcattaaacatacaataaatataataacttattccttaccgaaagccatcaataatattacccagcggcatgctcggaataggtgcaaaatccgacaaacaccgccgccatactcggaacatccgtcaacaccgaattcaaccagtgtcacgcttatccagcacaccattacgcacgaggagcaatctacaaggaccctgaaaatattaagtgatccctgccgtgtttagaggatcaagttgatagcttgcaattggactaaacatgcagatcagacgcccttcctctgacataccggaacagcctcggaatctattccggcgccaaccccaccggcctcggcttatcgataaaagaaatccagatcctcattcctgcctcctccgaactctccgctgaatttcactttatttttcctcatccacctccccaatccccctctaaaatcacctcagggacattaatttctttccaatggaccgcgaacagttccgggaggccgcccactcggccattgacgacagttagtccctgttccaattcctgcaccccgcacttctccaaaccccgcccgcattgccacacaaacacactcacacagacacacaactaaccaaccccccaaaaaacagtaattaactacttcgatgacctcccaaaccagcgcgttgtccccaccatcgaaccaggctaccttcgtcccctaatcccgacctcaccccccgagaatcccgaaccatggagcgccattcaatccgacatcgaaaccaagatcaagccgggcatcacccactggcaatcccccaacttcatggccttcttccccgcaggtgtcacctaccccagtattctgggcgaaatgtacagcgcagcattcacagcgcctgcgttcaactggctctgctccccggcgtgcacggaactcgagaccatcgtgatggattggctcgctcaggcccttgcattgccggaatgtttcctcagcacgtcggagaaccgcggagggggcgtaattcaggttacggcaagtgatacggtcgcgacgatgatgattgctgcaagggagagacgggtgactgagatggtggtgagtgaggggttcaagcctgatacagtggagtatgaggatcggatgatggagttgaggagtcggttggtggctttggcgagtaaccaggcgcatagcagtacggcgaagggggcgttgttggcgggaacgaggttcaggagtgttgaggcgaggttggaagataacttggagatgaccggggagaggttgagaactgttttggaggggttggatcgtgataagctgacgccttattttattaccttgggattggggacgacgaattcgtgtgccgttgatcggttcagggagatcaaggctgtgttggccgagaaggaacattggaagaggatttgggtccatattgatgctgcttatgcgggtgcggcgctggtcgcggatgagtggcagtatatttcgaaggagtttgccgagggcgtcgacagctttaacatgaatatgcataagtggctgttggttaactttgatgctaggttagtcccgggcgtccaacacacatttcgtttctggatactgacaactgatatagctgcctcttcatccgcaaccgcgaagacctcaccaacgccctcgacattacccccgcctacttgcgtaaccactactccgattccggcaaagtgaccgactaccgcaactggagcatgtccctgggccgccgattccgcgccctaaaaatctggttcgtcatgcgcagctacggtctcaccggtatgaaggactacatccgcaaatctatcggattgggcgagacctttgcaggtctggtgcgcgggcgcgccgacctgtttgatattatcaccacgcctgcattcgggttgactgtgttccgcatcaagagtcccaagtcagggacgacgatggtggaagctgacaatggggtccttgttgcgcagccggatgaggcggcgaatgagctcacgaaggaggtgtatgagctggtgaactcacggggagagatctttattacatcgacggttgtttgtggggtttatgccattcgggttgtgagtacgaatccggcggccgaggagaagtatgtgaagcgggcatttgagattttggtggagacggcggaggagatcattaagcgggggtagatgttagataccatgtgtgagatactgtagatatttggcatctagcttatagatatgttatacgatattgcattcgtgtcgtcctttgctagttgtgtgtgagatagctttcccgaatagtgaccgttcagcttactggcagcatccgaggtattgcggagcaaaagaacaacagcatagttcagataacagcattcatgtataacaatgttaatcaactcatatcaagcggatatttccatcctatcccgtacaacaaagagcgatatctattatatcaaagttattgtaagcctccaagaagccacaaagcaaacaaactggtctcctaaccttcttccgaacacagtagagaaacaatgatcctttgttccccttccagtaacgctttacctcctacgatgcgcagtaacgcaaacggtacatcccaggtgatgtattcaagtaaagttcaaatacgaatggcaacaaagacaaggaggcgtgctctgaagtaaccaacaataccctcgaaggagatatattgctcatgcttgaccctctcaagtacccttctagaggctacctcgctatcactgccatttgaatccaataaacgacagaacaggcttctgccacgtgccctgcctcgcatggataaacctacgggagtggcatcttctcaaatggacaaaccccgcttggggggcaagatgaacctacctgcaggcggtgctactactgcgcctgtcagagatgtctccaacaagaaaaagcgtgctctagaagaggacagcgacagcgaaaacattgatgatggtaagcgaacttgcatccatctaatcgatgaagcgatgaaggacttggagttaggtttcgagaaggattcagaagacgactacgaatctgatagcaagacagaatcagacagtgacgggggcagctctaatgacgaagatagaggtaactccagcactgaagagacaactgtcattgatgaagacagctctaatgacgaagatggaggtgactccagcactgaagagacaactgtcagtgatgaagacagctctaatgacgaagggtcagatctcggtggtcgagatgttacaatggacgaaatcatggatttcaatagtgaggagagcacaagcgacgagacaatggataccagtgatgaggacagctcacgcgacgaagcatcggattggagtgttggaagtggctcaagcgatgaggaggaatatatggatgtcagtgatgcagagagttggagttccgaacattggaatgatagtgatcaaagcgatgatgaggactatacatttgaacgaccggaagcttggaaatggagcaaagacaacaacatcaacaacaataaggatggtgacgaggaggacggtgataggctaatgattcagcttacatatcccaatcatacccacaagatctgcgatgacacatcttcagaggatgaggacggagatgcacttatccaagaagaggtagatgacgcatcttcagaggatgaggtcgagactgaagacgagaacaagtcgggctgcgctgatggtgactcctctaccgcattccccgcatgtgagtttctcgacaaacacgccgacaaaccaggctacatctatgatatgacatcacatgggaagaacatcctcatcctaatcacgacatctagtcccccaactctcatccgtgcctccacaagggatctgatcatgggatccagtgtctttgctaaagtatttggctacaatgaagagattcgagtgtctgggaagatattctcaagctggcggaagatccaaaaagtcacagggtgtcaccgagccgaattcatttgaagatatgcgagttggtggaaagcttcgagaagcttgttaaggaaacggcacctgggtgccctgttcgaccacgtgagactttacttgcctgcgagaaagagatgcggagatgccagggcattaactgtgatgggcagaacacccggaagactgatatatgccgggctgtgactcgttatagacgggggtttaacttcaaggagctgtcctggccttgtccggattgggtgggtttaatggcggacagagagccgctcaaggggtggatgcattgggattagaggtagaatattacgttacccatcggccacagaatatcaagaatggaaagaagggttcgggctctgtttaggttcaggttcgtctagagtgaatccactcggggaatttccccgcacttacgccataaatgcattattaatgcaacagtcacacaccagaaatcagtcgtagcagcaacaactagtacctcttatcttcatcttcatcttccaacataccagcactagtgtaactaactcatctgcacctcctccgtagccatgcccctcgccagggcaaccttcgaagacatcatcctcgctgaatccccaacctgggagaccgtcgaaggaaacatctacgtaagccccatcatatgtcaaaacaaccctatcactgaccacaacctcccagtttcctcccacagcaatcaaagacaaatcgctcttcgttcccattgacaaggtaacattttgtccttggaagggagacgcgtcatattactctattgtggttggacgtgagtatctccctcgacctcctgtttcgttcagactgctccctacgggagacaaaatcatcgtaatcattgctaacaatatgatatctagcaacaacaatccccggtggagcgtggtattatcccaacccatatgatgctgccagcaatatcaaggatcacgtggcattttgtatgtgtttccttttgtttgcttctaagctgggtgagctaacggtgcatggattcagacacaacaggcagcatcaaagtgagcgtggaatgaatggatagtcgagattggtgttctgagtggcatgtctgtaatgaaggttgatgattgatccagaagtactaatttgaataactctacctcttgacattccaatacactgcaggcgcgggttatgctggtttccttagctacattagtgccgtattgttatatatactagcactgtgcaatctgattctctctgcaactagtgattgaaaaatatatcgagcccgaatagtgagtcgtctaatccaagtggcaacagctggccactagcatgctagtattaaagagcaagcacttcccactcactgctcactctccttcacaagcccatacttcttcttcaaatgctgaatcgccgcctccgccaaccgccctatcttcccgatcttcgtaacctctaccatactaatatcccaactgagatcccctcgcaacccgcgccgaatctccaccgccatgagggagtcaattggcatctctgcagcctcctccgccgacatctcagctgcccccggcatatgccgcgccaggtgcttgctcaactcgtgggataaattattcgctgcgtcggaattattcagcatggccgggtcctgttcgaccctgcgtaaaatttccttaagtgccgtcccgccaaccgttgtgctctgttcttttgtctcgatattggtgtagagggagaaccgcgggtcagaaggcgtccatactgcccgaacggaggggtcgttggttgagcgggtgtttccgagtccaataatacaggcatctgaagtactactctgactgatagactttatgtgagaggtggtgagcgccgaaggggacggggaatgggattggtggattgccagctccaacccttccaggagctcgtcctccccgacgagccgcacagaagtcgcttgcattgcctgcagcagcttggtattacgactaaccagaccacagtcctcgactgggcccagggcaagggtggccgaaggaagccccaggtgacggcgatagcgcgtaaagctgtcgaggaacgtgttggcggcggcgtagctcgcctgcccatggttgccgcagatgccggcaattgaactaaagacaatgaagaagtcaagcggctgatccgaggctgcgtgatggagattccaggtgccctggaccttcgtggcaaggcaggtggtccagtcatcataagttgtattggcaaatctctggtctcttgagattgcagacatttggaggattccagccagtggttgaggacatttggaaatcgccgactgaacatcggcagcggcggcgacaatccctgccacgcagatgacctggcagccctgctcctccaagtcgaggatgaagtcccgatcggcattggacttaccagcagaacgagacaaaatcactagatgtcgtgcaccacgctgcatcatccacaagcacacagagcgtcccaccccgcccaggccaccaacaagaagatatgacttgttgggcgaaaagctgacgggaggcacagaggttggggccaactccatcggatctgaaggcattcggattaagatcttacccatgtggcttccctgctacatatatcgaaaggcatcggtgacctttgcggcctcaaagattttaacggggcggagaggcttgatgtggccaccctcgtaccactcccgaaatagctgcaacagcctgcagagatccagttagacaaacaccctccaagctctctctgtcgggccgtgcatgcatgcatacatctacgcatactgcacagaccggggggagaaggcgacttacaagtcatagtcccgaggtttttccttgcccatttgaaagagatcgaagccgatataagaccgattctggataaacggggccatggctaactgaccgttagccagatagtcccgcttcccgacctcgatgaaccgcccgtacggtgccacacattcccacgaggtatgcagcagcttcccggacagcgagttgagcactatatctgccccgcgggcttgggtctccgccatcagaccggggaggaagtcggtgttccgagagctaaagatgtgactgcgtggaatgccaaatgtcttaaccagatattccaccttttcgtcgcttcccaccgtcgcgaatatctgccggccacggcggcacatggtcagccaagccatttaaacatattatggcatggtaaacagtgtccaaagccttacctttgcacccatcactttgcaaacctggatggccgccagactcagtccaccacaggccgaatgaatcagtaccgactgccgtgtagagcacacatgtcagttgatgctcacaaaacgattgaaaatatcccccggcgcacttacattgccattctggagccgcgcgaggtgacagaggcagaagatggcggtcatgtaaacggaccccacggttgccgcatcatccattggtgtatttgcggggagcttgcggcaagctgtggccgaaaggactacgcgtgtccgaaatagtctccaagctagcatcacgacatggtcaccggcctgcagatccttgacgtcggacgccacacgccggacgactccagttccttcgagaccgagctcgtctgcacttccaaagacacccattcccactaacacgtcctgtgtacatcggcgtcagtggttactcattcacttcagcaggtaggaaaatttatatagccgaagcgatggggtgagaaaaggggcggaataccctgaagttcaagcccacgtaatgcacatcaacttcaacttggcctgtctccaattctccttgatgaccatccactggtacccaatgagctgtgtcgatcaggccaactgggctgacatccagcttgcgtgggcatggtgtctctggtcgcggggtaatttgcttcggatgtatccaatggcatcgaccgacgtgtatgaccccctcgaaggagaattccgagtcagccggccttgcatcgggacactgtcgtgtacgctgtagcttgttaaacacttggaacagagctccagcagccggctgtgtataactgtccgtctcgaagagagagattccggtggccgtttcatgtcgaagcgtacgtgtcaggccgaagatcagcccgtatctggggtcggcacaggccatctgcgaagtattagtcacccagattaggtgggagttgtcagctgtcatcaaggaggattgaagggcgagatagcgttcttccgagagattattcagataaggaccatccaggtccagaagagagataatccactgatcttttgggggagtgtcgtgcagggttgtccaatttacgacgtgacccccttggcggaagcgggatgccacctcgcttgcccatgatccgggagagtccgtagtcaggatagtcaccgtgtcataggtttcggcctcaggcggtgggtgaggcacgcgagagagcatggtaaagtaggtctgatgagggtgtggcacatcgtaagccatcacttcgctgccgatgaaaccggcattgcggagttcgatatcccatctatctggcgaaagataaggtatactgtatgccctgaagtcttccactgatgaccaattgctgagagctccctgtttcaacgtgagtagaaagataaacaaaaatgcaacggacctgaagggctcggttcaacttaccgttaaatactcggtgatcaaagttgtctctgttgcatactttgtgtcttagaaaacaataccagttagaaggtgctgcaaggcataccagggtaaatctcatgcagtaacagtcgaccattcggggctagaagttgccttatatgctcgacagcagtcgcaatccgcgcggttccatgtgcaactgcttgccactcagttaactgggcttgactatcccagacaaaggaaaccgacattagaagcgataatcaggtcataactctgcagattgcatccttgtgcctcgagatcaccggaaatatcgagcaaggcatattgtaagccttcctgattctgaaacttctgctggagggctgtgagggtcgcttcacattcctctgtgacagtgtactgggaacactgtggtacgccctcaggggaccgaaggtaacgcagcaccgcttctgtagcactcccggtgcaagatccaatcttcagtactctagtagttgggtttgaatgatccaaaagtgacagaaatcgactccaattacattgtgattgtatccatttattgtatctgtcgagccgaccctccacctcgagaacatcgagtgacgaaacctcccccaagacaatacgctcgcaattcgcctttatcttaccgacgcattcaaacaagatcgatcggtcatcatttttgtcattttccacatatgcggatattattttgcagatcgactcctgccgcgacgggccgctatcctccaccattgagtcgggttgaacaggcccatctcgttgatgcagtctactggcctcagtggtaacccattgtttccacttgctcagatgatcgtccacagcggtgacttcacccaaacggtcagatatccgcaatataccggaattgacgacccgaagagacggctgccttcgaaaactacctgaatgacgtcttccagaatgtcaacaagaattgcggggatcgcctgggcgatgatcacctttgcaacaattctccacaaacggcggcactgaagcaatgcgttgacgataacgccaaatgggctgcgacgacagcggtcctgccgctggtgggttatttatcggaagaccggtgcgagcaggtatcggattacttcaaaagtgagcagctgtggaacgaggatttgccgaatagggctcaggtttatgtccagagttgttagtagccgtaggctttggaagagaagaggaggaggaggaggaggaggaggaggaggaggaggaggagcaataagggcttttagggttaaaggacgaagatgtcacctagataatattaggcgagagacaaacccatgcaccggataacagagagaaacagagtttagatagccaaataccatcggcataaattcagtgttggccgatcagcccccgcttgccgcagcccattactgaaagggaaatctagagtcagtctcccgcctagaattccgggtagggatggaaggtattcataccgcctgagggccaaagcaaagaatttggccccctcgtctagagatgtatcgatgtcccacatcggcatcatggcaaagccaaccagcgacatagagctgtccccggcagacctgggactgcctcgctttgtagaagcgcatctagcaattgtggtacgcgcgaagcccgagccacatgattgccagagagctgcgcaagagctattggccacgtatcctatgctggcgatgcgaatggacttttgggtatgtcattgcttccctgactctattatattcagccttgctaatggtccggatctgatggaccttggactccaacagcgcaccaagctcctccatagcgattatcccgcagagatctatcacagccgaaccctgaagaaggacctcgatgaggtgctaccctgtcaaacagcgaaggtgggacctcccgcggtacaactcctcgacacgtgcagcctactcgattgcctgaatttcaaccgagacatttgggacgagatctgcggtgaacaagtgcttaggattcgtgtggtattccttaatgatgcgtgggctgtccgcttcataatgtcgcatacgctgggggatatacgaggtcggaccctctttctgctcctcgttttcgatttaccacgctgtggcagtgcccgtgggtctaaactccttattgtctaattcgatgtgccatacagctatgcattggattgccgattctttcttcgccttcctgtccggacgtgaagtccagactgtctcgccgattcgctccatcttgaccttcaaatccgatattatcgatagctggaatgccctgaccgcgtcaggcacgacgcactcagtagccgaagaccatcaacatgagatagtggctggctggctgccgacaatcttgtccggggcgcgacagatcctctggtacgcctacgaagccagctcgcctcgacgtcaggtgaacaaaagcctattcatcccgcaatgcatcatcgaccattgggtgcagggggcgcgtcgagaaggtatacaagtgactgagcatgatctgcttatgggatttatctacgaggtatgtatatgctataggcaaacgccatcttccatttatgctgacgagcgaaggccacatatcgagccctctccgcaccacctcacttcactttccttatgaatttccaccagcagctccattcacccggtcccctggggaacacctggtttcaaattcctattcctgctctgcacaaatccaaatcttctccttccaccccttttccgaaggaccactcatccactctcctccccatgctcctccaccacgcccaactcatccgtgatatcatcgttaaatgccgccatccggcctgtttccctgaaatctacgagcaacaccgccggcttggaactaccccctggcggccccgctcttttggcacgcgcagcccccacgtgatggtatcttgctggacgaaacagcagtggtatgagctcgactgcacaggagggacccccctattcgtagaccttggagcgtgtttctaccgactgtttcagctcctgggagtgcagggcccagatgactttgtcggcactatcaaatgccccggtggcaggaatagcaccctgatgggggagcacaaaggttattgggttcagggaaggctgccggaggttacctgggcgactatggttgacatgctgacggcggtttctttcggggatggtggtgggcaaaaacaaggtctgggccaaacattcgcgaatatttagccagatgtctagctgtctctgaggtctacgtttagcggtgaggatcattcaccgaatctccctaaagtatgtacatttattttattgtatcatggtacctctgcagagtagatttgtagttacccgaatagcatgtaacggagacaacggagagaaggtcatacagaaacataaagtacttacagcagttatatatttttattgcttagagaatatcttgtgtttacagacctctgaagtaataactttttttatccagacccgtcgctaaaatgatacaagagcttctattaatttcccgtaattgtacttctcttcataacggcgtgaagttgcgcgacgtagaccttacttagaaagtaaaggccaggacggcactctaaagtccggctgagactggtagtttttgtacataaatcatcctcgagatagctccgggtctgtcagctcattcaacagttccgtccagtctgcagaatccagagccaggtcgttacccgtctcaagcatctcggtccagatatcttccagctgcctctcatgaggtgcattgtcattggtggcagctgggaggtgtggcggcatgacgtttgattcagcattgagagctgggacatgagccggtgcagagccaggatgagatcgcgctccatccgccccttgtgaagtaatagtgtgattttcagcctgctttccggttctccaatgcttttgcaacacacccatcattgcgttgattccttccctgaccagggcagacgactcttgtgccttgctcagcatgcggcaggcatccagcacttcttcttttcgcttctcggctagaatatcatcccaattgaagcacacgtccagtaataatatcacagcagcagcgaatacatgatgcattacggaccagacgacagagttcggtggggtgtagttcggttcgtttccatccatgattcttttaatctcgagcactttccgggcagactgcaggcagatcacgtgggaataggaatatgctggttcacgagctcctctgatgaagaaatctcgatgcagacggcataagcgggagaagaagccttgttgtaggagacagccttgccaggcaatggtcggacgctcttcgtagagcgaagcaaaccgtcgtctggatgatggatccaggcggaagaagtcaggaatctccgccacggctcgatggaactttttgtctagctcgagtattttttcgtaaattggctctaagccatggagatgctcgtaggatgttgcatcaactacctcccggctcacagcagctagggtcaggcgttgaaggaaaaaggacatgtctgttggtgtggagtttggcattgaaaccatgttgtggcacattgcattatcatcgatattcaatggctggttcacgttcatgtggtgcggctggatgaggtacgtccactcttgagggccagtaagaaagcccagtagcctgcaattgttaatcagccatgaccatccatcactcgaatacctcttaccagtcgaaagacgtcagatcccaccatagtcgtctcttgacttcaagatctattgcatcgtaatncttccctctctctcattccgaaagcgcggggagtcgatgcagtgcagcatgagactcttcgcttggctgactatcgcaccatgtacgaagagaccgctcacggatggtggaatgttccagttagagacattatgcatgaccaccatggttgcctgcaagcccacaagagttggagacagagagtagtggctttgaattaatgcagcgccagtgagaaaggcaaactcttggctgcgcgcttctgcatcagtagatgccaccactgatcgttgtagacatagagagctggctagaatgccgaaaagcagcgccaagtggttgagatccacgggcgcattgctttcaatacaacgataaatcccatttatctggccctcgacacgctttgggacgatgatatggtagagatagtcgacgtaacgatgatagtatcgaaagagatccagagcctccgatttcgcgggtacaaaggtgatcaaattgatcgacgccggattctcatcgatagcggatcgattcatgtatggcattgacagtaggggtcttgcagaacccgtctcatcgtttaggcttaagtttaagttgcgccctcttactggatcatccaatccatctcgcagccattttggggttgctgttggtacccggtcagccatgtgaatgttctccagccagtccgctgtgagcagcgactcccgattgcacgcccgcaatggagctgcagtgggctcaataggcacgttatcggctcttggaggcacagttgggttactgggaggggatgtccgctccacaccagctgctaatagtggtttttgaacccttgcggtacctgcagcttctggctttccataacggcatgtcaaccggcgcgcagagcaactgctgcatggctgctggcgatcgcatttaatcttcttgagccgacaagagtcgcaagacacggggtcctgccgcggagcgcgtcggggggtatgaggcagctggaatgcagctttgcgcttcatgatgagatgtctgtcgtcttggtagtaggttaacaccgcagatgattgtttgtacgggtcacgtgagtatcggcctctatttcagcatgcagtcacttcacttctgtgttaccaagatgtagagagcaaatttctccgttgctggatagcaatgtcgacagttcttccttacggaggtgtgggattgttgttcttgatggctaaccgtctccgcccggaagctccgcggacagtccgagccaatgccatcaagcattaagcttcatactatctacaacaccatgaaaccttgtcctcggagggtccggggggttatactgtcaatacatagccctcaaatacattatatatatgcgctcagggttctgttttcgataaacatgtttccatcaacccatagatcacatcgagctgcactgtacgctcactatctaagttcagcttcaccttgtcaaatctgactagcaaccatggctcacgctgaagatgctcctactgactcgcctccctccgaatacacgtaagtcacccatcccaaaccatacacatatcatcaacaacttccaggccgcgagcagtgcagaccctcctgggctcattttgcggcatgttctgcactgttggcttcgtgaactccttcggcctattcctagagtactacaaaaaggaccaactatcagaccaacccgaatcgaccatcgcatggatagcagccatcgacatcttcttcatttttggtgtatctgtcgtatccgggcctctcctggacacgatcggcccacgagtcagtaccctatactatcaacataacactatacaaacccccagctaactgaaaggtctagctcctcctctgcatcggctccctcggctccgtcttctcaatcatgatgacctccctctgcaaagaactctaccaattcatcctcgcgcaaggcatcctcctcggcatctccctatcccttctcacctgtcccatgatcgccctcgtcggccaacacatcaagatcaagcgcggcgcagcagtcggcatcgtcatcggaggatcctctctcggtggcgtcctctggccgatcatcgtcaacgaactgctacagaaacctaacatcgggttcggatggaccatgcgcatcgtcgggtttattatgttgccgctgcttacagtgacttgtttttgttgtcagcctgctgcaccaccgccatcaccatcaccatcccaatatcagccagaaccacaatcagagaaatcctcacccgaaccccaatccccggatcccactaaagatacagaaacccccctcctccaaaaccgcaccctccacctaacctgcctctctttcttcatcatctacttcggcatgttctcgccctttttctacgtctctagctacggggtagcgcggggcttttcctcctccttgtcgttctacaccatatccatgctgaacggcgcatccctcttcgggagggtcattcccggtatactagcggataaatacggacggtttaacgtctgtatcgtctttacgattctcgcggggatagttgccctctgttggacgaaggcgacgagtgtggcggggctggtggtgttttcgatagcgtatgggttttcttctggtgtgagtataattttcccttccttgttttatgctcttggggaaagtgggaagaagatggctaatagtgtgggtctgggataggctattctctctctccagcaagcgtgcgcgttgcagttggcgacgccgaagacggtggggttggcggtgggggttgttatgggggctacggctttgaggtatgcacattagatttattttgaattgatcttcttggggagtaagggtggattttgctaatcatatcttatctgggagtgtagtgctatggctgggatacctatttccggggcgctggtgcagaagtatgggtttctggcgctgtcgatatacgcgggggtgagtctgctcgtgggtgggttgttgttgtgtgtggcgaggggggcgcagagtatggagttgagggctgttgtttaggttcttatgcgggggaggggtgtttggtgaggatgaggatgttggtggtgtggtgtttgtttcgaagtagactagggggtgatggggtttatgcgtgtgataacttatagatttatacttactgtttagatctgtcgatattgtattagtgctagataattagtcctattctaataaaccaggcatctccactcatctctcaccaagaacgacctgtgcaagactaacatcccgtaggaagaagtgtactccccctccgcatccaatttaaactactatgagccgctccttgccccaatcctctcttcgcaaaccccctccagatctcacagcgattcttcccgccagtcaacacaatgtctgcgtcaaggatcgcgtccctggcttgcacgaagttcggattacatggttgccttcagtccattagtcaggataccacggacattacaaaggtgaaagaagctattctgtgcatcacttacagtgccatcccatccaccaccaacttcatcatcaagtactttccatctgtaggcaccccgtttctaaacaccggcctcgacccatcattcttcccgtacttgtcgatgaggttccacaagacctcgtatagcatggttgcccagacagttccgatggcgtgcacgccgttcatggtattcacgctcgtatagttcaaagggttctcagtaaaggaggtagaataaggatagtcccggacaccacatttatcattatctgcccatgcacccatagtgtaagacgttgtgcgtgtatcgttgggcttgattcggatggccgtcgccataaagtcgccccagccttcgcccatgccacccgattcgagggcgctgaggcatccggcgttgtgggagccgccggtgagacgattggatactggtttgttagattaggacttccatcttctggggagatgcttaccaccgtgagtgtattcgtgaattacaatgcccgcgtcaaaacttccatcacgcgacggagtagactcgatccagatgtacatgcgcatacggccggggataccatcgggtggggttgcaaagtttgcgttgctgaacccggagccgtcttgtgcgttgaggatcacgtagtctttgtctcggccgccgtgggcgctgttattccattggaagttgccagcggattcggtgaagccgagtgtatagaggaggtcgtggtaggcgtttgctgtgtagaagagttggacgatggaggcgttgatgtatgatcggggtggggacatgtttggggagtatggccattggaaattcaagttggggtcggatggacgtaggttgtagagataggagccaccgccggtcggattccagtgtgcgatggcattgttgcctctggttgtggtgtagttgtcccgtccatcgcttatccaggtgtatgcggatgcggataggtcccaggggtcggtgacaatggtgcgatgtccttctgctggatcgtttgtgccccagggactgttgtcttagcttcgttattcgatggggagagccactcactaaacttgatatgtcgcgtctgcgacatagtcaaccacgccgtggacagtggtagtctctgcatcaatgtatgtcagtagccagtgctcatacatgtctgtttctatcctccaggtgagcgccagagtcccttctggcttgacaaggtagactagcttagctttggggtcagataccgctcccactgcctctctgaatatgtactcgttccgcccctctgcagcttcagtagaaacattgtcaatagtcagtggaagctgtatagcgtcccttgctcctctaagtgcagcctccggactcaaaacgttggtattgtccagatggctgctcggcaacgcgcctgtgaagaacgaatgtccgaaagacaagaccagtccatcttttccaatctgtaacagtaagcttccttccgaacagagtaattggggagcagacattaacattgaaatccgcattgtcaatgtcaataccatggagcgtttggcggaagtatacatgtgcaactccattgtcgccgacaaagtggtcatcgatgagacgaaagctcgctccaggaacaatgttctgaaccagtcgagctgctgtatcggtataatgttcttcagcggacactgcgactgatcgattcgtgtctacatggacagaattgacgtattcggagttagaggtcagacgaagggagtccaagtccacggctgctgaagttgtatgcaatgaagccgccggatatgccaggataaccaaaggcaatgtccctatgctgcatactaggcgcagaccatgcatgtttgctcatgcgtggatgggatgaaagatgatttggggtcattggccatccgcggaacatttactactatatatactagagtttgttctgggtgaaagagggactactaatcgatacagccatacctacccctatccctcctggttcgcccttaggatattccctatcaaagctattgtccgacgttgcatggctgtccaacattgtcgaagtacaacctctccaacctgccagctctcattggcctaataatggctgacctcccgggttgtctcacaagctggcctgccgagtgctaggggaccccatagaggaggcgttttaccatcgatagtaaatcaaatacggacccgtcatactatgaaaatgctggtagcacgcgttcgacggaagatcgtcccgtcgtaagacaaggcaggcttcccataattcgccggcactagttggtcactttatactaacggaatcaccaagttccatgcagattaccagccattgtttccggacagaggcagagtgctccatagatgaatcgcatggaccgaaatatggcttgtaaagcagcgattcagcaaggagatgtcgcagcgcctgctgaaatcgaagggtattcattgtttaaatatatgcttgcagtatgtgaactatatcttagcggactgctccagtttccgcgcccgatcctttgcaatatcgcacattgcctttaaaggagcgaactgtcagcactgctccgtgtttgggtagacagccatctcacctgtataatctcctccacctcacgatcggcattgccccggtcaatcctctcacgcatctcctccatgatgacatcccggttgcgaccgtttacaaaagtactatgccagggagatatgtcagaccaacacaagtcgttgggtatactgagagaacatacacaaaccgcaagccagggaacttttgctcgtactcagcattcatacgtttcagcttctccgcttgttcctctgctccggtattcagattcgcttgttccttcttgctcagttcgctcaagtgctctgtcggagctcccttgggctgtcccaggcggggatgcgatcccagaatccccactagaatatcgcggtccttggacgagttggcagcagacagagcagacatgcgaccgccaacagcatcaatcagggtggcgtaggaggagaatgtctggtttgcgagaacgggggccatgagagtatgcagctcaggcgacgactcgaacagggtatccaggacgcggaattgctgctcctgcgggagtgatgtaattgacgatggtgaggggagatcggaggacatgatgagcggggagtcgtggaaggaggataattgacaaaaaattacgagctgaaggtaatatttcgagcagaagtatcttggtcgattttcgttggaaaaaaccacacggtgatagttacactgggaggttgatggatatatgctgcttcaatgagtccccgcatcggcagcctccgagtgatggagagccagcgggacggagacctccagatgcggacagttcattcacccccatcatattatgggtgagatctatctcaatggcaacgaggggccggctttattcacaaccatttgaactgagactaaaggtgcacggacaagagcttcaatgagcttgagcttctcatcagcatccgttaactagaattgcattgcaggctgacgacacggtcggacatccttagaatctccgcggtgttctagaccccgaccttccgaactccctagcgagggatggagaatctgggggggaggaagaggggaggaaacgatgacaagaatcggattgaccatcgatagtcgcaatgtaaggtaggataaagtttgggtgggcaaccagataagactccatcagggagaatttctcagcgatagatattggggcctggataattagcagttgacgatcgcatgcaatcctgaccgattttgagcctagcgggtgtaacgtgtaatcatcaccataccggcgtgtacgaccgctgtatttagaatggcaatattacaccacgagtaagtaagtagtactccgtagttatagcaaggatcagtcgcacggccctggcagcgaccaaaaaaaaaaaaaaaataaaataaagcacctgcagacgaaggcagcccgcatccctgctcctcctcctcccgttcacgccggctgtctggtgccgaggtgaatggaaccagtctacaatgagtcttacaatgtaatgtatacgtgaccgtgggggggaagaagagaactaagtcggtacctgagagtcagtcctgagagtcagtcaatggaaattggttcatccaatagtcccacggtcggacttccctctgcggcgtcattattggatcctcacctggtgccttcagggacaactgctccaagtagtagtagccggtagtccacttgtcaatggcctgatttatgagagggagaccagagacacacattaatatcgagaataatctacttgacttttcctgagtattcagttcaagatttcttttttttcttttgccttcttttccattcgcttgggtgaatggaattgtcaactgaatttcttcgactgtaactgaaagtggaggcagccgggcatccactttcccacccacttccctccctctattaaccaaccatcactcaccatctccaaagcagcccctgaacggtcaggcccagttgaactcctgagaggttcgtgggcaagtcagtcaccactcggtccctcggccgtctctgcggatggatcagcattcttgttcaccagaaagaattagttatacattgtatctgattctcaatccatcccgcttagtgtgtcccgcccgtctttgatctcggtccaccgctggtgtgtgagagagtgtcttgctctcgctctcgctctctgccatcatactcacacatcgaggcggcgcgctgctttgcttccttacatcctgactttccgctagaccctccctttcccctctttttctcctctcgcccctcctcttcttctcttccccctcccccccatcgttcatcatcatcactttaatcgtgatctgtcgcgcggtcctgggcatctgcctccaatgcagttcccgtcatgtcgctcaatgggctagataatcccaccgtcatcgatgcctaccagaccgcgctcaccgaggccggtggatggtaagtactagtccgtgtgtctcggctataccctgcaccttcgggtcctccgttgcaagggtggccattgcaacccaatcgcatcggcaattcactaatgcgcatggcttggtgtcttctaggtttctcctgcggtatgtatcaagggatgaggtggctctccttgatcgcggcaccggcggggtgcccgacgtgcgcaacgcgatcgacggctacgaggagaagtctccgctctatggcttcctacaatatcggcgacggaaagtcgtcctcagctatctgccagagggcatgtcccgcctcgtgcaaggttggtggaaccctcctctctctccatcattgttacgacaagctagagatcccactgacctcgtcatcctcctgcagcccgaacgacggtccaattccaatcggtcctagacaaattctccccgcatgatacggtattctcggtgacgcagccatcggaacttacagaaagcgcattgtcctccgcatgcttactgcatactgcttccggttcgatcacttcctcttccagctccctccgccgtcgccgattgaaagagatcgcggaagatgccgaagagactaccgtaggcaaggacgagaaccaggcgcagtccgcggccgatggaatgccgcgccagagatcgttcagtcagctgtctgaagccaccgtggttcccccatcagtggtgtcgagtgtccagcaatcaccagtcggcaacgaaccaaccccgaaaacttccgaaaacgcctccattcgagagcggtcttcatcggtggccacatcggagcgggctccttcctataagaactttcgagaagactcatcttatgctccgtcggagccccgccaatcttcgcagtccgcccgaccttccgtccgtgacctggagcgtgccggatacaaagccaaggtaaagctgggtcctcggccttccgtagatggcagcggacgccctcggactgcgggcaacctctctcgaagcgctgaacggcggccagtggcatctttgcctgcgggtgtccggtcatcatccttgcgcaagtccaatcccagtccttcgcgacctcgatcttccggaggccacgggacccccgtcgccagtagagtgccggccgtgcctccgttactggtgcctcccttttccatgcccatctcgcggcccaagatatcgcccggtgccaagtcactgagcgcgctgtcttcgtccaccacgtccaatgaaaaggagcggctgatgaaagcgctccagatgcgaaagacgcagatggagaaaaaagcaaaggaggggaagaacagttccacgacggagaagggtgaggtgtccgggcttgatatgaccgaaaataaggagaacatcggtcatataccaagtaaaatgaagcacgatgggggcgatgaccgaatggcccacttggcagggccgaacaaggagcccctttccgaaactcagccaaccctgcagcccatgctccgtcatcagggggctgaagaagaggacggccgtactactcctaattcccctgaaccctcgggcagccaccactcccttagccaaccggcacgcctgagcaacagcagtaatgagtttcaggcgacgacacccactcgttcgggatctgaaacgcaggcgggcgacagggacttgggcgcatccaattccggcggcgtctcgggtggccccagctccccgactaggctgcctagcgccatcgccgctccactcgagaacaattctggaaaggctccggacgaagagattgttggcccctcgccaccaaaaccagtcccccatcctgttgttcctggcgaacaagaggccctcctccatcatcatcaccaccaccaccccagcacgccagacgtgactgagtccgatctgttcgagtcgcctgctcggcccgattcctcccaccatccttcagcagccaccttcacccccaattccttgtcgatcgccgctccccctccgacggagccgcagcatgacttgacccctgaatcctcgaatgtggagcgacagcgcagcacgtctcgaaaggagaaacgcaaaccatacctcgaacctattcaagtcccaactcccgactactcggatgacgagaaccttctctcagacgactccttcatggaagaattgaccagtgccacggttgaggaggctaagcccatctctgtgggcgtctctcccctctccccgggctactcaaacagcagcaacggcaacgtctcacctgatgcgtggaggaattctcgtgccgtttcaaaccccagcgccattggacaccagtcccccaacatgtcgaccatagccgtgggccgttccgtctcgacgacgggtgcggattctggttcccagaacgggccggtcctggtggcgaggaagatcaacgtctcgtcgggcatctccagccgcatcaaggcattggagaagttctccaacagtcgcgacgccccatcaatgaacggccaaaccctcgccgctccgtcggcggcctccttcgagaccctccgcaaaggctactcgggaccttccatgccccgacctctctcatacgcccctgaatccttctcgcggtcatcgagcgtgagacgacctagctcacaggcgggccctggcctcgctggtcctggcctttcgcgctccccaagctcggtctctgtgactgctcgcattgtccgcgatcccaccgctgctgaaaccaacccgaatgccgacccgtccgagccggccgtcctcaacctacaacccagccaaattaccgtcgaacaggaaactacagagctccctgttctgactttgcaaacagaacctacaatcactcagtcggaagatgataccttgcccccgtcctctgctggatccgaccagcaatcctccgtgtccgtacaacgtccggagagccgaatctccacccccacctctatcaaagaagaagaagaggtggcatcacccgccaagtcatctggcgatgcgccctcctcccctgatgagaagaaagaatcccgtgcgacgcgacttctgcgccgcatgtcctctatcacttcccgtaagagcgttgttggtgtgttaaaccctatcaagggagatgaccatgtggtccccattaagcttgaggaacccgagaggcccgtctcgagggcaacggaggtggctccggcgatcgatattggcgaggtcaatgtacagtttcccgacactctcctgtggaagcgtcggtttgtccgaatcgatgaccagggttatctgattctgacacctggcaatctggactccactaaccgcaacttggtcaagcggtatcatctgtccgagttccgtactccgtgcctgccggacgaagaccgccaggagctgcccaacagcattctgctggatttcctggacggcaacactcttcagtgcgcctgcgagtcgagacaggggcagacctttgtgcttcagagtaagtcgcttgcaccgatatgttcagtggatggtaactaactgggtacagcgcttcgcgacgctcacagcacctaccagaccgtctctcactagccttgatctactgcatagagcttgtgcctttccttctccttgaccatgcatatattgcgcattccttcctccatttccttcctcatccggtgttttcagcggtatacccctcaaaacggtttccttctacccactgttttgtatccatcacattctactcttctatcccctttttgttggacttgttagtgagaggcatgatgttctgtcggcttgctctgtgtaaaatgttggatcttggcttgttcgtgtcgacattagcagcatttggcggttggttctttaatagcgtggcgtggattgtccagacaacgaggttattctactgtcagcagtgcagtcccgttaatgtctgggagtgtagccttaagacatgctcgctgaccgagcaagttggaacactggttccgatcaggacttgacaagcatctactcatccttcatccaagaataacatgcgaacgttttattacatctcccaacgccggcccagtagctattactgactaattttgtttcggggaacgcggagacgacggccgagccagtcgcttttcctcccagtcctcgaggaatcgctggaccttggggccccagacctcctcgccggcctcgaggtccttatactcgagcaccttgtccgggtgaagctcgaattgagcctgacgagaccggatcagcgaggacatcagcccgcagcttccgaccgccttgcccaggtcgtgcgccaaggagcgcacatagaagccagaagacaccgtcatggtgatcttcactgcagccggctgaggctgggactggggcttggattccgaggattcctcggcttcagccttgggagcatccgacgcttcctgctcggccggcgcaacaggcgcagcctcgccatcagcaaccttctgcttcttagccgagggagcagactcagcatcaccaccctctaccttctcctccttagcatcctccgcaggcggggactttctcttcgcagaggcctctccttcaccatctgcctccctctccacaatcggcaactcatcctccttcgccaacaacttctccgcaacagccttctcctccccctctgcctcaacctcaggccatttaaactcatgcgttccaggctcgtaccactcgacaatcctcaaatccgtcacctcgaccggcctcttctggatctcaatcggcggctccttgccctcgcgggcatactcataaagcttcttgccattcaccttcagcgccgagaaaattggcggcctctgcataatcttcccgcggaactgctccagtgccttctccaccatctcccttgtcacatgctcgtagggcgccttgcgcaccaccttccccagccgatcataggtatccgtctcggcgccgaacagcacaacggtctcatattgcttcgtgcatcctaggaactcgttcaggtgtttcgtgcccttgccgactcccgcgacgagaatgccggtcgcgagggggtcgagggtgcctccgtggccgatcttcacgtcgagacgttgcgtgcggcggcgcttgcgctggtaggtgctttcgcgggcgcgacgggcgcgctcgtcggcgagccagggggcgaagagcgtggaggggttgaagtgcgtttggagggtgcggacgacgtcggcggaggagacgccttggggtttgtggacggctgtttatcattccgttatattagcttggaggtacattaaagcaataatgctaggagtgaggtataccgaatacgccttcgtagatcttttcaccggacatggtgcgacggaagggtctgagggcttgacggaagctcatcggcgagcgatgagtgtgagtggcgggggatttgattgagtgagagcggcaattgatcgactagcacagctcagtgatgcgatcgtaaagagacaactgtagatatagttgaacacaaccgaaagaatagaagtgcaatgaataaccgaaagtagtagtgaagtcgtccaaaatatattttcagctccgcaaaattacccgcatgcaagtttcccattacggagtgagtctagtccagtctaggcatgaaagattcccgtctgtattttacacccccccaaagcagtaattacccggtatccttgtccacatccgcacctaatctcgacatagtcagctgtgtattgtctggtaattgccggactgccctccggctggcaagcagcgcagcagcagcagtagcagcaagcatcatcgccgtgactgcagtcagcttcacccctcccctctatctatccctcacttacttactcctctctcactcactcgttcactcatttccttcctctattacccactactttatccattgcctttcttatcctattttaacccccctctcctaaaccgagagagaatacacagtcccccgaacaaagcaacatgcagtccccaccatgacctcccgcgaagacagtgtcctggccgccagagacccctccctcaccgacgaaaacgactgggaagagttcagcctgtcggaagttcgagtcctggttccgggcaaatcccgctatgcgaatttattgactgcctcgccggagaatccggtccaggtgacggggtgtttggatgaggtggaggaggagcaggagaagttgggtaatttccctcacttttgtcttcttatttctgcttctggagttttggcagggggggtagtgtggtgctaactgattactggttagtgctcgacccagaatacttgactaaacgcatcgtcctcgaaaacgtcacccacttcgcctacggacaacataatgatggggaggtcgggttctgggtggctgggaaggcgggctggttctcgatatctccggcgaaggggtacaaggccatatttaatgatgtggtggaggcgatagatttgttgtattttctggcggatcggcatcagtcgaagaggaggaggaagagaaggaattggaatccgagtgtcgagtatttgtgcgaggaggtatgcccccatattttcttctgtctgttgtgtgaggatttggtggatggttgtttgctaatggtttgggtttagtatgtgagccatacgcatgggatttgcgaggatgcggacgactctgcagaggtgttttacaaacatcatcattttctgctgtcgaggatgttgaagggcgaggaggatgtgcagtggaccaatacgtgcatcttcgagcatctgtgtgaaaagtttccggtatgttgttttttccctgttccttggggtggtttgaagggtgctaatggtgtaggatgactttaagcagattaaagcgcagtacgaaggggcgaaggaggtagagtcggaggaagaagaggaagacgaacaagaggaagataaagaaatggacgagaaggagggccaggatgaggcggaagcacgaccagatacatctgggctatcgaaagaccaggcagatgctatctacaaggtcattctcgatctcaaagaagcgggatacttggccaagcgccaattgaccttcgaactcctaatcaacacccttgtcgaacgcttcgccatcgacagtactgactatgcacacgacctcgtcgccgcacgggccgacgctatcatagagatgatggacgaggtgaaaacatacaactttgactggtctcgcaaggtcatttatcgggagctcaaagccgcagccaagaaaaacagagttcagcagattaccctaaccccgctgcggcctcgcccctccgatgacgatgaatcgtccggagaagagagtgaacatgaagaccatccccgactgcgcagacgcagggtccacaagtcggttttgcgacctaagagctctgttgccacgaagcagaccggcaaacgaacacggagtgccgttgatgaccaagatgatgactcggataacaacgaagatgcaatggacgagttcgagactccaagcaaagtccgcggccatgatctcgttcgtgacccgttgtcgacccgtgccaagcgcaggactcggtccctcctgtacgattcaaccccaattcaaaagacgccattgcaagagacgcttcaaagccggaacacatccgtttcgggggcggaccgtgagacgaacgcagatgcatcagaattggaagccacatttgaagacgatgtaacatctgatacctggacgtgtcacgttcgcggctgcgaaaaggttatccacaagagcaattctaaacgtggcaaggagctaatccaagatcatgctctggctcatgcagatgatactaaagcaaagatcgatcttgtctttgccgagcagagactcaacattggacttcctgttgacaatctccttagtcgcatcagagagatgggcgcattcgataccgatcatccggtggatagcgctttcactaatggagtgaagacataatcaggacatacaatgagatcctacaaactagatacaatttctgtgcagacagatgatgtgcgtgtgcagtctgccacggtatgttgcttattgcttctgtatttaatgtcatactcacatttctctaggtgcgcagctcacagcacatcacggagtcaggttagcggcgttgagatggcatgatacatggcgggtgggattctgcttcttgagatatgatgatgtgataccagagataccagcgtaatgaagtaccctactcaggttcagctagatagacagtcaccattccatgattatcaatatacaaatcaaactgtctatggaaacactgcttttataaccctgaccggtatcgagcaaaaaataaaccatcaaaagaaatttacagcgaatggaatcaagaacgacccttagcagcagccctcctgctcttgcccggccgcttggcaccaccgcccttaggaccacccttcatcttcttgaccgagaagtcgcgcatatcaccactcgagacagcatcaccgctcttagcaaagcgcttcttaccaccgaacccgaacttctcattcttcttctggcgcttcatcgacggaccaccctcggcatcacgaccgcgcttgcgaccacccgcctgagcagcatcatcaatagcgacatcgaacatgttggacgaatcatcagtagggccgccagtttcagccttgcgctctgcacacaccaaaacagttagcaaccactctcaaacccacaaaggccaactcccccaaagaaaccaagggataaacatactcttcttcaacgcattaatcttctccaacgtctccctcttctccttcgccctctgctgcaacttcgcaacctgcacctgctttccaaacttcttcaaatcacgctgcttcctggcctccgccgcggccttcttcgccgcggcctcatcatacaacttcttcttgatcttgcccatgtgctcatccgtcttcaccatctcggcgaagtaatcgccgggtcgcgtaaacggcacaccttctttcttcagggtactccgcgccgtcatcgccgccgcctggcagaccttgtagaaggccagttcgcggttcaggtcatcgttggcgtcgggcacttcaatcggttcctgcgatacgagactgttgtgctcggagaagggagtcgcgggggtgaggaacgagatgcgctttagactgctggtgatggcagcgctgttgttgattgtgaggcgttggtgggtgacgacgtcttcgcgttcgtcgtcgctgaggtcgctgagggggatgtcggattcttcggcttcttcttcgtcgtcttcttcttcctcttcttcggcgtcggagggggtttcttcgggggtttcttcgtcttcggattcctcctcaacttcctcctccttcttcttctcctccttcttatcttcaacaacagcctccttcacatcttcacccttggtagcggtagtcttcttcttcgccgccttgacgagcttcttctgcttctcggcctcgtagtcgcggccgcggtgctcgtccagagcttgaaggagcttgctgcgcttaggcatgatgggttatgagatgtgattgtggtggaactggagtgagttggtctggtgcaaagctgcgggctggaactttgctgcaaatcaatgggaatatttttttggggagatttggtgacgctaggcatgctttgggtttagtgttgtggggatgggggaggaaggttgttccgttatcgggttatcgataaggaatttatagcagtagatatgtatgtagacgagatgtttacgagaataataggagtgttgattgctatctttttcttttctttcttgtttatctggaagtcaatattgtaatgggattaattatgcggaattacctcatccatctagttgtgaaactaatcggtttatcaaagtcagctgttgctggggtgtgtaggagagtgcagaactacgtgtcttggtacatgtgaagaggtctgttggcggattagaattttactctagtctgtttattcaatgaaaagatttagacatatggtatattaggggcactttatcttcatcactggtagtaatgatactagtacaagaaactgatcactcccatctgaaatacgatatatatatatctggggtaactatcttttctgacagctcacaaactcgagaacggtcatccatatagtacccaaggaatcatatcctgaccctccttaattttcccactctagtacttaagttcttcagttcatccacatcccaatttcgccacgcttgtttccaattgaagaacgcggcttccggactcgccaaccacaccataaagtcggcgtgtagacttactgaacaatcagtctctatccatacatgatagaataggtaaaggtacccctattcctaggcaatttcgccggatccgtttcagtcttcctaactatatctgttatgaccatcccggatgcaatgacaccgtaaacacattcggatcctgatatttgtaaggatcattagcgtcatctacgatacatccctccgtcctcggtgttggggttgcagtccagttaatagaatccgcagacattcgaaaagctcaagcaattcaacgaaggcaatgcatcaagaagagggggacagctacttctcctcgagaaaatgttctctagtagatggttagtgtgtcagccttgcagcattagcgccgcgccatcatgtttggtgactccggatttattgacccgaatgcagctcgtagggatacccgatcactacccaagctacaacgagtacttgagaatcttatacaccagtacaagcatcatctctttttgagcctgttgcttccaccaaagattgagttagcttcatgatgccgttgtcatacgacaagttggatcccagtgccagtcagatccgtcttttaactatcattcccgacgagaatgacgagaaccctgtttgtggatcgctccataccgtgtctctcaacgacacctgcgactttgacgccctgtcctacgtatggggcgacacttctgtgactgttgacatctcggttgataattgtatagtcggtgtaacaccaaatctgcatgctttcctgcggaaaattcgccagccgaatacagaacgtacggtatgggttgattatgtctgcatcaaccagaacaatatctcggagcgaaactcgcaggttgctttgatgtgtcaaatctattcgaatgctaggtcggtggttgcttggttgggggatctggcgccggaagctctggagctcattgagtggtatcatgccaatcgaaatgggttttacttcgaaagcacaggtcttcatattgataaagctatagaaaagctgttgactcctgcaaaagcactgtgttcctcgccgtattggcatcgggtatggacatttcaagagtggcatctctcaaaaattgcccctgtctgtatgcatgaaaagacgactttcaccatgggaaacatatttaatcgactgcacgatgaagtagcggtcgccaggagtaggcttacttctgatactatctctttggacatgccatacagagcatatccaaagccggtagtagctaactcaagatgtgcgcttttttttgggttgcaacgaagactcgacacacttgtgaattatatcccgcgggatattctgcacctcaatccgtataccccgcgtccatcggggcttggtgacttgctatcgcttacgagggaccggcaatgcagcaatgaactcgataaagtatatgcgttatatgggctttctcctgtggctagggtgacataccctcccgactatcgaaagaccatcggccaggtcaaccatgaaacaacgtcatttatattgggacacgaagccaatatgaatatattcaatgacttcgatttctgcttcaattctgctaacaaagacgagtcactcccttcatgggttgttgacttcaccacgacggatccgaaacatcgcgaaaagatgcagcaaagcttctccaagacgatgaatctggacaaggctctctgggagcaaagtagagaccatgctcccatagtagcagatgatatgtagactctcaaactctggtgtcgtaaagtaggcgttagccttggtcttccatacgtgttggactcagaagtcccccgctgtatgacgcagacacagctggctgccagaatcatcatgaaccaaagcaaagaccgtgatcattgctcgaacatacacgatatggtgataaaagctgcttactactacactgatagctccaatctcattccccttagtcccttattcgagatcatgaaaactcatcatctccctggcgagtttggacagtgggaagagacgtttaaaacgtatcttttcgccacctacctcatttttgagaaacttgcgcgaaagcgattgttttccgtggccatctagactgggagtagtattggtttcactgattgtgagattgaaaaggatgatcgtcttgtcatcccctgtggaatcgcccaagtgtttgttctccgtcccattcctgagaagctgcttgtggatggtgaagaagttcagtgcttcaaggtgattggacgggcgtatgttgagggaatttcggatcgagaggaagtcatgccgcatcctcttcgttccgagatggaaaggacatctcctacactgttctgtctccgatgaaattccattcctgctctaattctccgcactgttgattgatcagtaggcatatacactattttccaatgaaaccagctgcatttgctataggatggacatgaacgtttcaaatgatttcaaggaagagactaatccaaaagaccactgcgagattgtcataataagaaccttttgctagcctgtaatgaatataagctacacttacattgcttcaataggactacacgtgtattaaccactaaggctatataaacgaaccttcacatgacaaagttcattaactatggtaatagcctctaagtttctcttggaacttgttgagggagatactcacccattgcatcgagcacaaagtagaagagcagagcgattaccttgattcaaggacatgaccgacaaaatgtatttacactaaacgaaacctctgcacttccttacagacgacgatcaatgaaggtggatctgaagttcaatagatatcgttcctcttgatacgtctaatatccttccgctcattcaatagatagataaatgtaggtgtccagatagaggacgggaatgtcatttaggccatgggccatgactgcaagggatactacatgcacactcctatcctcacggactctcgggatctttctgcaggacacaaacgggaagaaagtgttgttcaaactctattactgcctacacatgccatagccgtttgtgacacgaggccggaaggaccgagaaattaatgcaagggggacaatgtttgacgggttgtgacactgacatatcagtaagagggtagagtatcatatacaataatgtaggtgcagaatggtgatgaaagtttccatctacagaacgctgcgtagggctgcatcatgcagatttgtcacaccatggcaagatggtatgtatatctcggtcattccgagctctgccagctaaccatgtagtaaccttctagctggtgtcttgttagatgtcttgtagagatttcagtaaacccaaccagtctcaacgcgttcagcttcttctaggaatgtgttatatggtacacgtcaatctaccaccgtaccagacatatatagctctcccaagtcatcacacttctggtatgaacattgttgacggggtggttatggtatgtggtagttggaggtgtggtgaaggtgaaggtgctactggggaggacggtggaggggaatgctttggcgtggaggttgtggtctatgtggttgatggcgttgtatgctttgccttgtgtgtgtgttgggggggaggggggtggggggatgaagttggagtttgatatagaggagtgtgatagggggagtaggagttgggagaaagtgactccaaagatgtagaatggaaggtgatgttagagttaggagtttgattttttgtgacctatctccaaagagagtgagagggatatgtagaaattaattacagtagtaaaatcgaaatggtctgggccggaggagaccaaaggaggggtaatgagtgaacaggatgaaagtgtggtacagacaggggccagccagtgaattgctgttgtcatctcaggttatacttgacggtcaactttattccttgtaagcactataatattataatgctaggcaagaaagtatatctggcgagtctatcatcaataagatgggtgaacggaccaatgacatttgatttcggaacagggatgtagaactgatgtattagcagcttctttgttcactaactatagccataagatgatataatagatgaacgtcatatatagccttctacagctgacctaaagcaacagcatccatgcagtagtctcttcctatcttccatgtccaataactccatctagtatgtatacttaaacccagccaacccctcgatcggttttcccccacgatcaacccgccgattcgcccgccagaacttgaagctgagtcctgccacaaccacgataaccagcgcgttagcgatcatagtggtcaataacccgggtcggtagttcggggcatcttgggccctgaagaccgttgtcccgatgattcctccgatactgcccccgccgatgagggtggcggatgtgaaggcgcgcttccattggccgcggacgttgttactattaatcatgttagtaactaatattatatataacaagagtgggataattagggaaaggatcatacctctgccatgagactaaggctgggcagttcgcattggctatccttccatcagtacagcggttataccaacagggagaggatactcaccagcaatagtcgccagaaagacaccaaaataccgtggccccgactcactaagataccccaataaagcaagcccaaccaggcccatagcagcatttgcagcaatgatcggccctctcaggtgccatttgtcggcatacaccgcctgcgtatacatcactatcgccgccgcaacatacggcggagccaccagacactgagcctttgcaaccgagaaccccatactatcctccagaatgatgggaagaaagtaggcgatcgagtagctgttcgctgtggtgagcatatacatggcagcgtatgcccagaccttactatctgcgccgctgcggagatagcctttcaatgtgaatggctccgtgtagacgtctgatcggtcgttctcgatcgtagctaccacgtaggcggcctctgattcgttgagaaagtgccatgacttgggggattgttcggggaagtcgactaggatggcgtaggagccgatgcccattacgcaggttaggatgccttcgatctgtggggtctgcattagtgtaggttttcagaaggtctgtggggtatggggcagtacaatgaagatccatctccacccggactttccgccaattccatgcatttgcatcagtccgtaggcgaggataccgccgaatccggatgccgtactgccaatcaggtagaagagggcatttcgcttctgtagttcgaagcgagggtaccaggtgcttagtaggtaaacgcatcctgggtagaatcctgcttccagagcaccaaggatgacccgcagtccagctagcactggccatgttggcgacatgccaaagccctagttggaacattagcaacgccaccactactacccctaaaacagtatgctattcactgatcataaaaacttacaatcattaccactccccatagcagaacaatagcagaaagaaacagccgaggcccgagtttccgaataatcaccgtcatggggggctgaaacacggtataggtaatgaagaagaccaacgagctaatactgtatccattattcttggcattcatcttcaactcttcctgcatcctatcagtacgaaaaattgagttagcttaatctcttggccgagccgtggccatgaagcggggttggaagaagactggaatgccatacccggcaaccgaggcagctcccaagttagtcctatccagcaaactgatacaatatagacaacccagtgggataacgagacgaatgtcaattctccgcatgagtcttttcttttccttcggagtaaagtagtcgagggattccccggggtggatgctgttcttctcggcatcctcgacgtgggatgccgctccggaggacttttctgcttccattgctgcggggacgggggattcttctttcatgttgagaggcttagagatggatgattgtgaggcattttgactgctgtaatgggatggcattatatagctgtgtgagggatggggatatacgaaagtttccccgcaggatgaccccgcagatctgttaccccggatttcgccatctcaggccaggagtaaacatcactcgcggatggagaatttagttatgggtcgtagcgataggacacgtcacgagtcccgcagctggacggtagatggaaagcccacggcaggtcactttgtacttggcaccgagggacaagacaatcagtggaagggatcaattgggtcctgttccgtgtggcgagggactcgtataatacgatagacaagatcttggttctccccgagccaggagcctggatcatctctgaatatattaaggttatcaatttcgcaatctggagtctttcggttctcccgaggcaggccgggggggagttctgatctggggatttagagttcgttatctctattccaagtcatgacatcaacatgtccatgtgaattctgattgaaatgaaccacctggtttgacaggctggtggcccaaagtacctaaacggaactgtttccgcgattcatcagcatgccatcagcactgctgggctggaagtcccgtctgcggggcaccttttaagctgttgattgatgcaaactgcatcttgtatcaactcggtcgtacaacaagaggctgttggcagataaccctcatctatccacaggaaaggtgatcattctgatgatagtagtacagtagtatcgaacaccaggaacttggtgggagatcgctaaggatataaatgacatgttcccggccattgctagatgagtcgccgaggatatccgtatctaagcatacacgagatgatagtaccgaaaacagaaactcacaactctagtggtatctaaacaattcccttcaataaatcaaaccagtcaaccatcaacgccaaccgaaatagagacagccacaccagtttaaaagcccccgaacggataatggctaagggaccgatgtggtgcaacataatagtcctggtatggatgattctccatcgaaaagtccgcagttgccatgagcggattgatcactccagctggcaccttgggccgggcaggagcgtgatctgcggccaaaggatggtcactgttgaataacgccaggatatcttccgacatatgcattggaggaccgtgagagtcactccagccccaggcttcctgaagctcctgcttcacgtgctcggctttccagcctgtctgctttatgatgtcctcgagaatacctaaggcttcttgttgagcttccctggtcgccagacactctgcggcaatggcgaggaaacgtattgatagacttgcgactccactgcttcatattagttgttgatcctgttacacgtatatactggcgacgtaccgatccctggagtgtgccacgatgccgcagatatcccttgcatggctttgctgtacagtctgcatctcggcactgtactccgactcaacggggtttgtcttcgtaagcaagattcgtgcagtgtggtatagtagtcgagcgatgattgtggaacgcttgatgagcctataaatattagtaagtcatgtgcgaatagatcagaccgatgctcaccatatctgcggaaagacggatttagagtttgtctgccacgaatgaatatatcccaggggcatcatggaccgcggcacagctctagcccactgatcgcaccactcgttataagtacaccactcctgataacgctggctgattcgcatgtcactggcagcctccagtgctggcggctgggctaacgatcgaaagttcgcaatcttggcgcaaatgaataccatctggtgcgtccacgcttcttcattgcctgcaacacttggctgtgcatgattcagatccagttcaacaccccacgtgtccgggtcccaggaaagcgtccaattgaaatgcaaacagctgagtagttccatgcttacattcaaccagaaacaagcacctcccagtcccggcgttttggcattccagtgacactctttgatcaaagctcgcgcaccagcaatgtggctcatgccttgaatcggtcggccagacattaactcgtagatgttcagcagaatcgctgtagttgcgcagagggccgagtcacgatcagggtcttgtaatgagcgaagaagatattgcgaggcgacattgtgaagttctgcggccttctcctctccgtacgaggcgtccacgtggaataagtgccttgcaccgcatgccaacagagctttaagaagcataggttcctcaagtgcatgaaatggaagaatatgcgtgaactatggaaataagcgactgatgaccacgtcgcaaggatcgacaacttacatgtttcaccgcatccatcgaatccatccatagcccaacctcttcaacaaatacctgtagcaggtaaacttcttctgggttattgagacaagtgtggtttgtagcattgatatgaccttccttcgtggacctgaaaggggcgaatgatgcattctggtcgtaaaaggcaggggcatttgttgggccgttaaacggtcctcccagactcccagactggggggtcccgaagccatgtacgaacgaggcactcagactaggagtcagacaaggccctgtcgcattccccttctccaacgaaggttccgccacttcggggggatatctctcaaacccacccacgtattcagacgctataagccgcgactcatctcgaaaggtcacgccagtcgctggtatacggactacgcagtgcgggggcgtcgatttctggatatctatgaagtttaagcggattccacgcctgcatactctgcccgacttccggcaattctggcatcggtgcaaagcctcatcgcacttcaggtgacgttcccgacatgtcaagcatcctgtccgcactcgcctcggctttgcgaggacaatcttgctttttcgcttggcggctgacgggcgcggtgcgtccagcgatgtgctgtttggagttgacactccgccctcatcggagggactcgtgtcttgtgtgatggcttcggtcgtgacagccaaattattttcatcaagatcaaactcaagtatatcggtgatttgccctgaagctgtcagatccagtgagagatccaggtccgacgggacagagacatggtcgccgagagctgaagccatctcaggctgcttcgatcaaggatgacccgtcaagcctgaaccacaatgtatcctcccagtcttgggttatgatcatcagcaaaccccaaattcagcccccgaaactgtcactcccgagcattctgccaaccacaagatctatagcgccgtccggcttcctaacgcagcaccacttcacatagatattcggggccgataagatgaatgacgtagctgacagggatggcagataataatcgaagatttgcgcacgatgctaaggttattaaggtgacaccgaaaattaaatgcataggcaccggtatctggaagcgatctaacagttgttgatctgtgcaagaacgatgttagcttatgtttgatagtatgcaatatctcgcaggcacagtcataccttagggattaacagaagaagagacaataaaatgtcagcaatcaactcacacaaacatgcggcaatagagagaaaccggggagtctcaaaagatccgcggggaatcgtgactccgggtcggagacactagtcccagaatggtctagggcgacagatcaataccgcggcagaacaaagaagcgatacggttaatcggtcccgctcaattattttatttcagtctctacgtgatgtggtgtctttcacggattcgtattttcacttataaatttctttgcaaactaatcaagtctctttataatagcgctcgcaatttttggtccagcattacctttatccataacttttgggcattgggtcgtaaatcaatgaggtcttcagcaacatgctgttcaaaatgacagctgcaagagaggtatctgttatcgccgtctacattcgttcggtcaataccatgtactgtagcatatcagcagctcatgttctcatgctttggttcccaatttggggactcggactcgaaggtgcagaaggagcataagagcaccccagatggcagcagagaagaaagtagcgcgaagggcagcagcatacgctccgattactagtcaaggatttagtgtcattaacttccacgggtacatataatcgagacttaccttgttgctgatgcattgaatcaagtttcgcgattgcttggacggatttgcgaacaaggaggataacaccctccttgttgggtccggtgaccatctcttcaagttgatacacgagggtgttctggaaaatccaactgctcgttgcgacacccatcaccgatccgaggtttctccacaaacccaaggtcgtcgtggccacagcctggtcctcttgatcagtagtggcaagaaccgacaccattagcgaggggaaagagcatccttgtccgagactggagagcgaaacgcaaaccatcgcaagccaatcaggcgtaccaacgctcatggaagcggcagcgcaaccacccagcagtagaaagatgtcaccaaagatgatggttggcttaagccgtttagtccaagtgatgatgaagcctgttgagacactggaaattgtcaccgcaagagttgagccaattagcctgagacctgagtcagtcggggtagctagtttgactgcctgaaaatacagaggcgcattgaagaccatggtgttaacggagatggcgccgaagaagtttccaaagatgaggctggcgcgaggctcctgtaccaataacgagattggcatcactccccgctccacggtccgctcatagcgaacaaaaacaacagctaagatgagagatgagatcaaggacgtgataacaatggggtgagaccagctcaacacattaccacccaggtttagtcccataatcagtgaagtcacaccgacgacaagtatgagtgagcccacaagatcaatgctcttgaggagctgcgtcaaactcttcctctctgttttcgccctcttcaggcccaagtcggcaggggttgtccaagctgccacgatgaagtaaacaaagatgaagggcaattgcacgaggaacgcacctctccaccccacttggtcgcacaggaacccgccaaacgccaaaccaaggcagccaccaatacccagacagagattgatgtaggactggtagacgcctcggtattcgaggcgtactaaatcactggagagaatcatacccatggagaatacgccaccggctccgagtccgcaaaatgctcgagcagcgatgaagctgaacatactctgggcggctgcacaccatgccgtagtgacgaaaaagatggcaatggcgaaaagatacactggcttccttccaaatgtgtcagaaatgcgtccgaacagcgggaggaaagcggtagacgtcaataggaatgccgtcgacagccaagatgcggagttcgaggcgtggaagtaggaggttataacagggtgactcgaagccatcaacgtggagtcaaaaaatccgatcacgtatcccatcaagataccagagaagataagccagaatctcatcggtgagacattgatgaaacgtgaagcatagccagtaggctcaccggcaactccatcttcggcatccccgggcacttgtttctggctcacgggggcagaagggagtctctcgaggttaggttcaatttcgagcccctgggggattgaggtgactctagagagactaagtatcgcagggtcctcttcgggggcgaagatggttgaggacaggcttggatcgacatccttatctacagtcgtatcgtcttgacttgtatataatgattgacgagatgactcatgcagcaatggcgtagactcagtagcagggagaaatgatggtggctttccatctgttgtatggggagaagtcataatcggagtagatgcggtgaaagaaattgtatcaaatgatcactctaaaatacgacttttgttggatagaacttaaagatcatgaaacatagtatatggagccgaatatttccactgaagttctgttcatacaaagaaggaaaaaaagatagttgagaagagaaaggaaagggagcagtctacaaggggaggtgtaattcagtcggggagactggctgagacaaattttatagagggattttctggtctgcggcactaaagaatgcacgctgcggcacggtggattccctcccgcacggaactatggatatgactcgactcggtcagcctttgcctcctggaccttattgcgcggaaagaccaacccattctccaccgatttggacggctgcattggttggttcagaggcatgaggagcccaaaattttgacatacgtacccgtcaaagttcttcaagtctcatggtagatagatatgaagtgaagtcaacaaaccctggaagctgatttgataagcgcagttagcggcattgctgcctccaacccctcatcttctagtatgcatttagtatgcatgtggacaggatccttcttgatgcacgcaaatgagtgtctcgctcgtgctgcgatttcggcccactcccagaatatcacgtgtaatcactcttgctgattggttcaactgcagtcatcggaccccatgccgtgtatgcaccctgcagagtctaacctgaataggaatgggggccctcagagcgataccggcagagtacatctcggtaaggcatcaataccgagtggactacttagtacctactaacttatctatgggggtgcagtagtcgcctgtgtcatctgcggagctgatggcgtgcgaactgtcaggcccaggtaccatcttctatctaccaatgagtacttttctcttatggcattcaacggacaactagccgagctcgatcgttttccgaagccaaggatgagttatttcttttgagacagatgaagagaaaccaccggtactgcgcaagtcaacagatcagccttagcagatgacacagtgccgtatgcacgcagcttgcatgttcagtaaatgctgctgaaagaaccctgccacattgcaccgactagttgcagggttcaatcccgactgcatggtgtgtgcaactcgatattttgtagtcgtctctgcccaatgcttgaacaagatttactcttcaactatccaatcacctccaatcaagaagcaagttccatccggtggccgctttgctatgacatcctccccgcatcaagatgcatgatcagccactactttgctagatgttagtcaatgccatcctatcaggtgcaccgtgtatactccttatcaaggacactgcatggtctttgagagattttcaagagagacatagaacctcatgagaagagtctggatggtttcggtccgagcgggaggcacatccgaaggaggtggcgggactaccttctgataaccagactagcgcattcgataagagcagccaacggtgattcatacaaccatattacctgtccaggccaccatttccgacacagtcattgcgcataactaacaagcagatcaaaccataatctgcaaacagcttgcattgcagataagtaagtagcagcttttcaacccgctcctgcagctgctttcctctccggaacccgtcttcgaatcaccgaattacccctccctccaccaccatgcccccgcttcgtatcgccatccttgaatgcgacaccccagtcgaaaaagtaaacaacaaatatggaggctatcgcggcgtattctcactcctgctgcgtgaaagtgctgcagcactaggacaacccgataagctagacccagaaaccggcctcgagtttagcggctgggacgtggtaactgcgcaagagtaccccaacctggaggatgtagacgcaattgttttgtccgggtcaagtgagttagctacctacccttcgtgctcttccttaattcccgcgcaccgtgcagcatgcacttcctctgcaaggcgcgccctgtgactcacattgtctcctagaacacgattcctttgaggaccacccttggatcctcaagctggttgaattcaccaaaaaagctttcgaagacaagcgcgttaagattttcgctatttgcttcggccatcagatcctggcacgtgcgcttggcgccagagttggtcgcaacactgcaggatgggaacttgcagtgtgtgaggtggacttgactgagacggggaaggagttgttcgggagggataagcttgtatgtctaccatccttctctccgtcaccagggcatgcatatagcttttatgtgtatgggttctatgctgacaaagtatgtttacagcgcattcatcaaatgcaccaggatattgcgtacgggtacccatccgaggtcatctccctgggcgcttccccgaggtgtgcagtacagggcatgtatgtccctgggaagttgatctctgtccagggccatccggaattcagagaagacatcatgaccgagatccttactttgcggactgcggctggtatcttctcgaaagaacaatcagaagatgcctttaatcgcgcaggcatcccacacgacggcattgcgattaccatggccttcttgaagcttctgatttgaatagacctgaacatatagagcgacattttactttgctgccaggactggctgagatacctccatagctaacaatactttgggtacccgctgaaattcagctccagcgacgcatataactagacagatcaagaatagatgtcttttatccactaaagatgcaaatggttaaaaccgcaaacccaagcgcatctagccagatgaccataaacgatgggtatagagcgacctatatataatcagagacaccgaaatcaaatcagaccccacagatcctataccgatccgcaataaaaccatcaccgaaatgcaaacgcttaaaattgacaaaccctccgaagcaacaatatcccagtaaaacaatcacaccccaatacctgcactatatcaccccgtagccgacggatcctccctctccaaaaacgtcgggtccatctccaccttcctctcaaacttcgtccaccaatcacgaaaagtcttcaacggaacagtttcctgtcctctattgctcggatcctccgacgcaaagctcgccaggaaattgaacgcattcccaataatcctctgcgccagcaccttcgtagtaatttccttctgctgtcgtgtatgtcgcaccaactctaacgacgaccccgcgccgccagcttgttccgcctccagcgcagcgatctgtggtgcaacagcttgaacaggttcaagcgagatccccagcgttaccattggtgctgcgcccgccatcgcattgccattctgtagtcctgggatttgcggggcctgcactttaaggatcgcagatggtctctcattcgctagcgcaccgataaatttgaactggggtgcgttgttagggtcggggaattggatgtagatagcagcggcggtatcgggcgggaggacggtgccggggagaaagaagacgacaagttcggtgagtttgggcggaagggggaaattgaaggcgaatttggtggtttggccgtttggttgtgtctcgactgcgacgatgtctgtcaggcagggatggtctggtatgatgacggagaacatggtgcgcaattggcagtgaggagggggatgacgaaattaagactgttgtattgtatagagcatgtagattggatctcgatgtggtgggatagtaatcttaatgtgtattgttatagctggactagaacagccggagagaattgcgacgcatggcttaaaagggtcctaaagcttccggaggcggagaagagctagctagccagcttttgaagaatttcctggcgcgttccatgatggaatctcaaagaaagactcggtgacgaaatggccgtctattgcccttatcgataagggttccctcccgcgtctaggctggttgaactcttccagttggcagagggggggcatccccgcggctaagtttataattattattattggtgactcaccagcctacaggacttgtgtatatacgtctttcgttaagattgttcttttagcatcatgggcaagtcaaatcttgagctggttattgagtgcgataggtaattattatcccatatcctttgtcccgatcgcttgggttctaatcgtcagatccgcatggcagatttccgtactaccaagatggccccgcttcttatattgagcacctgaagaattatcatgttttcaaggtcgccggttgcgatgccattctcggttatatcctgaactcgacagtagagaggttcgacttgccctcggaatggtgggcgactgattccgacaaccggagcgtcaccctcctggctccggctgacgcgactcctcaacagcgcagcgagatcatggccaagacgttgagtaaggcagtggagttgggaacatttgacattctcaagggttggcgcaatgaaatgtatcctatctatggacccggcggtaaatttctcctggaaatggaacgatctgctaccccgctgtttggtgtcgtttcgtacggcgtgcactcgaccgtttacgtggaagacgagaatggtctacgcatctgggttcccaggcgctcgaaaaccaagcagacataccccggtatgcttgataactccgtggcgggtggaatgagcaccacggagcacccgtttgaatgccttgttcgcgaggcgatggaggaagcttccctgccggaggacgttgtcagagctaatgccactccagcgggatgtgtcacgtacacgtatgtccggagtgcaaaggctggaggcgaaacagacctggtgcagccggaggtcgagtatattttcgatgtcaaggtcggggcggatattatccccaagccttgcgacactgaagtcgaggagttcaatcttttcactatcgaagagacgaagaaggcactggctaatggggagttcaagcccaactgtgccgttgtcttgattgacttcttcattagacatggtattttgacaccagagaacgagccggactaccttgagatcatcgcacggatgcatcggcgcttggagttcccgactgcatcacacgtgacggtataacctacaactgactcgcatatatggaatcagaaatgtggtgtgaagcaatatttaatgttctatttgatataccctatcaccaatcaaacgccggcgctgcaatcaaagtaccccaagcatgcaaaagacttttctgactatccaagacagaacgggccaacgccttagactttctggacactatatgtgatggtcgtgaaagtttcttttttctatttcttcaggagcagatacacgtagtcgatcctcaagggggccaacttcttgtaaggaccttcgaggtaaagcaaaagtccaccgaaagagatgaaaacggccctagacacgatttagtcagttgttgatcgataataatctcggtcacatcgcgaagtccgcaacagaccgcgatacgtgacacaggaaatcttacatgttaccctgactcgaaccctcctcgaagcggtaaaccttgccgtggcagacataatcgtagtcgttggccaaggtctgctcgcccattccaacctctctccagcccttcgatccggagtcatccttgccatccagagaaagcgtcgaggccagagccatgttcacagactcgccaacgacgcaagggtaaagctcggagttgacatcgagggtgaagtgcgagagggtatcagtggagttgcagctcagacgcgaaacacggtcatatttctgggagttgatggtggtgattgtgaaggtgtcttcgaaaagtaccgggtcggacatggttgcggcggtggctttgagcgttcaattgaatcgcaaaatgaatgagatgcaggcgtttatgcgaaagacggtattcggggaggaacaagacgtgcgctggcaacaagaggcgtggtggtcgtggtagcgccagaaggtgaaagcgaagagtcgagggcggacagcttttttgctcgacttttagcgcggcgccgcttttactttccgggagctgccccgcagcaaatcttcaaagtattccgttcggttcactgctttcaatcactctaccaccttacacgatgtcttttcgcaagagaaatattggactttcggcaggcgctgatcgcaccggtgccgttaatgctaacgcacagccgcaacagccttctgcgacgccagaattgactcccggagttcgcccctcccccgacgacgggcgcccgactacttcgactggtactccgtcgctggataaccttctggctgggcatggaggtcttcccatcgggaagacactgctgattgaggagaatggaactacggattttgctggtgcactgctaagatactatgcggcagagggtgttgtgcaagatcaaaagattcatatcgtgggaatgcctgaacaatggggaagaagtcttccgggcttgttaggccctgctgatgctattgatgacaagcaagacaaacggaaaggcgagcgcatgaagatcgcttggcgatacgagcgtctgggcgagttcggagcaggaattgctggttcaagaggtatactatcttgtcatattgtcactgtgagagtttagaggtagtgtgctaacagacacgattctgcagcgccctcaggagaccagagccaatctgccgcagacccaaacgtggacaagcgaccagcattctgccatgcgtttgacctcacgaaacgtctcactcacccatccatagccaacctgaactatatacccctcgcgccatcgaacgagcctttgtttgtgtcgattcacaaacgtcttcaagctgcaattgcctcttgcccgccaaatactgtccatcgcatcctcatcccttcgttattaaatcccacgatatacccacccgattcctgccagcccgacaaccttctaccgttcctacactccctcagggctttgatgagcgcgcagggcgcacgggtgacggcgatgatcactctgcccttgtcccttttcccccgcgccacgggacttgtgcgatggatggaattgttgagtgacggtgtcattgaattgtgtcccttcccgcactcttctgatgctctcgcaacctcgggtgccgctacttcacaggaggaaccaccacagggcatgctgaaggtccatcgactaccagtactgcacgaacgtggcggtggtagcgatcagaacatcggacaggattgggctttcacgctgagccggaagaagttcgaaatcaagccgttcagcttaccgccagctgaaggagacaaggaggggcaggatgcagcggtaacgggtggaatgccaaagaaggcggatcttgagttctaagttgcacgaagggtggaacagccaaaaccagaccacaatcactcctcgtgatccgaatcgtccaacatattctgcagctcgatctgctcggacatagcggacccagtgttgaccattgatcggaggtagtgtctcccatatgagtcaagtccaggtccggcaggtgatgctgagaaataagtccgaagacgaggtgcgatgaatttcgagaagcctagatatgcttcgagctgtcagcggcttgtcagtggagatgggcgagccggtggtacctaagagtagcagaaagggtgcaaagaacaccataaaaagtaggaacaagaagctcattctgtcttagggtggcaatctagtcacttgaacagcttccgataatgattatacggatcttatcatctagtggtagctttcacgaatctccgaagagcatcaactctcccacattctatgactaagcaccaataatgccactagcttcaataggaaaggcgtgatttccgcgcagctctttaagagcttccaccccaccgaatattttttctcgcttccatcctcatcgctcattcaacgacaatctggatttgctggccaagtccacgagcatcatttctcaattcgatactctataatgctgagttgtattgatggtaagcaactgtccctttcttccgcgtcaattgttcttgcttgcatgattatacaaatactataatctgtcaatcccctgaagctcaactaaaaaatctcattaaaacgagcatatgtgattgagaaacgtatcgaaaatgattagcattttcttgcgctttatgtttcatccatacatgtcatggaagctgaacgctaacgttcattcagtcgcaccagatcccttgataaattgaattgcccttagtcgctaaaatggatatcgaacccacccttcctattccgatctcgtatattgggggtagctactttctcttctcaattgatgcagttacgtatgtgagacgcgagtatcacatttgcggcgtcttaagcggcacattgcctcaaatcccacaacagaatgtcttcctgggcttgccattgaagctaatgccggaagaggcccggttgctcgtggagaaaggtgtagcatgcattgtagacgaggtaaaagtccaaaaggacggaatgcgagccctcatggaggaggatcgcaagaagtatctccgtgagctagaatctcaaggccagcatgctatgcgactacagaacgaccggaaggagcagcaacgcgagaaggctttaaagaaaatagaagaaaagaaggccgcaaaggccaaaaagtctgctgaaaggcagcaggagcagcagcctgcccctcttaataatgaggctgctgctcaagacccggttgttgacttgttcgcaaatgaccaggagggtactggcgaaatgtcgcgccgttcttcgactgccactgctgctccctttggcactgtcatgggagtcacgcctgctacatcttatccgcctcttccgtatgagtggtctgctgagcaacagctaccgcttcctgatgtgccttcctcatacccattattcgctcaccttcattccgaaggatacttcttatcccctgggttgcgattcgggtgtcagtatcttgcctatcccggtgatcctttacggttccattcacacttcctgagtgtgtctgctgactgggatgaggagttggatttgatgagcatcgttgccggtggtcgactaggtactggtgtgaagaagggtttcttgattggaggagctgagaagaagatcgagggctcggatgctggagaccccagtagtgtgaggactttcagcattgaatggggtggaatgtgatgtggactgttttcgacgtccttttcggtcttcattggtcgtctcctgagctaagcagcgcatgtcgcgcgcgcaccgcttgcagcatatgcctgatagctgcttgcctcagtggaacagaagcgtaacgtcaaaagcagttgtgcggcgttgcgcattaccttcatgcgctctcaagtctggcagaaatgcatacgggcttgattgcagcagccattcatcggtacagctagtagagctgttatctggcaaggctaaacaaactggtctacagctgtcgaattctccagcagacaccccaggcagcacagtccgacatacaggactttgatcgatctcactccagcgttgaagatccctgccatgggtaaactacaaagatgagatcaaatcgaaacatatcatcaactatacattctttattattccggcgtacacttcctgtaatagctaccgtatcaaaagggtcccggcctcttttgcacaaagggcgtgtctcaagcctgatatcctgctggaccaaattggcatggcagtctgtcttggttcgctccaaggactcgagagcaaggctcgctcacatggtagaagaggatcatcaatcctcccatcaaatatcaggtgccagtgcgaggctgaataatgcctcgtgccttcgtaggaggtgctcccttatagggatcaccatatgggaatgaaatctccatagcacgtgcctgcttgatgtgaagcctccgtcaaacatgctgcagacggagcgatctcgatgctgcgtcccctggcgcgtcagccttgagtagtctaccacggctatggtcagactgaattagtggatccaagctctgcaggatagtctcccttgaccgttcactcgtgcagtccactttaaacgatcgagcgatcgttgccatatgaatcttccatcttctcaacagcttagatataatccacattccgccatttgaatttcttgttcgccctgtcaaccggacgattctggaactgactgccatggagctcaaacacgagctccttcttagcagaatcagcgctcgtctccccagtcaccgccgcgccatcagcatcatccgcctcaggcaaaggcacactaaaccggaaaatagtctgctccttcggaatagctagattcacacccacattagcaacacacaaaccaaacctcatcaagaaaaagaataaaacatactcttaacctcatcccccctcgtaacaaccacaaacgtaaacttcgtatccctaaccacaatccccttaaccccgaccctcccctcacaccgactccttacaacctccacctccgcgccatgaaaatccgcactggagagcttactcccatgcgacaacggtgtcatcggcggcttgaatttctttgcccccaagtctagcatatcctgcatataccgcacccacatggcatgcagctcctggaaaaccgcatacttgcattcttccttggggaggttgtagaggcccgaggcgcgcttctgacgcgcggataaaggctgcggcttttgtttgcggaggaaatactctttcttgcggaggcgatggaggcgccggcgcgagcggttgtcggcgggcgttggggacgtgggacgcacgtagagaggcttttgttttatgcgctcggtgaagagttgcgaggctgtgtcgggggagtgcgcgcgcgagaggagcgtgtgtgcgatgtggggtttgggggttgtcattttttccgaatcccttcctgtgcaatggggtggatatgttgagggtttgttggacggaggtatggagtggtggtttggtggtggtggtgacgatgtgatggtgttggaaatttggtggttatcggttcctgataagatcacatgctgattgggttggggtccactggcttgcgacgtatgcaaagtcctgcatctatcatccactcaacgatagtcgattcttatacgattccttccgctgatatggcttgtttagagtctaagttttgtcaattaagggaagttcatgagatttaagtgatttcccacaccagctgtgacatgatgtagctaaatcggggcatcgcccacgactcgattggtacagactatagctcaattctgacgatattatagtgattgctaatctgaagacgactttctgcatcagagctactataaattttctcaaattggctcaccaaccggattccacgcatataaagccctagcatttggttcttgtctgccgccggcgtttgcacaatattaagcgatgcagcaaagaaaccctcggatatagataaatagcacgatgtaccgctcatataacaaattagctctgactcaaagcaaacatatgctggtatgtctggaagtctggtctcttcgcttgcatcacattatggttgccgattagttatccctcggcataaatgtcttccccgcatgtcacttactatatatactgagtgtcgagctaagacaatactgccagaggttacagccaacatcatctactaccacaatgtccgaaaccaacaatttacctccattcccatccgacattcccacagctcctctcctccgtctttcactttccaaactacaagcccacgatatcacggaaacccacaacctcctacaagcctgcaaagacatcggcttcttctacctcgatctccgcgattcaaacgagggcaccaacctgctcaacaacgcagacaagctattcccaataggcgagcgcctattcgacctacccctagacgagaaaaagaaatacgacctcgccagccagaaatcctattatggatacaaagcgcaaggtgccatggtagcagacagacagggcaatctagacgggaatgagttctacaatgtccctatcccccattataccatcctacaatccaaccacatactaacacccacatgcaggtctccaaagacgatatcctgaacatcgctccctctctcccatccccaccaatcctacaggaatcccgtccccttctcgaatcattcgtccgaacctcccacgacatcgtgactctccttctctcaatcctaagcgatagcctttctcttcctacatctaccctgcccgacctccaccgtctaaccgccccaagcggtgaccaaatccgcttcatcaaggccccccctaccgctactcagaaccccacactaggcgaacacaccgacttcggcagcgtcaccatcctcttcaaccgtatcggaggcctgcaagtcctccctcccggagcggacgcagaatggacgtacgtgcgtccgctatccggccatgctattatcaacctaggtgatgcaatggtgaagttcactaacgggctgtttcgatcgaatatccatcgggtggttgcgccgccgggacagcaggcgggttgcacgcggtatagtctggtgtattttgcgaggccggaggatgaggttcctttgcggcggttggagtcggataggattccggcgttgggggagggggtggttgaggaggagattagtagtaaggattgggtgataagnagggcgttagggaggagggtggatttggggccggtggactatgagaaggcggctgggacggagggggtgagtaggaggttgagagtctagtcggataattgtgctctgcttttatagtaattcgtgcgattaatatacaatgacttatgtccctgatattgctgtccacaggaatgtcgttacgcacggagaggggcttttacactattattgatagtttggctaatctatgaccgagtagactgtaaggtcacgccgatcacaagtagccgcctaaaggtatatcttgtgtcagtagtaccagtaattggtaaccagagcctcggtaggattacgaattcttcccccttcataagatcaaaacttttaccatgcaattagacatcaggaccacaaaataagttggtagactacttctttactcaaaatcatcaggaaattcatcctcatcatcatatggcaggccatgtatgtccgacatgccgcgcccagtagtttctggagtcctctgcatccggtgcctctgaggcgattggaaggccaattcatcaaattcgtcatgtctaccagcttgccactgatgatggacattggcggttcgaggagcgcctcctccaccagagctacttatgagatcatttgctcggccaccgccgcgacgtcggtttctcggaggcgacgtgatctcctccggagcccgaatcgatgggctatagttggaagatactctgtacaagtcccgatcggctggcatattggacggccagtcgtctaatcgtaggcgttcaacaaaagcccgatgcgccatgtcagctccgaggacccgcgagacgtagtcgtagaattccttggatgcagctgctacttgctggacgtgcttaacctgcaggaacaccggcttggacgtttcttcggcctcgaattccgccagcgcgatggcagtttggcatccgttgcggatctgtcgcccgttccagcgcgttctggatttactgttctgctcccagtttgcatcagcccactccaggatggggtccatgtcgatggtcaatgacgtctttcgcgctttggctttttccaaattcatttcccagatggcgtggttctggcctttgttgagcccggggtagtagagggccaggtggatgcgagagacgaaggcttcatcgaaggagcccactcgattggtggtgaggaacaataagcctttgtagtattctagtactcgcaagaacactttcgttcgcaaggtcagtaagattgagaggccctgtcaaatgaaggcgaacactcacctgaaacaattgcatttctttccaactccgttttgctgcgcgccgcaaggaagacatcggcttcatccagtagcaggacgcaattccacgcctcagcctgggcggatatacgatttagcttgtcttccactacttccgcgcttgttcccaagtcaccgcaggtgatcggatacagtggtctttcaagccaagccgccatacattcagcagtcgacgtcttgcctacacccggctcaccgtggagcaagatgataaggccttctccttttcctctgaccacatcaggatcaacttgctggctttctccgtcctctttcgacttcctatctgaaaaatggcgcttcacctgtgcgtagagcattcttttgtgaccaggccgcaatttgagattcttccagccatcgtcagtaggaacaggacgcatgcgttcgagatcgcaaagtgcccaccgacggcgatgaagatcccatgcgcaagcacggtcgggcatcataacaagctcatcatcgctccacacttccttcctggttacttgctgttctggggcagattcttggcgagccaggaaggcatcatcgcgaatgaagtccttggttaactctacatccacccagtcgtcgtcgtagatcgcttcggaaaaagatcgaatatagtccttagtctcacggttcgctagcactcggacatacaaagtttctgaacttcacttcctgttcctcccatggtactgggaattgacaagctgggcacccactcctggtcttcgttgcgggctgttttgaaatcaacaatgatattaccctttatgtagtcggtccgcctgttaaaactccccgggcaggatgcgccatccacatgacacgttagggtggatcctgaatagaaacgatgttgtggggtggcgaaagtagcaaagagctcgccttgcttcaacaacttatcgcgcagcgcttggtagtcgtccacaaatcgagtcgggactatccccaaagaccgaatcgagcgctctccactgaagtgaggaagatggaagtctcgtgaaagcacaccgaaccgctccccatcatatccaatcttataaagtcgaatgataaaatgattaacccttccagagtagttggagttcaagactggtcgtccttcagagacctgcagtactttccaaatacttggacgattggttggctggacatgtggtgcactttgctccggagtgaaccaacaagccacctgcatacctgggtggaataggtaccatagattgctgaaagagattgttgggtcaagtgtcgatgggcttggagcgaagttatctagtagagcacgatgacggcttattaccggactgagatgacgatccatgaaactgacaaggcagtcgagtgcgcgaaaggcttgacgagaatcaattggctctttacctggctctagaagtgtagggtcatcgagctcctcatgcccactccctattcgccatttagctgcgagctgtcgatgccgctcgcgtatctcctggtcgtatccgacgagtattttgtatgggcgtaacacgacaaacggggcagactgatcaattcgggaaacaatatccttcagaagggacgctagaagactggagttaattcgaatacgctctgggagatcgtcttcggcgccaccggtatctgttttgggctttgggtctccttctgatgtattttcgccctcctcacccctgatcagggcaaagtcaccgaagcgacggatgattctttcggtttgttgccagcagtactgcgcagggccttccaagacgtcgatgacatgacgtttttcctcggcgtacatcgtcttgaactcattccatttcacgtaacggagatccataataacatcatcggagtcatcacaagggtaatgcttgggttcttcgtcctctgcatcgctggatgtagagtcatcacgactgtggtcgttatcacccttatcgtttgcagctttctcggttatcttagcattgctttgttcgagactttgaattctcgcgcgaaggtcctgcaactctttcaacaactccacagcggagtcgtggctcgaattcttcgtaggagtatcgaccgggattgccactatcggctcttcagtgatggtcgccatgtttgaattaataattccaggtatgaactagatcgactggcgagcgtttctgaaaaataaagagatcacattgaagggcaaagaccatgatttgaaaacggctcttctgagtgtgactttatacgcatgtaggctcagcacacgtctattgagacagttgagaggagacgtgcgttcaggccaggaaagacatagtattgcataccatccagaacgaagcttatcgtagttcggaccctcggaaatgaagttggcgaatgaaaggctgaggattgacagtcaacacgaactatccctgcccggagtcggagtctcgggctaccgtgcatgaactacatggcgagaccgtgtccaatatgcaacgctcgttcagcttcatgggatggcgttcttcatgtgccctcagtgcatgagacagacagaatacagccactcccaaatgagcagagctgagagtggctggctgaaagacctggagatggcatctggcaccagtaacagcgtgggaaatcccgcaagtgcacggcttccccgcctgtaagaccgcatggagggatccatctgcacgtcagcgtatctatagcagtagggaatgctctcgtatatctccgcgggccggactccgcttgctaatcagtttgaccttgttgtacggataagtccgtggatacgtagagttccagccactcgaatgtcaatgaaggctgaagatgtcaggccgaaagtctcgtgtatggcatccatccaatgcgtttgacagcgtgaaaaatgccacaagcacgagattcacccgcctataggccagcagggaagtgattcggctgcacctatctttgtgcgctggactatgtgtgctagccaacctagcttgatcacgcgggagccatgaatagatgggtaagacggctgaggcccacacgcatatctaccatggtggatcggataacagaggcaatggtagctctgagaagaacagtaagaaccatcataatcgcaagcaagaatggagccgtctttgatgcctagaatgactccggagcaagaaactcacatggcaaaaagctggcttagaggacatagccaccgactccggttgccgctttccaacaggagccagccacagccatcagcccaaatcgatcttgcggacacccggcaagaacttgatgaagagtgaggcaatatagtgctcctgtcttaccaggttctgatccttctataatagtgtcgacgaggtagatgagttctgccaagttatccaatgctattcgaacgagacaaagggtactagtgagtatggcgatggccacggtggggggaggtttgatatatatggcgcgcacagctggaaagaggtggttaatattgtccaagcggtcgagaaagactacaatcacagcgccactggctggaaagggcttgctagaagggcctttcgcaagctcggtgagcatgcagaggatttcaacccttggctggacctcttgccggatgacaagtattttagcattgcttgtggcgggctcaagatagtccttggtgttagtacactccgtgtcactggcttcgtgcatactgattgaagtagatggcagcgcgaagaagcgaacagcgggaagccattcttgcattcttcgctgaaattccagatatcattttctggaccgaccgttaccattctcttttccaggacgaggagggattgaagacctacctgtacgagttttatctggctctcctcgccagaattcaaggcacgattgcagcgttggtggatgtatcactgtgtaggtgttggcttctagctgcagcggatatgacaccaatacagtcccgtactaacatgcgcgcttgaaatcagggaggaagattatttctggtctgagggtcaaaaatgcagacaaatcgcttggacacgtcaaccaacgcttcatgcgggccaggactcagctcgacaaacatctccagttcgtgcgcgatcggctgcaggtagatacaaaccagggggtagtttatatcaagcctatcgtggacaaccttgcaacagagcaggaaatagtaatccagcaaaactcagatctggggaattacgtgcgtgggtttcgccacgaggtcatgactcggctggaaaggcagttaaacaatccatcgagcaatttcgcggagcagatgcagcaggtcctccggaatgagttgcagaaagcgcagtgtaggttctctcagtgccacttatcttcaacttaggcattgaccttgcacttcagggcagataaaccaggaaaacatgcaacgagagagtcgacagtggcagattacgcgccaagggtatcccagaagcgacctatacttcttccttcgtttgaatgagcaggatgtgcgacagcagtttatccaagatctcgatgatactggccgtgatggtcaggatattgatatggctgctcaaacccacgctcagcagcttctccgtatgccgcgattccaagattggatccgttccgaccagccagacatgctccacgtcgacgggaattgtgacaactatgcaatggcgagatgttctccattcagcctcctttgctgtgtgcttgtccacgagctactacagcaagcgcattgccaagttctgttcttcttctgtggattgcacaatctggccggggagcccatggcagggcctgtcggtcttgtcaaatcgcttatcatacaactgcttctggatacagacggccattatgatctccttttcctgacctttgggcggagggaagaagcgttgtatcacaatgaccttcccaccctctgtgagacattgagggaaatgctaatccagaaccgctcctctgctcttttctgcattgtcgacggtgcttcgttattcgaggtgcgagaatggcgtgaagagatggagtatgttgtccagcgattattcagcctaacgattgatccggacattgcaacggcgttcaaggtacttattacgagcccaggtattagtcggctcgccagtggtgtgcctcaagcgtgtcgcgtgtatgtgtcagaaaccaacgagaggatttcagacgcaggcttccgcaacccagaggcattttgggacgaagttgatcgccgtcgagaagacatggcagacactgcaggaagatatgaggtcaatccatacgaggcaatgtacaaggtggatatgtacagtgaggaatatgagtagcgaagtctacctctttccgaaaagagaaggtgtaacgcaagaatagttcgggttagtcgtggtagtactagtaattggcaatgctgaggaatcatggtatcaacaaaaatttcagcgcatgtcatttgttgtagccttgaaatataatacagttgagatcatcagaagttttgagtcatacttacacaatccttcgggctactgtgttgataacaagcatatccaacgtttccacacgaatatgacgacatagtgctacgtgcattttttccgcttcttgccagccattaaatccttaccaacacaaccgaataagtccgactggctattaatacctcaatatggctacttacatcataaacaaaaaggcaagaaatataacaaaacaaaattggtaaaataacacaatacgccgacctaacataccagcaagtcctcccttcgtaagtgctgcctacctgcctatccgccaagaaggcaacgatgcatatgcactgcatgcacgcaccaaaggaatgagtcagaaaaaaagaaaaattaaatccagtccactggcacatctttttcatttctttttctcacagggatgaattcttattcggttccggcctgttgggtcgccatacatggaaactcaggctcaaattgatcatccgagtttttgttttgtttttctttgtttctttgcttttgtggaagtttgatgctcggctcggtcaatacataacatataacttaatagtcaaaagtgccagtggctggggtcgggggttcggtcttggttgcttacttgagaggggtgcgttgactggcttgttgtctttgcttgattgtcagtcttataatgtaactatcctatatcacagggtgtgtagtggatcatgtagtcttgctagtatatagaatgacacgataagagctcaatcacgtatcgattgtcaagatgcctagagcagcatttagattgacggtaaacaataactttcctcattttattccctcgaaaatataccagatcacccaccatgagatttacaaggatcacccatcccaagtaaccctgacccgacatgccaagaaaatgatctatgcaatgcctggattgccctgtttctggctggtgcagtcagtcagtcagttgacaaatcgcgaggtacagcagtcaagtagggcggctgcaagagaacccttccaccggagcggtgatgattctttcaagcaagcaagcagcctgtaaattatgcgagggtaagcgaggaaaaagcaaaaatggatggggatgacgcaagacggcaggtgggagcggatgtacacaggataaggcttacttaaggatgaggtttgagtaaccattgaaagttcgggtgtttgtcattgagttagtgttttgattgtctttgacttgtttatgaaattgtcagtgtttattgctttatgtgatcttcatacgaggaatgagagtatgtatagatttaccgtggggatggacacactcaagataggttactgttgaacactgcaaattggtactaaaactggattacaatagcgtatgatggacgaaagaaataaagaagatacccgtcccaaggtactcagtagataatccgcaaatctccggcgggtcgtcgacggatcggaccgttcgaaatggcccatggtaactgcactgtaattccatgtatacataaaggtatcatatctacagtagcagaccgataaaatcaccttgtaattagatagataaggcataccatgatcatcaccaggatgatgcttcataactcggatgatcggcgaatatgaaaggagcaagaattacctagccctccttgatcgacgtaagggccagactatcagtatcctcctgaacacaagattgacatcgaggtgatcttaataaagtgatgttacacgagattatcagaaaatccttccgtaagtatacaccggatttgtcaataggtaggtaaatctacgagcgcctccttcccgcctgatctaggcattgttgctttaagaggatgagccgggtgagtcgtcacacttggacagctatactcatcctgcctcttcgtgtcgacaatatctctttagctgcttcatcaagaatgtcaagatgtcgcgtcaagaggcaaaatcatgtagcataatatcctacttagccttcgagcagttcagtccacgatcagccaatatagattcgattcgctccaacatcaatgaaaagtggttgtcggtttgattcctagacacagaatccctccaactgtctagtagctgtcatcagaagaggagctttgctcgtcacacctagcgttcttcaggtcattgcacagcctatcaactaaacacatagtgttcatcaaatcattgcacagcttatcaacatactgattctcctctcttggaatccatacataacgcacatctcccttctccttcagccggtcactgagaaccactgcttcttcaatgagatctcgatttgctacctcgttccctttacaattcatccatccgttcctgatccacttgtagacccactcttccatacagtcaactgcaaatgccgagtcggagtagatcgtgacatccaaccaagggtcagagtgtagttgatcatatctcttcaaggccatccttagaccgaggataacggatgttatctcagctcgctgattcgtcggagcggtatatgaaggcaagtcttctgttgtctcgccatggaatctgccggacgcgtccttaaaagcagcggctgcagccccgatcgagcctggctgaccgttcggctctacagccaccgtcaacgtgaatcttgatgatgtaaaccatggcggtgatgggtatgtcgggggaggaggcagattaggtctctaactactgcggatacgcgagccttcttgtaggcgcctccaggtttcgaactgctgcctttcagcagcgggtatctccaccagctgtatagcctcaactcccagatgcttgcctggactcccaatgaggtctctagcaaggtggtgcttcaagtgctcagtttcccggcagtttccttgtgttcncgatgcatgtttaaccatcacctctttcagtgccctatgttgtttctcatcaacttatccccaagtattctggcaaatcccaggatagcaacacgagatggccaattacaacgtcacggctactgtacttgcctccattgctgcctcgcagtcacatgagcacgatagtgattacatttaatgtcagtactgttgcaatgtcattccaaacaccacgatactatcttacctcccgcttgccaactactatctcgtcgggttccagcatctctgattccatggtgccaggcttttgcatacaatcattcagttagtcttactgttagatataacacacatggtcaactaagatcgtgggcggtattggcatgaccaagagattaggacgatttctactttgcgttggtgctagttttgttctatcttgaatattatgccactgtactctgttgtctcagtatataaaatgcccccaaagagccatcctcttaatcttacaacctctctagttgctctaccccaaggcatccatcataatcataacccctctcgatccggaattcccccaaagtaatcaccccattcctactcacatgcacccctacaacccccaacaactacgtagtacactcaaaccaccaaatgatcaccacaaaccccaccatccaacgtccatcaccccagaacaggaaacacacctccgaaccagagcactccattcatcgctccgatcccaagtaccgcgtgtagactactactagtacttacgtggaagtggagatcccgttcaaggtattaccaaataaggatagagacattacctaggtagatacgggcagagcagtcaaggataagtagtactttataccttaccgggagtccgtgccaactcacctctgggacagcaacgattacgtagatcgcatccatgaataataacactaaagagctattttatctcctcttcagggactacatcgagtcatgccatgatgtgtcgggaaggaagaaaggaagaatagggagatggggagggggtgagcgaagatcagcattggggatttatcctgttcggggtaagcgtaacggctggtagtctactgcctagttgggaagcaggagggaaggaagtaactagtgtgggtgtgggttgtgggtgtggggatgatatgacagctggaatttgggtttcttgggatttttggattttctgggaggggagatggtggtatttactggtacttttgtagggtgaagggtaaactattagtacaaagtatgtggttaatggatagtatgcttagttaccttgcaactttgtatacaaatgaaataacattcttcatgaaaccgaagcaaacctcacatttgcattgaaactacacaactccatacatacttacatacatacatacatacataccctccccaactataaatactatacgtagtgtatatgagattataataacatcccagcctataaccaccctgcataacaacagcacattgccgaaataagtagtgcctgcttagctgctgctggtggtggtggtggcacaaccctcacatcacaccacgccaaacaacccaaaccaacgggtcacttaaaattccattcccaccactttggactcatccatcccggtgcttaacagaccgtcttatgcatcggcattccgcattgggtccttggcacagcaagactaccgtctacctgcgtatccatgtgggggtggtagtctactactagttatttagactgggtccctactgctagtatctttaggagaaatggaatagatactacctagacatattcttctttgttttgtggtatggaaagttacacagtatctcaaggtacagaggtgaggacgaagacccacttggctgactactttgcattcaagacagctgctgaaaattctctcatttattagttagttaataatggtgtcgactatccaagacaatcttcataagcacttaaaccgactccaacagtttagcagctactagcaccaaacacgatctatctctgatccgtgcatgaacatccgtgttccggccgaatcctctcgttgcgggatttggtcggcgtttgcaaaaaaaaacctatctgcgcgagtcaggggtagaatgtatccagcctcattggcaggtcggaagtatcaaacaatgattttagtacgcaggggctatttatttttttaatttatcggtatcccagtttgctggtaccgggaaattagatctgctttagagggcaatcgggttagtcgacacaccgcgtgagtaagtgtgggcaggtcagatcaggtcaggtcagccggtgtctctacattcatcctcatgcataggaggacgacaaccaagtcgccggagttggacaggataagtacttcccgcccaatgggcagtaacagtcaagccaagagagctttgctgtcacacacgcatatacacgctgttactataggagaattaaccccgtgcatcatgcgatgggcagtcaacttgctggacgaggagacaacgccaaagcgccgggaaccggtcccggccaacatcgtcttgcggggcagtggagctagctgaatatcctggtcctcagggatccagacccccgatgaaaaggatggctggcgtgggatcatagggagactcgccatcagcctggcctcctgaatcctccagggaggataccgttagtcctgctactcccctgaccgtggttattggttgataacggccacttaacatacgcagcggggcgtaccgattcccaccgtggcatttaagttgggaccacaagtggccctggttgacccgtggctttggcctctcccgaccagctggctggctagtggctcctgctcagcttagtttgcaagggtattgtgccacctttcagctcgttcgccacagcgtccaaactaagcataacaagaatattacacaacggagagtaaaccggtcaataatcaggtgccacaaagtaacatcaagattcaaacaatgctaggtccgccaaccatcgttgcatgcccagtgccttgtggcattcgagagctgcaaagggtaaagcttgctgagctgctattcttgtcgtaagaaggtgcgagcacgtaagtgaacagacgcagctttggcaaccggtttgaaaatcctgacttgccatttgcgctgcataacgaagtagattgattgtataccagccaactatctacccagtactgatcctgacttttgccaatcgctcttcaacccgtcgaacaatttcggggtctggtttcggcttgtctctgcgaggtctgggatgtattagcaagtgcgtgggtcaccttatcaaacaatggagtgacttacggatctcgtattgtttcaggccccttctcttggccacaattggagcaatttctctctcccgatcggtacaacgttgtacacttgtggcatgtatagcgtacccgctgccgcggcttcttccacgtccgtgcaggaggttctgcgggagcatcgacatctccaggatagccatgcgggtatttgcccagtttaggtctgaattcgttagtacaagagctttcgacaaacacaattggcttggggtggacgcacgggtcgcgagggcacattgtgcaccgaatatgctggcaagtactgcattccgtagcatccggagcgaacacagtactacactgatgacatgtacggcggactcgttgtcgggtcgggtggtggatgacatcctggccgccggtgcgtgagggcagcgtaagaggaggttgcttgggtttgtgctgcacagggacaggtttgtgcaatttctgcgcgacaatggcctggagtgcagcctgggtgtcgtcgcggtggtcgttggtcttggtggagggatggtgagggcagctcttgcagcggacgtgctggcagttgacacaaactttgttcgggccgaaggtggtctggcagcgatggcaggtacggcgcactcgcatacggatcggtctgacaacacgctgcacggtcgtatcgctaggggacctccattcaccaggctcaagggtcagtccgtatttcgcaaatagagcccgcgccttctcttcttgaatggcgccccagttggtgaaaacggtcgcgtcgggtgtagctttgacggtaggagcctgcgggatacgttggggactgtaacgcaagtcagtggcacaaagtaaccaaacccatgggagatgaacatacgcgggagcttggcttggctcaggttctcttgatttctgcatgactggcgtggtggtccggacagttgagctcctcctcagagccatcttcatgcgcttaacgtatttggacaagccatcgtgcttgccttcgttggaagggttgggatcctgttgagtcgacattttctccggtagtatcgtcgatctctaaattcgcttgccggtcgtattcaaatcagatcatgtgtggcgtcgcacgacatggacagggtgactgctttggtggtgtcggaaaaaggtcgaacagtgtaatgacactttttgtgggcgctatttaattcataccaactgggatcggaggggacgttgtagagaaattatagtggtggtggttgaattactgggaagcaaaagcgccgaggagcgactacccagattgggggggtaacgaccaagtgggtggaataaggtgggaaacgagggagccaccggttaagtatggcaggtcgcacgggcgtgtaccgtaaccgtaggcttgggacacccgacaagacggtgagatgggtgaaaaacccaacaggaagggtcgcagggaattggaacagcctgggggcaaatccagcggatgattggctgaggggcggtcagatcctgtggaccgggcgtggatgagatgtccgatgtaaagtataaggtgtgtaaagtatgtgcaggagggaatgggacgtgacgttgtgaaaggatgggggatggtggtggtggtggaggtggaatgcacgctgggagcggaacaaagtcaccggccaagatggtggaaaattgaagattcacgacttgacgacggggaggagaggaagataaaaagaaggcaaacgaccagcgcgagccgaacgtcaaatagaagccgaacagactttctgggggaaccggacgagcgagaggggggtgggtaaggaagttgtatgtatgtaaagtaacagtcaagtaagagtggcaggcgcctaaagtagtagtagctaaagggaatctaagggaagtgtggcacatggcctcccccgatacttaactctttcctgttccgttgtggttattttcagtttgttttaattttccctattctctctttttatttccaattttttatttcttcatattgtccttttcttcttcttatttacaccttcgcttctctgatacatgctttctagatttcacttcctgctttattaaggacaccaatggaccaaacattgacatgagccggagcctctactaacaaagtcaaaactatggaaaccaaacccactttttatagccaaccagtctattctcactagaagactcgatactcagctcctatcgaaaatcgatgcctgtctccgtgaagaaaacaacgatcaataccatggcaggaagctccacgatccgagcggaaacaaagggagtaaagtagcagaaactctagaatcaagactcaggaccgattaggcaaagtcatcgtctctgtgttgccgataggccaatctggtcaggagctggttggttgatatacgcctcgacatcctcatgcagcatgatgaccagcaactagcgggcgaaccgatgcgacggggcgctttgggggttggagtctaatgccgtggcaccctacccactctggaacaatgcccgaacccaccgcgtctcgcccgcgggtctgaagaaggtcgcgccggaaggtgtgggtttttgcgactgttgtctcctgggaacctattttgctgatccggaaatattatcagtttctatttaggatgctcctgatcttgagtactaattacaatagataaaaacatgacgtccttcatatccgcgtggtcggaatcagacgctgattgaagatgatgtcagctggagaatgagcggtaccaaagataaccatcgcgtattttccgggatatgctcctaacgaccaaagcccgtgtattttacagtttgtcagatacaaccaacagctccgaagctgcaagaagacgatagcgaggataataataacgacgctctaagtatatagtcagtcattaacggctcgaggctaccaaaaacgtttctgtgcatggaccggagaggatgacaactgactcgagcaaatagatcttaatcggagcaagaagccttacgtagatggcggtgccgcctatgatcagacaacctgctgcagcctagcctggagaaaccgacaacatgatggaatgaatcattgggggatccttttccctggctcggttcccttcaatttcacgccgggatagcgatgcgccattcaatcaggaagccccatggaggaaccgaacatctacctgactacctcctgagctgagactcacttcgaccgaagatccggccgaaggacagacgactattcaggagcaagacttaccaatttatattatattaactgaacacaaaggggcctactatccgggaaccagttcctagtgagaactcaaaggaattgcagtgtcatcatagtgtcccaactgctgctttcatcaccgacaatcccaacttatccgataattcatgcatagattctggtgtgacgatggcttcggacatccccctacgaagaagagaaataagggagcaaccattgtccttgcatttttctcattttaccagttacttacaaagtagaaaccatcattgacatctctaactacttacctccatcacaacgaactactaacctaagaagtaggctaagtccctacccgcgcggaattctagactccctgaccaactcctcatcacacagcgctgaaaccatagtacgtctccataccgaggcattccgacagcctggtctgtcaaggttgtgtatgtgtaaatactgttttagacgcccgcagcattccattcccatcccatccatccacttagaccatgcatgatgcatgacaccacacctcgtttccaccctaccctaccaaagaaaagaaaatagaaaaagaaaataaattagaaacggcaacggcttcatgcagcctgtctgctgcaggcgccaactcaacacgctagacactgcctgcccattcctttgccgtaaccgacgaccctgtaagtaactacgtatgaagtgtgtttgtatgtatgtatgtatgtatgtatctagcggaagcgtagcgcgcaggaatttgtcagaggtgaagaaaaacatgaagcaaccgaagaaccttaacttgcatcgccgacggagtagatcggagaaatattcacctaccgggttcgaaggcagtgaacttgggtttttgctccaccggtttgtaggtacatcgttggagggttggtgttgggtgggtaagtaagtaagttaaggattgtctttgttgttggtttcagggactgggactggacaggacacatggcatgaaaatggtggtggtgatgatgatggagatgtttgtggttccggcttgttatgcttatcgttggaaccgtggttctggtttcttgctccttgcttgggaggtggtttccttttcattgtagattcggaaatgccgaccggagattgatggcctcaggctggattggatgtaggatcgtcaatcattgactcctactactactacatagatactactcagaatagatcctcccacccagaacagctcatcatttcaacatcgtaccgaatagctgggaataaacgataagagatggggaccacaccccctccccccgtgccaaacacccggtacttactatcagcacttcactttcacattacagccagccaactgcctttagtagttaactaggcttaataactagttaatacaatctgcagggctgaataattaatataccaaaaaacaagcatgctgaacaccaccaccacccacctttctcagtcagcttcaacacaacacacacacagctgaccaccgatctccgtgatccagaaggggagaggagcaaaaagaggggaagggggggggggaagaaaagtggaaaaagggaagagcataggcccaatcacattgcacttccttcgtatggacaaggcccgggatatccagtcccagcgccgcggagagaacacaagaatgtcgaggggtggatattctaccggcagtgccaggtgtcagaactcctgcctttagaggaatggtgaggtttgtttagtggcttttttcatctggagatccactgtggggacgcgtatggagcttgtatggatggtgtatgtatgtatgtatgtatggatgttaggatttacgggagggggataagtattacttggttagttacctagcttgtatgggatgagtttaggcacggaaggttctattgcttcgattaattgattgattgattgatgggtctcaagtacagttgattggatgggatatcgatactttgtacgatctcgtgattctttcttatgttacattgcatgcaattatcatttctactaccttatattatagtacccataagtagctacgaaacaacactcaattgataggaccagatatcccaacaaacatattcagcctcattttcacctcatatcacaactaagcaagcaagcatagaaatatatgtcaggctctgcttaaccaaaactaccacctcaaattcaactacactgtacacctgctatcaactcaacgaccgacaatcatacacttccctctcgacaccaaggctatcattcattaagtgataaagataccacgaacaagcacccatccaaatacctacacattcttccaactgtactactccgcattcccctccaaaccaaaataacatatacatatacatacgctagatactactacagataatccacacattagtatcaatgctctaccccaaccaaaacgaaacaagaaacaaagttcaaggcgcatatttgcccgagtggatccccatccaacccaacccaaccagttggttcagttcaaactaagatagacatgtcaagcagtcaaacctggaaaaggtttccggtctgatgtcggtgcttacttctatctatgttgtctcatatatcatgtgtgtgtgtgtgtatgttatgacgaggctattttatcgatagtcatgcaagggattatattgcagtgtagaataggaagaatgacaaattctgtcggggaatttgtgattgattataaatcagatttggggtagctacatagatagctgcgtgtgctcgatgtcttggtttcgtttctaacatgagttgaatactatagtgttgtctggtgagacgtgcattcggaactgagaaatcgtctagcaactcattgttgtatccgtatctaacctgatcatgtatacaatgccagcactataattatgaagtaaacgcatagcgtcatgaatgaccaatatagaaaggcctaaaaccagcttgacagaccaacgatccttaatctaaaatctccctaatctgcgttttgcagcttcgactcgatcgagataatatcatcttcctcatgcacctcaatcacccgattaacctccgccgtattgcgcatcaactcgacagcacccgcatacatcatgcgcgaattcgggttgcagttcacggggaggtagtagagcatgacgtaaggaacggtgagacggccggaagcctaatacaacaaacacaagttaggtcttcctcgctaagtctagatgaaacaaggcttgtcgaaatactcacgagggtaaggggatagctaaggaggataaaccgaggggacgactcgggcagctcgtcggctagatcctccatcttggagtaaacctcgccatcttcaggtctgatctcctggctcttactatcgatgatatctgccaaccctgttgtcaacgacccattgttctgagatatccgatgtgaagcgaacaagttcgcgcgatagctgtgacggttgtgctcgtgatagatagaggataagagagcggggttatgtagcaacgacaggagacgggatcctacaaatgatggcctgcggatccttagcgcgggaggttcccaagcggaacttgcgaagcttttctttggtctcgggggaaaaggaatatagtcgtgattcagactgcatggacggaggctccaggttagcaggggggaaagggagcgggagcgcgatgcggggcaatgtccacttaccatgttgtgataagggtgatgcgacagtaaggcggaggtagaaacaggatattcggaagtgcgctagaagcaagagagtcgaaaatcggaacccccagacgggatgtgagcggggatggatggagatgaatttgaccgaagagaacgaaggaggaacaagcaagtggtggtgctccgcgttttcggcccggtgggatgaagagcgcggcacttctccacttcctcttcgctctcccttcactttcattcaataattctcctccccgcccgcgcttgtttgttactccgccattcaccctctcctcctcctccctttccctcatgttcagtcgtctcggtcaagtcgcccgccatctcactcgaccgtccctcaacctccattccacgcctaccttcacctcgccctctctgaccccgcccctgcttcgtgcgccatctcccaaaatgacatcatccgtcctcccgaagaataagaggaccattcacacggcggcatgcctgattattggtgatgaggtccttggtggaaaggtgaggagcgattaagttataccggcgtctgctattcagttgcttttctaccttttgaagcgtcgtgcatacccaccttggttttcaccaagactgactgtttgccgataatgccagaccatcgacaccaactctgccttcttcgccaagttctgcttctccctcggcattcaactgaagcgcattgaagtgatcgcagacgatgagagcgaaatcattgaggcagtgcgacgtatgagcgaccgctatgattttgtcgttaccagtggaggcattggcccaacgtccgtacaccccctacgtcgattgcacaccccacacgagcatgaatactgcatatggcttgaaagctgactgatgaatgattgtgaatcgcaaaagccacgacgacatcacctatgaatcgatagccaaggccttcggtctgaacctaaagctccaccaagccgcattcgagcgtatgaagaagctgtccaagccccatcccatgcagccagacttcgattgggacaccccgtcacctagtctgactgcgaagttgcgcatggtcgagatccctcacgacgagtctgtgcctttggaagaacaggccgtttttgttgccgaagatatgtgggtgccgatcgccatcgtcaacggcaacgtccatatccttcctggtgttcctcgtctctttgaaaggctactcgagcacctcaagccgaacttgttgcctcgcttggttaacccggaggggaagggcatctatcgctacctgttcagcacaccacttccggagagtacggtcgccccttatctgacggaacttgctacacgcgttgcttcaaagaacatcaaagtcggcagttatccccggtggggtaataagcgcaacactgtgactctagtcggcactgacaaggaattcatggactcgcttatcgcagaggtggagcagaatgtcgagggaaccaaggtaactcgagaggatgagcttgaccctccctctgacaccgaggagagcaaataagtggaacgctggcggtcatagtatgcctttgtgcagacaatagttgctagagaattagacaatgacacgcttattccgaatatgtcatggtatcactcggttgtatgggcgttaggagtccacggacctgcagacgtgctgttctcaacggtgtccatacaaatattgtgccatcagggacgcgtgcaagtcaaaaatcaacgtaccactcatcactcactacaaaagtagaagttgttaaggttagaaaaccagccactaaatccccaaagacatcactaaggacccaaccataaaatacgaaccgcagagagacagaagaatgaaggcttattctcgaggaccacaatttccaaaatcaaataagattacccaatagttcaagtgtatacatgaaggaagaaatcggacagactaagatagatatgcttattgcgcgccgctgctgagtgcagaatagggggaacgaaaccaaggaaagaccaaaataagaggtgggaagagcgaagacgggcaaacgacaggctagctggcaccgcgatatcacaacgtctatacttccaacagactacccggttccttcccagggccgttggagcatcaacatgcagttatctcgccgagaaggattcagcaggtgcgatcaagcccgacatagagcaaattcggtgaaagagaacaaaacgtatccccgatgcatataggaaagagatcaaatgagattgagggcgacaagtaaaagaggatcagcggctgctgaatgtgcaaaagatctgaattgctcgtccagcgcggccgacaagacgaagaggaaggatgattctgcagttccgaatagtaccacaaatgcgaaccgcgacaatagcgtacctatattaatgcacagatctattgacaggctccgttctcgtcctttcaaagatcgagaaatcgtcaaagaaaaatcaatcttccaaaaagtaataataaacaaaatagaggaacaaagggggaatcgaacgttcatggagacgatggcggcattagggggttgagagcagacatcatctgagagttgaggctcgtatggtataatgatcacaaatcaaaaaacgcgtgttgaccagccacatgttgcagcaaggcaagtggcccgtctctgttgctgacctctctttccagccgggagtgaatgtatgtgtttttgctttccttccgtatctcgacctgtatgtatttcttttagatccaacgcctgtcccattacataattatacattttccacagcagccggcgtcatcgccaggctcgctgacgtccatttttccttccggggcgcgtgagccgccgcccgcgccagacgggtacgatgacatctctttgttgaaccgacggatctcgcgcacgaggtcgtagaaagcgttctcgacgttaatacgggacttggcggatgtctcgatgaacttgcagccgaactgccgtgctagagcctcaccctctgtaaagtaaagaaagaaccgtcagccacatcctcccccggcaagcagatgctgggccgggaaacccaccttcttcggaaacagccctctccttttctaaatcgcacttgttgccgaccacgatgatgggaaagtagtccttatccttgactcgcaggatctgttgttggaaagtcatgatttcctcgaatgattggcgcgacgttatcgagtagacgagaaggaagccttcgccggttcgcatgtactgttcacgcatcgccgagtactcctcctgtccggcagtatctaaaacgtccaacaatgccacctcctcgtcgataacgcactgcttgcggtaggaatctgtataaacacgatcgaaacatgagccacacggtcgggaaagctacagtagagctcagcgcccaccttcaattgtcgggtcatattcatccacgaagtggctctggatcaattgaatagtcaagcaagactttccgacaccaccaccaccgacaacgacgagtttgtattctcttaagaactatatgcgaccgagaggtgagcgaatcgtccattttccggggtgaggcagtgtgcggagatcatgagagaaagtcggtcgggaagggaggttgacaggaggcacatggaagctaatgacggaaattggaaagcgcagcgacaaggcttaccttggaagccattctggtaggatctggcgtgaattatgccgtgagggaagggaaggggaggaggggaagagagagagagaagcggtaatggaagctatcccaacaggagctgtgacagcgggtcgaaggagcagcaacacaaatttcttttgcagaaagagacaagacgacaagagtcggggcccaggtcgtcgggggtttcgcgcaaagcaaaggcgcctaaagggcagtccacagcaacggcgggtctaatgattaggccaagcttaaagcagcagactgggggggagcagcagcagcagaagtgcgtgtgggaagtaggatccagggggggagggggggggtcgtggaactttgcaggcaggcggaattgaaggcgaaccggcagggtttcggcgtggtctgcagttcgtcttggacccaatgcgttctaagcgatcagggaatatggaaagtcgaagggaactacttagaacaccttcgagaaccagggtggattcaaggagggaagataaaaaaaaaaagaaaaagaaaaagaaaaagagggaaagggaaaagagagaacggggtggagagactttgggaggggaaaggggagagggagaggagatgattaaggagagttaagccaactgaggaacggaggtggggataggcagggcagcccagaaaggaggagagagagtctagatagtcaactactgaatactaactagtaatggacagtcaagtagtaagtgcgtagtattggataggaacttccacaagaacacagagcaagtcacaaaatgacaatatgtaaattattaaccgcgggataagcgccttgattggtgtggaacacccctaccgacgatgtgaaaagagcgcacttccatcgagaaattgatatgatgcgcctgctgattggaaggaaggggattcgaaggttcgccagaattaatctcaccacaatcactaacgatatgataatcctcctagtgcaggagtcggttaagcacagattgctagtcgtatctgactactgctgctgctactactactactgctgctgctgctgctgctggtcttacaacttgactccggttaatggcacaaactgtgtggaccgaattgaaaggggggtggaagacagagggaagatcaaagggaagggagagagagacagagagagagagagagaaagagagatgagcagtgggtgtggcattaaccggcaacgcgtgtggattcaaccaatccagccaactgtttaatttcactggtcccggttggcccacccgccgataattaacctcaatcgtccgatcgcaagatatgaacctgaacagcaacagcctggcctcgaatccgtgccaggtactccgtgtaccccagatacacagcacacccatcacaatcagaatggttttctgtcaatccttccttcatccagtgagatcatctttgataggctactgcaacggtattctcgtgagtggaggtccgatcattagggaagaaaattgagtcagtcggtgggaaggaaaatggttgcatggtgaggtagcctgaaaaaaggggccggggggatcgaattcccagggcacccaagattaatgatccattgggtctagtgtcgctgtccctctctctctccctctctctccctcccacacttgccaataccgtacagtaagaatttggtggtttaataggatgaataaattagttgttccctacacagaactagttactagtattcggttcatttactatgtcatgtataatgaatgaatttcgtattgatgatctgacccagcagatcccaccctccctccgtaccaccacccagcactcaataaatggtgactgtcattagctttgcacagaatcacaatataagctcgactccagtacgagccgttagtaaactatgcatttgattgactccatgactttgtgaaaccattcatcgtatctctcccagattaatcttcaccagctccaccctacttttttagcgccggtcgttaatgcttctaaattgtccagtgttctccatcccaactttttccccctgagggtcctctcccctgctcaccttacgcaacacagtaaacgaacgaatagcttccggagtctaagccaatcaccgtgaggcctgctgggtggattcgctcctctcttgactctgcgtcccgctccggttccttgaacaagtgaactccttcggtcccagggtgcaggcttacttacgcaagcactgtaagagaggcaacaaacgaactcccattgataataagtttcccgtccggctcagtcaaaactcggaacgatccattggactaaaggccttggacgttacaatttaataggggaaaacggggtagcttcccctagagggactttctactggacgtgagccttgctgtgggcgcgtggagagaaaaaagaatataataaaataacataaaataaaaaaaaaaagagggtgagtgggagtgcgtgagtgagtgagtgagtgagtgagggtggatgagtgagagagcatccatcattcatggatccgaggtcccttgtccttttcggcacaaccgttttccttctagaagggtagaaaactattctcagccttaacagatgcaacatgacagctccgatttgacacaccgagttacatcatcattcgaaatattgagtctgagtctggcttccttttggcttcgacagcgtcatggaattgtgtccctggagaggagggggggggaaactgagtccaatggagtgagtcgtgctcgactagtccagaagaagcctaaaatagccgcagaccgagtttaggatgttctccacgcctccactttttgccagaggtgatatattggtctgtgagaccgtccgatcccatagcccatgttactgctcaatcaccattggcgaatgaggcggcgacctcgacacaactccttgctccccttcggtgatgagcggagtaatcccggatgatagtaccctcgagtgtcaagagatgacgtcccgcaaaattttaaccccggaagtctgaacacatttttgcatccttgcatcctagctgcagctggggagattttgccttgctcccgtaataccacttacttcctgcagtgtcgtgcgttgatcctttcccaccacatgcgcttctcattgactctcgccagggtcgtcttttcttatcttctgctgctactaccctggagcgaaactaaacccacccgtgttcccgagccatggcacccaagccacctcctccaagtcacattgcctgattttgcggacaactgctgatcgcggaaatctcttccatcctaccgactcatcacatttgaacagagccatggctcggtttggaggctactacccaagtctgggtaaccgaccgcttcagggacaaagatacatacctgcggggtcgtcggggcctgcgaccgagatcggtacctgtcacctaccctgactatcgtaccagtcatactccagaccttgtccatgtgcctggatgcccaaatcaggatcaaacattctcccgcatcgattaccaagcgggcagagcactgatttgtctgcgaagatatcctaatcgaagcacatactcacaccgccctccgatgttcggtcagcagtgcgtgctttatcttcgagtactagatgggcagaccgaaatttccaatgactagatcgctaagcccagccgacaggcatcaaacatgcccatgacgtggccagacaagaaacggcatgcgacatcaagccatcacaatgagacttgcagtaggcagaagtcccgcccacactctatctacctacgacacccaagttcatatagctgggtggggttaattcagtcaatctctcccaatttgttcatcccctccgtgacacatccaatgcctccgactatgccgtcaaacgtcaacaataactttgttccatgactggcgcatatcagaatgatctgcggggtaccaagaacagacaggcatcgcttaaacggtaaaccatcacactgacttttggctgacacaaaccctgagccacaaaggggtcatagctactagtcgatacaaagtgagctgccccccccttttcggatctcggatatttacctaccttgtctatgttcgactctctccaagtgagcacagtaggtattggtaagattccaaatcaaccgctcacctaccgtaaggaaaaccaattatcatgtgtaaattgcaaatcatatggtctaaagtatttagtccgcttcaggatgttgtgcatagacaacttactactcgttccttttggcccccaatgatatattatgcaggggtagatagtgtacttaaagcttgggggccggccgggggtctccgctgttgattccttgccgtctgtctatctgtctgtctgtctccctgaagaaacctcagtggagaggaagaccacagtattttcaacctagtaattagctgcacattgtgctcgcctctttttacatcagagcttttcgtgtctcgttcaagtggtgttggtctaacagatcccttctttgaaaatatgccagtaccccagaaaaaggcagtaggatgttggagtgaccatcttaatagtaaagttacttctgggtcagaccatttactaaacgtacagtaagtgactaactacttactcacatttgtagttcttttgcctttcctcttatgagagtagcatagttatgtctgtatttgcctgtctcgtttcctaccgtagttgcctttcaccacaattttatcttggtcctagttgcttattatcaagccggtcaatggcaattaagcagcctgcttatctccgggagttcatacaagccttcaatatatagcatagaaaaaatgaaagcaaatgtactccgagatgttcatgggatttaactattgctacgtacatgtctgactagctcctgtatctggtatttctcaggaatattccctatcacttgtctccttaatcagaaggaaaaatggaacagaaaaaggaaaagcatttgaggtttgttacttgcaaggaaagatcgctgaaataaaagtcatggttatcgtgccgttgacgtaaatcaaaccgagaagtcatcagatcatatcgtccccatgggtactttgtgtgttccccgggtgtttgggggtattcaagagaaaattcgaccaggatcaagagattaatggtatgaaaactgccaggtagatagttatgcccaacgtatgaaatccaactagtcaagaaggatatcctgaatacaacttgaaaagaactggttctccggcgaatgattcccaggtctgcatagttgtgaaagtatcgtaaaagagcacgtctccctgtttccaggtatgccaatagcagactctacggtcatagaggagaggattcaggatattgcatagtctagttgagtcagcggttgagatatcttcgatggcgatgagagtgggatcacaggtgatattgctttgagagaggagcgagtggtaacggaagcagggccggccgtgagaaaagtgcggtatgatcaagggcagggaactggtctcagtgtcgtgggatgaagtctctgcgttccaggaaagttgctggagtatgccgacggtgtagctggctggaaggtggtggaaaaacagaggggatgcggagaaaagactgcgtctggtgttctctgagatagggccaggggcactgatgagctgatatctattcgggagtggattctatgtgagtgggaagttaaagaatcttgagaaacagagttagcttacttggctggagaggagaccggacactgcttgatgtgatgggcttcttgatcctccatgatctcagttggcccatcgtagggcagccaacctgacaaggtagtgcttttcgaatcttgtgaatcaccatcttcggctttttcttcaggattgaagtcggatatcgaaaggtaagaagcgtcaacgctctcagctttctgcgcgatcagctcatggtcatgagtgtctgtaaatccgcgaaggacaactggtgagttctcgtgtgctagaccctgcactttctccatttcaacctggcttattgaggttggattgagaggcgtgatcatcatgccacagggatagatgggatcgactgctaccggcgatgaccagttgtacagctcagatataaaacggtagcaccatggacgcccgtttttgtggactaactccaattctgggttagcatcgaaaacttcgcgccatccatatatgaagcggccgtcaacagtatagcaaggtgctgagtgccatggtgtgactggttttgaggatctcgggagaacatttatggagatcttggttaatccatttgatggatggattgaaagacggatgtaacctgagtagttctttatgatggcttctgcaaaggcctatagtgaaaccacacgtgttagtgccattcaatactgttatgcttggttagcgttcaagttttgggtgaattattccactcaccgcgcctcgtgtgatcatggctttggcaacattccccaggtacttcttgtgtgccttgcgagatgtggtaccattctctacataaagatgttccaggtccttggtcaagaactttatgtatcctcgataagtggtgcagatgttttcgtctgacttgatcataacagcggcgtcaaatcccaccggtgtgtgctgttcaattagttcctggcgaaacaccggggccaacctttcgtacgtctctccgtcaagtttgacgtcctcatggctgtgaacaaggtcgcgcagtctggcgaactcgatatggtcgtacttattttcagcaaccatttccctcagtgcatggccatattcccagacgtctctgtcagaaacgcccaggatatctaccgacagtcagtccctattttagcatacaagatcatgagtactttcttctcgacttaccgttgtacacgaggccatcagatacaatggtgagcttagctccatattcatagacgtcactaatagcagcgcagagtccgttaaggtgcgcgagacaaatctcttcgcctttgtcaggaaggcttcccaaagtcttatttccctgattcggagacttgaaggggaaagccggtagaatcattcggatcggctgtttggcccggatctgagaccacatcttggatagaaacataatgtttccgtcgctggtgcgatcacttgcggttgctggcaccatggtacgataccgaccgatgatttccatgatctcaaaggcctttagcagtggatcgttctcgtacttgcgttctgagacttgtgggtcgatagtcgactccatagggaaaatgtctgactccatgggaacgacgcctgactccatagagacgagatctgacttcatatggaagaactctctctccataaggaaattgtctgactccataggaaacatgtcaatctctaagggaatgatgtctggtccaaatccttgttccatattggcgctgttgagatacaggtatgtgcaggtggtgttgtgggcatctcagaagactgaggcgtgaagatttacacgtctgtataacacgaagtgagaatgcacttcactggctacacgccgactaagcgatgcaaactcatatcatactctagcttgagttcggggtgaaccgttcagggaccgtgatgtcaatcatccaaatcaacattgcactgtgccggatgcagtaattgatttacccaccggaaccagtcgatgatagcccttcaggtaccatcgccatccactatcattttcagagtgacgaggtgggtgcaatgctctgctggcatcgtccgtagaagataaccgtgtaggcacatcgactcgagttgctataaggatggtgcgaataaaagtaggctaccataaaaagcctgaggtttcactatataatgagctgacggcaataatgcagaccgattgtgcccctcaagtcgcaaagaaaatgtcaccgttgcatcggcagcttaggagtgccgttacttatatataccgagccgtagatccagtttgcgacacgcaatctccaagttaccttttgaaccaaagctgccagttgcccacgttaagttattagcaaagctcttggatatatataacccgatctttcaacatataagttgctgatggcactggatatagttggcaacgggtgacttcgtatcatcatgtcgttcctttcacacaaggaagttgaattctttacgcttactttgattcagatatgcagtctcatcatgtaatatcatttgaccatatcgtctaaatctaccaaaattccagccaattctaatgtcgctccaccattgagtgctctttacaagtccacaaacataaatgcgtatacactaagccttgcggtgcatggaagtcggggatgcctaagtgacggtgccatcagctatgctgttgagccctgtatgcgatgtttgacttacctggtggctagggaaaatcaaggtatctgcaatcacaacattctcgcgccgaccggcagcaaatacaaccacctcagcaatatcatcgggtgtaagtggctcgcagccgctgtagtgcccataagtagtcagtatttgtccatgtgcctttttactgtcagctgggagaacatataagggatccttacgcataaactgcatctgccttggccttatctccgtagaaccgcacaacggagaattcctatcgaagaacagttattagaagggtcatgcaattgacataagcgaagtcttaccgtctcaacctggccaggatcaatctcaatgatacggattcttgtggcgataagctccttcctcaaagcatcggtgaaagatctgatagccgccttcgtggcacaatagatgctaccgccagggtaagcctcgcggccagcaatactgccaatgttgatgatatctccgcgaccaccgtcggctctcttcttgaagatgggaaggatggcctgggtcatgttgatcagtccagtaacgttggtcgagaacatgacgttgatatcctcaggtgcaatttccggagccttagcaactcccttaacaaggcctctgcatttctcttagcacagacttgtgagtagcagttggaaaaagtcctgactcacgcattgttaaccaagacatcgatttccttgaactcttcggggagagacggcacgaatttcttgatatcttccgggttgctcacgtccagctgcacaggcaacaccttgacgccctcaccgacttcctccttaatctccttagccagctcctgcagtgaatcaatgcgtctagcagtcacgatgatcttcaagtccttgggagaagtgcgggcgaattccttggcagtgcttcgtccaataccggaagatgcaccggtcacgaggattgtcttgccttcaaggcgctttgccattgctgtcgccattgtgcgtttaataaaagctggtctgattgcagcacgaaacggaagcggggtggatgcggagaatgatccggatgaaggggagagctgtcgcagggatctgagagtactgtaataagcctggagaagccgcataaagagcctgtcagctggcgtcgataacggtcaagtaagagagaaaaggtttcaaatcggacgaggagacaggggctattggtggtttcttatgaatcataggccgaaggtcgggatggcgtgtgcggggatccggcgaggccatttcgtgctcgggcgggggggcctggcctcggctgatggttatgccggccggactggcttccgatggctgcttgtaaattctcccagcttctgctcctcccccgattctgaatctgccaggaacgatagctctttggagaacagctcattcttgtattcgacacaaagcgccatcagtcacacaactacgctgttgaatcctctatcaacacgaatgccttgactccagctctcaaaatcggtcaatagatgtctttcagctgaagtcgctcaattatcgaacgatgcaggaatcagtcgccggatgataagtcgaacagagacggttttaaagccattggcagtaggggggtttcatttttggagcaagaaacagaatctttcccatccaggcatgccattttgtgcggctagctaggcctggcaaaagcattaatcattcacagccatgcagaaatatgaactagcactgatgatagaccaccactgcacttgatcttcacagaacaatctatatgactctcacgttagcaccagtgtgggcatatccgttaattccagatacactgaaacgacatgaacgtaccatttcctttggcggtagcttaaccgcgggcaatcctcgaagaaaaagaagccatagtcatcatatccgcaacagctctgaaggggacttagtaaggtcgtagtcaattaggcgagaaatggagcagcctttggcctcttagcgatccacgacaaccacgacatcgtcttatggccagtatgataagcggccatgaaattagaatcccgaagaccgggctttgcttttttagaacgcatgaatatgccaaggcttccacgcgttcttaggtaactagcttcgcatcgccatgcagaactagcttaaacggctaggtcaagtcctattctatctgtctgcgaccattgactacaaacacaaaatcgggcacagtcttatgttggacaaggagtcattgtatccacttcctgaaggtgacgccaaacggtacaatgccacgggtccgtggagaaagctacctagtcgccttgataatctcgacatgaaaggatcagtaggtggcatagctttgagaagtcactgggcatatgataacgaagatcttccttcaggtactttggtatgcgagtttcccgtataggtctggtgctggcgatcgttcgctaccgaacgtgctagcaaagagttcaagagttcaagccgccagcccatccactatgatgaaagacaagacatcctgatttgaacgaaccacggatttcagggatctgcaaactgcaagcgaagagatcgtcatcccagtctgcaaaccttgagatcatgtgctcggacgcggtaggcacgttctctggttgttgcgcacgtatgaggtgccgaaccctttggatcattgaacattgacacctcgcatcagtaagattgaacaaccatagtatctaccaggtcatgtgtgagcacaatgctatgaggtaacaacggtcgcgagcatacagtaggaaattcaagcagggtaccaagcaagcatgtccgaagcccgtaaaccgaagtcgactgtggagtgtactccgttttcggcgaatggccggcgctccgaggggtgttgaaggcgggattcggaactcatggtgtttaccaccagatagatatctagattcgacgtgatagtcatttggattctcagccctattcgaggaattgtaattcataagatggcgtctaggggaggttaaggttggggtccaagaaccaaggaaatctggactattcttcagccatgcaagtagagtttgagctcggaagtgactccgatgctcgtgcggcgtttgacaaaaagtcctgagaccatgacttggacagtcaggcatcagaagaagttaaatcaactaactattgaaatgctcttatctccttgtcgaagtcctggcaattgcctgggtcggagttaagggcagtggatcgtcagggatagtggctggtcactcgctctctgaccgcttcggtgccttctttcccttttccctctccggccgacgatcatcactagcttttgacagtcctccaaggccccagagtcaaggcttctgtgccaatgagagagacctcatgctccaggaaagttcgacgggctatctccgtgggccagaatgacattattgacatttgacacaggtctattccaatgttgacacctctctcgtccgtcgatcttcgcatcttgactacacccttcagtccaaagcattggattcgcacgtcattttcatctttccccgttgcacgtaccccataatatctatcgtacaattgagagttgccccttttgtgacacccggagcttcgcatggaggtgcttcgtgaggacacatagtggggacttatccacatattattttacaccaatgaacgaaacgcccccaggcataggctccaagacaaatcctcagctatcgagaccaagcttcagagccaaaaagcaattagtcaccgggttgcatggcaagaaaatggaattgaacgtcgggcagcttccccgaacttccgtaagaggtctctgcagcgcttatttgctgcgcaggtcacatcgacaagaaatgcacttttactattcaatggtggcgctctaccaactggctggtagtggacatcctttgccgcttatagcttgcccggcgcagcagtagcgcggcgctatccagcctcgtcctccccctcccctttgaacctgcatgggacccatcttctattgatgatcatagccacattgtcgcagccgcaccgctgaattgggatgagaattttcaaagcagtaaaacaaaggaaccccgagttttccttcgggttccattcccccggaatcatgtatgtcatttgaattatcgagccacgaggagcaacaatggaaagcacgcccctgttctatgcagactcgatgcgagggttgcacagcattctccacatgcaagctcggagtccacagctttgatgcagccaagcatggcaacggctgctggcttgcgacctggactcatggtccttggaggcacgagtcatgcgaaacacacaatatctctgtctacgaaacaggctctcgtatggaatagtagttaatatattcttccttttgcctttctcttaaacatccggtgttcctttcatctatgaaagatggcaaagcaactaatgctcagacggatcatgcaatttcaaattcttacctggtcaaacttcggccatgacgtgctctatggactgatgtgatcgacggttacaggtgaggaaaccgaaaatagaagactatgactactagtagtcgcttgcgcccaaggttgcgagaagacagggacctgcgtggacaatagcacaaagcgcggacacgctgcctatcgagtactcgagcctacgtcaaagacttccccaaatatgtcgatcaatcactgagcagatagtgatctatcgttctaggaattttccgacgagtgatgaatgggaagaaagaaaccatggttgcggttgttcacgtttgaccaaaacgggtgaacgcagaggataaatgtaagaaactggtgaacgctaatgaaaattctgctccacagcgaagctgattgttcgaactgttgttgacttcctttgcgacaacccacgatcttagtatgcaggattagcttttatcgaggtacgaaactttgttagggaggagccatccggggtcttccgctaatcggggactgatgaaggccatcttttgccctgctatgcatgctcccatatcctcgctgccttgatcataccctgaattgccattgttagccagaaaccaggcgcccagaaagaaactagttcatgcaaggcattggactagagatctcgtgttttttcctcgcttggtgacccaccgccacgctgaacggcagatcatttcttatcctgttctatttgcagggataggataaaatcaacgagcgaatgaatgctcgaaatcgtgccatacacgttttagtctacctagtgccagaggacttctatgccgctttaggcttgtgtacctccactggcggcgctatccacaccagcacggtcgtgaccgagtctcatcaaattgaaaccggtggaagaacattcttcaacaccatctaagccaaattgagtgagccacccagctttctccatgtggctattgatcctggtctgattttttgcggcaccccgggggctttgcttgcgatttcttaaggggcacaggatgagctggggatacacgagccaaaaggttgaaacgggcattttgtgtttggccttccctcttcctagtggagccaatctagccgaatcaacggtaccgtacgagggatattgccgagtccgtaccagccaagtcgaaagagcactatactccaggagggaagttctcaagacaccagggtggcgtcccatggatcgaccatcggagagagactccagtgacagggcgttgggtgccattctgggtctcgctctacaggtcgccgtcttgattgactaatgtcccccctacaagcgcatccactctgccgtctgcccacgacaccagtggagaccgacagcttagtgccatagatcattactgcaatttggaaggagtccgggtcatgtagccacactgtgccgggcaacaccgagctgaaattgtctactacgtatactatgactctccatccagggctccccagcagtctagcggccttcgcacgctattaactactatcaaactttgagctattgcggggggtactcgggcttaattcgctgaactgttaaaagcaggatccccgatactttccttttccctcttttaccccggcgcaagatcttgaaaaagcaaacctgcttcaagagttggcgttagcccagacactccttcttgaaatcttgtcggtgcttattcgacccatgtggtaaaccacgttccggcctctaggttcaagaacctggagactgtacatctacgcagatcgattcattgaccgcaaaccaatgcaatatcaacaaccgacgcttcttcatcatccatatcagaaatcacacgctcttttgtgcaacactcatctgctcaactggcccactcctttgccatgctggatgaaatgatgggaggcatgctgcttccccggactacggatgatggtacagctcgcggacagcgagccctggtagtgacagccgtgcttaccggactctcaattgtcattgtcgctatgcgtatgtatgcgcgagttgggttaatgaaattgactggtcgtgaagattatatgattcttatttctctggtacgtaccctgattggggtgtctgagttctcgctgggaaagtgccgtacattgacattggttgcatgtaggtattatcatgcacgtacctcggtcttgttgctgctggtaagtcgtggccatccgccagtgacctaaaatatctctcttacatgctccagaggtgcattttggactcggaaaacatgacgccgatttgtctgacgttgttgtgaaagagcaattgaaggtaacattccccaacactaatcagttttgaacctatactgatcctctgtaatgaagcgactctgggccgctatccctttctataatgccagcttgatctttaccaaattttccattcttttccagtatcttcggatcttccccgaccgccgcttccggcttgcctgctggatcgtgtttggtatcgtggctacttacggaacatgggcagtagtcagtggtttcttgaactgtgtcccagtcgccaaattctggaaccgcaacatctccggctactgcctaagtttcgaggccgtctggttcttcaacgcatcgatgaatatcgctacagacacaaccctgttaatcttgcctatgcctcttctgtcgcaattacaactcccgcgcatgcaaaaattcgctcttatgggtgtctttgctattggtggactgtaagtcatggcgatcgccagtttgtccaatgcacgctaaccaccacactccagcgtcgtgatcacgagtatcctccgtctatccagtctgagaagcgtagctaaaagcacagacacgtcttgtacgcagcccccattcaatttcttttctcctcctcgagtttagactaacaaacgaaccagacagtaatgttggcgctgcctattggaccgctgcagaatgcaacgtcgccatcatctgcgcctgcctaccattccttcgtccaatcgtcagtcgcatcttccctcgtttcctctcgaccaacagctacaaccgctacactcgcaaccccaccatgacagccagtcgcatgaccgccactcggatgaccgcgcgctcgcaccggcaaaaggtcgagctttactcccaggaccgcgactacggcatgtacaccatcgacgtcaagtccggcgaagcgagccacgatagtgcgctagacggaatcgcggtcacgacgacaacgatgattcaggagacatcgagaaacaatgacgagtcgaccagtcagcgtcgattggttgttgatgtctgatgatctccgacctttcctaatttcgcacacactcactatttcccatacattcacgaacttactttcttctgataccacgatgcatgatatatgacgctgcatcttcaacattaccccctcttttttttatttactctctgatcctgatatcccacacctgcgtctcgtttcacacatacctacctatccgtccaccttcgtgtacattcttctcattcttcggatgtctaatcatcgacgactttatgnccatgctacaagctgaacccctctttcttcttggttttatgtacattcacccttctttcgctcatctaacgagctcccaacataatacatctgtacaacagacattaatactaaatagtagacggaaaacccagtagataaatcgttagaaaaatcaaacactactgataaaccaacctagcgcccccccccccggataaacagaatcccgctctccacggtgtatctacctatctacccaccccaatttaagattaataattctcacacgatcatagtaatctcccccctaattttaatcttatcaatcgcatcacatcatgccataatccatctataacactttcgccggatctagaacaccctcctttcccctcctttgcccctcttttttcgcagcacggtagatagatactgtcaatgtaaggcgacaatccagcagggaagaaagtcctttccgaataatcctaggcaggtaacacaattccaacccatcaacatcaattctctagcaagacccaatgtcgttatgtgcttatcatcctcccatgtcctgtttacaccacttactagctacaattcgctcgagaataaagtaatcaacaaacaatcacataaaaccccccgcctcgcattaccaaaaacaaagctttactacattcggtccataaccatgaatcagacgatgatcatcataagcgataaatccgaatttaaccgacgcaatgcatagctacgtaattgtagctcctaactaactagctgtatgctaacttacatttggtaattgttggaatctggacttaagaaacatcccaccacaaggggaagagagaaatccaaacaggcgagcagggagtaagtaattctacaataaattaacattgatcatatcacgcaaaacaactaccctcaaacctagctgttacacatgaaattggccagcttaatggcctactttattagctagttagttccaaacagcctcatacgtgttattatttcgcaggattcagtatgtgacgagacaaagcgaccgactttgttttcgtaacgaaacaaaatccggaaaatccgatcccttgcagtgaggggtatgtgctagactactagtagacctacgtgcgaataattaataagaattacatgagaataatagccaaggagaaatttttggggacttgaaaggccgaggtcgggccgaaccgatctggaaagggaatctggcagttaagcttatcaatcagtcaatcagtcaatcaatctgtggttgagagataactaactaattgatgggtttcagataatcaatctatcaatcaatcggtcgctacaggttcgatcaagcaggaatcttagcgaactagtttactttagatcaataacagtcatcatatgatcttgataagtcccttattaccgaaatctattcagttattccatgaccttacgaacacagtcatctcacccccggttatcccgtaattaatagccttgtccacgcatccgtccgccggtacagattcaaacaaggtgaaggggagagtgagagagagaagaagaagaagaagaggaaataaaagtgtaacaaaacaagcctccgtagtctttcttttgtaatcgcttatcccgccagcgcttcgaacaaattaaacccaagtaaaaaaaagaaaactatgtagagaacttttttttcccttaatagtgcacaagtcccgtgaaactcatcgtgttgcaaatggtatctcgtcagaaaaagtctgcgccaaatatgtgattgttgaaagagtaaaggtatagcaatagcagcataaacagttctaggacaactagatccatgatcattgttgtcctaattctgccaattcgcgctcctttgctcgcagcatctctctcatctcttccgcttctcgttgcaactttaagcgacgctcttccctgatgttgtcgaattccgatacaccaggcagcaactgtgagggagggggagcaagaggaggagcttggtgagactgatggtgctgacggctaagggcagcgagtgaggggtctagacgcgattcgtcatggctgttagggttgaggagagaagaaattgaactgaggcgggcaggaggggaaggattgacggaagacatgatcggaggaagttggttggacccgttctccagagtggttgggatagacatcgcttctgctgatgacgcggtttctgcaagggtgcgtttctttggattacccgatggattcggcgaaagagatcgccgaccaaactgagacaccggagagtggcttggagcgttgatgcgatccggctctaacaatcttggtggcgggggatggtgcggtaaggagacgggcccggaactaaacccggtaaaatcgacaggcgggggtgcaaagccaaattgcttgggcgcggccggtgaaatcctgtctccggacatcggtccatagtgatccaccggctcagagctgtagtagcggtagtgatcgtcgtggacgcgagccaacgtcgctggggaggcctcgggcgaggcagaagagccattcgacgactgcgtggcagcagtcggagagtgttcccgcagcgccggcacaacgcgttttcgccgcttgattatagtcttcttcattgtggtggggcgatagcagccgtggagcttgtaatatagacctaagtgaaatgttagccgcttcaaggctcgttctgatacccgagataaggcaaaagaacataccacacgcattgcagatcggatggccattctcgtctcgtcgccaaagcggggtcacagtagttccacaattctgacacgataccaatatgtttccctcggccgacgcaccactttttccgggtacgtccggttcctgtgctggcaggggcttttcgctatctggattggcgggtcgaccccaagcgtgcaccggcacagtccctcgggcagaggacttgtacacgcggttgttgtaagctgggcaaccgtcacacccctcagcacccccagtgccgttacagttgcccccaccggggcaagatcctttggagccatgacagcctccttcgctatgggtgtgtgcctcgtgctggggtgctatcgatggtggctgttgctgcgacggttggggttggacaggttccgtgctggtctgtatacgattccgctttgtgggccgggcaacattccgtgccttcaaatacagaccacaggcattgcaaatcatcgccccggtcggtgatcgtcgccatagcggagtgcttttcgttccacagttactaagtgttaccaaggaagtcagtaccgcccaggtaacaaactaaagaagcccatggaaactcacctgcaggaatgtcctagaaaggaagtgtccttctgggacttgggtgatgtcctttctgctagtgtgttcgaggcagattcggtcgacggcagcgtaggccgttcagaatcgtaaggagtaggtgtatgtttgccatcgtaggcatcgtaagcatcgtagcctcgagccgcatcatcatcacgggcacggtcaacaaggtgttctcgaccagcctgagcagacgagatcagctgctgagcagcgtccaagtcctccgctgatggatgccgcgcaaccatatcgggatttcgagggagcgatcgcaccgtctccatctgggggattgatgccagcattgccaacaagaaatcgcccgcagaagatattcgttttccttctctatctcccagtgacaaagtccccagatcaaggcaacttccgagagtagagcgagtcactcaagataaaagcgtagtcgaaataaggagagggctttgtcgtgaaggtacgtcgcaccacagtcgagggggggcaagtaatgtatcgtatcacaaagtcaaaagtcggtcaagatgacagtgcagggggaaggagaaaaaagaaaagaaaagtctaacgacagcctgactgagaggcaggtaactgcagctagtgaaactcccagagccaaccaggcggaaccggagagacgacagaacactgatccctgacggtgacccaagcgtactagaaggagataggggttctcggaaaagttgagcgatcgtaaagtcaaaaggcagagatcagtaagcagcagtcaaactgtattgatgggcaacagatctgccacgaaatgctcgtatattggccaatccagaacgggatggtctgagtggcgatccagtcgtaacggatagagtgccccggagtactgggtgcggatgaacaggtgaggaaaggtttaaaaaaagaacaagaggtgaaatcaaaggaggtcagatcgcgaatagatttggggggggtggaggtgggtaggaggcaaaaaaaggtacggaatggaggaggctcgagagagaaagagagagagaacggtctggagagatgggatggatagatcgatcgttgttggtgggaggggaggacagcggcgacaggacaagaaagatcggcggtaacagggcgatcaaacaagacggatggaatgtcggatcagatatgatgaggggtgttgaaagagtagaagatgatgaaagggggatgaagggaaaggaaaggaagggatttagggggggctgagcggttggtggaggaagtggtgaatgagcaagaaggcgagagagccgaggaagagattgataatagaggcaggaagtgggtaagtatggaaatggatggtggtggtgatgatgatgatgatgaaggtgagggtgaccaccgtatgctgataaccacgggccagacctttttcggacggttctgtcatgagacgggcaaatagaaagtaccagattacttaccaacacgcctctcggtctgtttttttcactcaactatttttgaagcactcgctttttttcttttttgggatgcctctgaactttttttgtttttgattaatttcttttttttttttttttttcccttccccttcgcttcttcgcgtgctctgtcggtctgtcaactttcccagcagtatggtctttttgcttatcaggcagcccttctgttatcgatctcccagggggatctacgaccgggggctattccttttccttcttctcgtcagggttttgctttttcctaccctgcaatctgtaggttcaaaccgatagtttgacggaataaaaagtctgaatgtctctaaacttcgtttactttctctctttccatccgctaaggagggtggacagaatttttgcgcgtgagagctcggtcgcgcagttccctcacccttttttccctctttgctggccaattccaatcccatttgcctacggcctccccagatcgaatctcccgggctccaccgcttcctattacggtttagtgaactgggtctaaggggcactgcgccttcccgaatcgtccatagcgtgtccgttcacgaataagcgttattcatcagcctatcattggcgcaccaaaccctggcgcttcagtcagcggtattctaggcaaccacattggctgcttcggagattctatcacgatatcccgagcttccatgctccgctccgacggtcacactatgcactctttcgttcggtagtcggccataacgaagcaccgccctagtggtgctagctgttggactaggtgaccagactgcataagatgagcccgaagtcccactggtccctatttgggatgttgtggaagcccgtaaggctactgcctaagcacaccggaacaggttgttatctctccgacgcggctgacgaaagagtcccgtttgatctatctcgctcatgtgattggattcttacccacccaacctgacaacaacaaagtacctttttgcctgagccctctttttattttcctcttccggattgccgatttgctctggcgtatgtaaaccatcatcttctagactttccataaccttccgacactggctgcacaaggcgcaaggcgcagctgcgtctgactttttgacactctgacacgcctccttttttttctccttgttcccactcttctaagcatgcccaccagataaatctgataggtaccattcacaatagtaggatgattggatagtgaagagaagaaaagaggcaaagagggggggccgaaagtatccatccaaacgccgacctccttatcgaaacgttcgcttattttggctctcaactttcgggactaatctatttctgaccatctagtgaccatcctgaatccatcctcaatcctccgtacggagtaatccgtactgttagttacaatcaatcaaaatcagccgactcatccgacctatctatcaacttagaccgtagcgaagtaatcaatcaaccaacagaatcaacttgatcaagcgccactagccccccccttagtcgatcgtggcgtgatgtatgacaccgataacctgaccacctccccctctcccccaaaccggccacaacatgatatgatatgatatgatgtgagatggatatgatatgatcacagtagactaactaacgctactacctacctgcttactttcctgtaccggtaaagttccttgccgataacgctaaaatcggcaacctgcgtcgatttaggtttcgacacatttgccctttctctctcccacccacaccccctcatcagcgcggattttaatttgccgccctacaccgactcgggggttccaacgcgcggaagttccgccctttcgggatactaaaaaagaaaaaagaaaaagaaaaagaataggggaaaagaactagtctgcttaaggagatacttgttgtgaagtatctagttagtctgcatatgtgtgcatgtgtgtgagatatgacgacgaccacatacatagtctaccaacgaaatagggaactcatcgtcaagtttgcctgaatacgtaagtaaatgaacccggatatgaccggaaatgaacgccattcgtctggattgacaaagcgtgtcgtctgagcgtgtcgcctagagtgtatacgaatgtttggcagttgttgctttcgagttgaaaggaaggaggagcgagcgagcgaagcaaactcgggccccctctctcgcaaggtgaggctgattctggatcgatccgttgattgataagtcgatatagatttcttggcgggggcttggcaaggggcttggcgttatagctgtggacggaaatcttgaacgaggagatgattctgactaggcgtcgggcccgggagtcgggctcgggagtaacggcttacgctacgattaggtcgatcttgcgcgttaaaatagtggaggaatgaaggggcaacgacagctgcaatggaacgcagtgataggctggctatatgtgaggttctactgtctagtgtctggtctagactagtgggcgttgggtaaaggcatacgacaggttggctttacttgatcgttaatattggttgatatgtttaaaaagaaatatacgattaatgataagtctcaacagaatgttccacaaagcaaagagaggatgggggcgtgttctcaacaagtgaagaaaagccgaaaacacaagccgtgacctgagtgggacggcgcagaggtttaccgcatccggaacgaacacacaacggccccatcttgataatcaatcgacctggatagggtgaaggaggcccatcggtaacatatttgaaattgcttatctccgagctggggtatcgccatctccgaatcctgggaccggaagagcatgccgaaccgctcgtgcttgtggtgtcaacgttccaatggagcaggtttgcccgagcgatctttgttttttgatgcccgcgccctctttcttctacttgtgggggcgtgggatggatggcttagtccaggacttgatcgagctagtcgagtagtttgcatgttgcctgagcggcaagccggatcagataactttacccacacatgctagcatgggactgtccgtggtgattgtcgtcggagaagacgagtccatgtgttcttgtcccacatgggtagcttgtgacggcgggacgccgctgttgtggtgctgtagcatcgctaactagtactcagtttgtataccgtagtgcttggccatggtaggggattcatatggtgcgatgtccgtctcagcacccatatacttactagctgtcatcacgccacgcggccatattatctagacttgcgtttgcccacgtcagacctcggcttaagatttattatatatcatctactacttattatacaaaactaaagggcatgaaacagcgccatccggtacgaacagaccactggccccacaggacagcctagacctttagaattttccaatgcacacatccaccgtttgagaaaagtaaaagaaatagcgtgatttagaatgatctggtgtcatcttctggccggcaccccggcccaaacctgatcctttggtctttgcattcccccatcacttgaatcatcgctgagaattaatcatcgcgctcgtcgatcatcaaacatcgcataagagttatcttcgctttccctgactctcactcgtgcttcgaacgcctcgtttgcagtcacggtgtcttttgttctttgttagagggagagaccgcagacgataatcaactctgagaacacagattatgcgccatacaccatcactccgttaacagagaacagattttacaccgcatttagacctgctcggcgccccagccctggtcgttttcacgcatgttggaagggggctcgatggagggaatgaactccagggccaggtagcccaggccgatgaatccgatgatggagccggcaatgtaccgcaaaacccagtcgtgcagcaggatacatccaacgaagatgtagactacgcaagtggtcaactcattagcagcgatctacggcaatcacggatagtgtgacttacaagcaccacgtcccaggaaagagaaaaggaaggacgcgtagcggtaaacgtagtcgggaacgttgggcaggaattccaacccaccgacaactaaagccatggtgtaagtatgctgtcatatgcactatactgctgcctgatctgagacttactgagaccaaagagaatcacgtaaatgccgacgatgatggagctcatagacgcagggaaaaattgcgagataccaccgagaaccatcaacacgccaacggcgatgttaacaattcgactgcagccgttggaattagagtacatttcaccaaaaatgtatgcgatgcaaggccatcgtcgacgtacaagatgttagaaagatccattttggcaagtatttaggcctaaggagctcttcctgctaatataaccggtcgtcgggatataggtagggtgttcaacgacgaagactgagtatcggaacgggtacaaaggggagagtttctgtagataaactgggttagctggagaatccaacagggtgaggccaacgccggattgggctccggcaggctagccataacagctacgtcaggtatggtcgcgcgagtgatgaccactcaaagggattgtgggcagcatgataacacagccagaggatggaagctcacctttgaagccaagcttctttgacagatacgagtcggaaggaagagggcggaagggaaaccaaggagatggagaggctcaagcatcgtcgtcgcgctgtcgcaagcagcgggtctgccaaggcgctgagtagatgactcagcaggtctcgtctccggagcgcccgcaaatacgcgagatgaaagacccatttcagctactatttcgggatgtgcgacgacattgattctacaaaggagctactatgcggcattgaggccaggggaaggagctagatgcactcgacaaatctcatactattttttttggtctgtccactgtctctgaaagacatgtgtagacttcattgatcacgagggcaactcatacgtcatatctgacaggcagctacgatctgtccaggtatgacagctgttgacgggcatactttgctttaaacagatgcctgacggactcccgattatgtaccagagcaaaacggccctgcactagccgttcaaatcgccatgagatctccttgcctcttctccagtctgacagccgacaatccattggctagtcggctcatactcatcgagtcgcgtcctaggtcggcgtagatagcgtccaggtccgtaccaaggccgacattatcagcagtttccaaactgcgcccatcaataaaaggtgcaatggaaggccacacagcctgggcattgttgaaaaagagatctacgcccaggtcgcctagtcctttgatctcctttatcaactttctcgtttcgtctcggtcattatgggcttttttcagaagattgttaagatctccatctgcaaaatgcagtcagttactggccacaatcttacatgacgcactcatgcggtgaaacacacgtaccgtacttctcattgacgaactctgccaaatcacctagattcgttgcaccttgctctcgatagcgattgtatcccccgtccttgaggaccattgttctctcctcccagctgctctcccctaatttccgtatatcatgatacccgacctcgataagcttattgactgcgcgctgtgtcaggtcgtgcgagatagggcgcgatttcagcatcgcgtccataaccatagcaagtagtgtatccggggagctctccaggcgtccctctgcgatttcggtcccatacaagggtgggcgaccaaattccttgacgaccttttgcagtttgggcttgcttgagaccctttcttttgcttctccttcatcgtcttcctcgccttctgcgtcctggtcctcttcttcttcaccaccttgctctttcacaaagtcgacgttctcgtcatctgcctcatcatattcttcctcttcatcgaattcctcattatcttcctcgccctcttcctcaaattcttcgtccttataccccgaatcctcctgaacctcgtcatcttcttcaacggtgtttgcagctgacttggacgctttagtaggcggctgctccttttctacctcgaggcttccttcaccggtgctgatgtcagggtctctctgatcgagcttgcgcttgggggcatcagctgcgtcggtttcgctctctacctggggcgatttgtacttcatcttggtagagagctgctaatatgcgaacaagacgaaagtgacgtagaaaggttggagaattattgtttccaaaatcaattgagttaagatacagtgagttgtcgtagttgaaagttttcatggataaatagtctggggtagatcgtagatggcttctccgcggctatggcgtcatgatgaattcagacgctatgccccgtcattgaattgaaacaattcttgcatgtaacgtaccagtaactagagcgaaataactatgctttttaagattagcgtgctaaactttatggtctatcacaggacaaaatgttgtgtctgagtctacagcttggctttatccttccggcgcagcgtttcctggaccaacttgacagcatcctccgcacatccaaatgaagcctgatacccaaagccaccatggccatagttatgcacaacggacactccgtcgaccttctccgcttcaatacgcggcccgccctcacggagggggcgtagtccaacaccatgtctgatgatatccagaccttcgataccctgtcccttctcgaccagctccgggcatagagctatggcccgcttcatgattcgaacagctaagttgggatctggcagcggatcccactggttcttctgatacgaacctccaatgacagttccaccacctgctgcacgggtcatcatgtaaacgacctcgtcctcaccgtcgtcagtgccggaaatagacaccatcttacccgggtcattgcgcacgacgacaatctgaccacgagcagggtagagcttgtcatcgagcacaccgcccaacttcttggacgagagtccggtgcaattgactaccacatcggctttttggcctgtgtggtggccgtttgctgcatctgccacatgcttcaggacggctcgtttgaagacgacaccgtttttccggcactgaccgactagccagggtaggtagacggcggtgttgatgcacactgatgtgaatttggatgcgttgtcgattccgggggctagctggtcggcggggatatcttggaacttttggaggttaggagtgttgtcggtgagggagagtatgtgggtgtacgcacatcaggaacaacttccatataccatgggtctttttgcaccagttcagagaaccattccccggttgctgatccctgatcctttgtacggttgtaaacaatggtttctgatgaggtatgcttagtagtgttcgttaatgagaggcttggagcgtaccttggaagtgaatgcccgcttcggggtggttcttcgtgagctccctcagggcgggccaggtgtttcgttcccatctctcatggtcacttccggcctttcccacactgtgaagggagaacctcttacattagtcttttgagacgtgtggaccgatacacagctgagggcctacccttggaggacatacggaagataattggcgccagcccagggagaagtatactcgatgtcgtagtcaccgggcatgtgctttgcaaggactgtaatgctattcgaggcatcctgggacagtagatatgcggtggtgagaccggagacaccagctctggtgattttcaaaatcagcatacgccggtgacatgtgagcttgcggggaagcagctcctaccccagcattacaatgcggttgttagccatcttccgttcgagcaatggagatcagatattttcgaaaagatgctttgcaaaagactccaatggcacagacgggcttataagcaagcacccaggcatacagataaagagataggaataagcatgagtcaagccaagaggaggggatgttgaggcacgatccccgtcagtcaaattagttatcggaggccgatcccgccattttgataaggactcgactcctctttttcttctcttttgctcggacctcattcggcgattacagtaaggtacgggcggcttccggtaaacactaacgtgtaattggtgtatatacggtacaaagtacatacctaacggaacgcgtcccgaccgcggcttaccatacggaccggctgacacaggcttgcccggcggtaagtataggccaggaaaacaggtccctatattgtgaatcggtgggtatggaaagaaaactaggatgatgatgtgcaggaaggctgatctgccaattttgttcaggccacttcatcaggtatgcctgcatggccggaaagatgttaccagcaaagcgccagggttgtctggcctgaccgctcccgaacagacagatccattgtaagcgccgaggcgacggaggggaaaggtctttcgtcatcggtgacagcctcacacccgtgctagccaatcataacaaacatattagctcaccgcctcgtcctcggtaaggaacggggctgtaagagggtaggttttttcctggtaaggtaagttaaagtaagttgattctgtaagtaacggggttcctccgcactctccgtccgaacaagaaaagtctcgcctgtctctctcgcgtgtagatcgtgtgttgcttttctctccctctttcccccattattcactctccattctactgcgccaaaacactcgggctgttccccctttgactattgtgttgctccccactttccctattgtcccgcctctattctcctctgctcgacgaggctcgtctgtgttccccttgcgccaaatgagggccgttcgtcgggcagggctatacatcaaccatggcggacgctccaaatggtggcagaatcgtgcccatagtcacgactgcccgtcagcactactccagctctccgacagatgaaagcatggccaaaacaactccgcagacgtctcagaagaccaagatgcctcgcaatgcacgcaacaagactgcagaggcggaaactctggagattccttgcctcaatgcgctagggctctatgctctccccactgagggtgatggtaacgtggtccctgccattgggcacctagcttcaattttggcctcaattgggttaaagaagcatgctctccagtctatctaactgtccatcgtaggcaactgcctttactacgcgctgtcggaccagacttatggggatttcacgcacgccgacgaaatccgtgatcgtcttgcagaccatatatccgccaacaaagactacttcatgagcttcatagccgcggccggtggagagcgtcgagcccctcgacgggctgcggctgcagccgcccgacaatcttattgttcctcttcgtccgctagcccggcgcctccttcagccaaggataaagagcggagctttgactccaaggtggcagagtcccggaagaagggcgtatggggaggagcggaggaaattcaagctttctgccaggccttcaagaaggacgtttgcgtctataccatgtacggtattcaaaattttcgtgacgttcacgcccctgaaggtgaggaacgcgacattatccatatcgcattccacgtaagataccttatgccatggttctactttacggttatctaacgggcctaggactttcaccattactcctccgtgcggcatagcgatgggcctcacaccggtctgccttgtattcccaaagtcggtaaagaacgggaagcagaggcgtcagccgctgaacccacagttgtcgacatggctaccccctggaagatctccgcaattcaggagggtctggggggtaagtatgaccaaggcgctatagtagaaatgctacagcagtgccgcgggaatattgaccgggcgtttatgaatctcctcggtgaggatagcaatacgtctctggcagacgcgccctcgtccaaggccatcatgaagtcacgcctccaagcatcttcgaggtcgtcgtctcctttcagcgtcggcagcaaacgttcagcagatgaaagtgacgccgacgacagccctcagccggctgtccgacgtacccggactcgtgagagtaaaaggcgtatcctccctgatgtcatggtcgggattgagtttagagacgatcagaatgatctggtctcgttgcgattgcgagtcagcccagacactgtcgttcccaagcctgcagtccagccaagcaccgagcaggctgaggccagctctctagagtctgcaacggatagtcccagtctcttaccacaggacaggaaactcaggatccggtcaaaaactgtttcaagtgagacgtctagcattccgaatgagtccagcgatgagcgaaagccaccccgacgaagccaacgaatttccaggactcgtccggcgcctagaagtgcttgacaattacaatctattctgtggctctccccttactctcatcttcacgtttcgagaacatcagtttcgaatcacaaatccttctacgcatacgacattacgaccccatccttcaccttcgcttcattgcttttttcatcattgcattacgagcgcgttgggtgttgatcatactatcccgctttaccattagagcatctgtcgacaatcacatttctcttcctttccataccactggcgacttggagcacttacgacccaaatcattttcctcccgcatattttcaccatctccaaagacatagtcaatgacgactttttgacttgacttacacgcgaagcatacgacacataccatctacatcttcatgaggcgttattggacggttgcacattgcataaatcccgttaactttctaacttgcatgcatgcattgggttggtgcacctttcggaaaagttaccttctcatctattgatttgccctggcggtcttctggagaatactttcatcttgggacgattctgctgattatactgctgaacggatcacaacgactttgatgatagaaggagtattgtccgtcaaacacaccgccttgcttgatatcaccggctattactgaatagactggtagaggtccgttatttcttattgctggactcttctgtggctagttagctcttttactagcgattatgattgagccatgagactcattcgccacgaaaataaaaggcacacatatcgagtataccatgtcagcttctctctagagcacgtagacgcatagacagtatcaagcgtacctcgtaagccaattttctaacatcgtaaagaatacctagttaaccaactacctgacaagccgagtgaccaattgccaggactactcaaattcctactccaacatcatctacatacttacatgagcaacaacaaagcaaacaatctccttcgttcccaacatccagcacacaagatgtaatgtaatcatcaatcaatgctacccaacgagaccaagtattcttccgcccttacggcccataccataactagtactctcaaagaccaaaccaacaactcacccatacataatgacagacaagttatcaggcaccagacccccaccccctctttctcttttccttccccaagcatgcacacacaacacatactttctcccaacaatccaatcgtctcccaatgaacccctactgagtactcataattattatctattacacataatattcaattttacccctccttctcctcccaccatccccactactagtacttagttccggtgtggctgaccgaccaataatcagctagctataacaaacccgtcattttttatttctattctctgttgactgaaatagtctaatatagacagttcacttcatctaatcctcgatggtctaacggtcatgatttccgcttgtcaatcccatctcgggaacaagcgcgggagacctgggttcgactcccagtcggggagatttctttttgcttttttattattgtctgttgtcatttattcttttggggggatggtatttgtaggatgatggtgctttctttattttgggggtttcttgtacggtggtatgttggaggttaattgataagtttgtttgatttaaaagggtgttcgatgttatgctgagcgtggttgttgtcggttttccgatgaatgagtatcggaaagtaagacaggtggtgggttgatgatgatttaaaaaggatttttattagggatttcttagtttctcttgttctattgtatgattattaaattcataggatagtagagactggctatatgtacatgactgaaatgacgccagagctggttgcttcacttcgctagtatgtagatgtcaacgagaagaagataaagagaatgaggcatttgtctggcttgctgagattgaggacaatgcgatacaatatggtcatttgacgggcgtgaaatcgtgaagtgatgtatgcatatctgtgatgcttgctagtccatagtctggccttctggtaaatcccttatgacatggtggactgccgtgggatagctctgtttatttgcaacccgatatatttaaaggccacgtggaggcctgctctcttttctgggagcacacatggagcgcacgtatatttgagagggggcggagctaacacccttcctcgcggtttggcgcataccctcatctgggtgagagcccggcgtatggctcagggcagtgtttgagagtaagatagtccaatctcaatgctcatcccgtggccattgaactccgggtcactgagctccgagtaatggctgtatctggccgcaagcgaacaccaggtgagtaacaaagattatagagttcatccacataactgctggtagccaaatcaccggctacaacggtggcgtgcgaagcatgtttggcagagtccagtgatcgcgtagatagcttggcgacatccaccttgacctccttgcggaccataatatcgccaagctgtgagagctccgtcaacgtttcctgggagagatcgccatggggggaatccgcatgcttgcgcggccaaagtttcagaacagaacggatggaaggtgtgatatcggcttccgtggcggagctgctgcgtgcgtttgaatagtacagttccctgcccagctccttcgcaaatccatcacttccgatgtttgcgtcgttcagttgttgctgtgcgcggaagaggcgtaggggcatgaaggtgaagtccgggttcgagacttgagtatccagatttccaacagcgcagaatggcagtaggatagagtttgatgcatcagaatcagagaacatccggcaaggggcaatgagaggtctggctgagaatttcgaggccatgttgatatcgggaggaagtgcgctttcaagcgatgtcatcgcatggatcagttgctcgcggaagtcatcgatctctttgttcgactgggctgcttcagatttcagccaagacaagcaggtcgatatggtccatccttccatgtgtgaaatcagatcgaggtgctgaatgttaattcgtttaatcggtaatgttgatgaaggcaatgggttaccggtccccttcgctgttagtacctcaaagtggtcggaaatggtagggcgcataacaaatgaaacgaggtggacgcccggctcgtaattgcggcctccagtcgcgtaatctcgcatgtcttttagatgctcgcccaacacaggcaatggaatgtgcattcggctggacaaaaccgatgtgacattttcgaccgcagtgaaacggaaacctgcggcggccagtcgattcgcttcctgcttgtccaaatggcgcactgtgaaaagcatttgtcccttgctattgtttaaccgagaatatcccatcgcccgagagaagcgcgatgtcggagcagtcgtaaccagtacatcgtcgtatagctttccgagggccggcagaggctgtcgaacctcgtcggcgaggtcctgagcggtaacgcaaaaatgtcgcttgaagagttcgtcgaaatcgttctgcaattcattctcctgatccagggcctcacccttggcaagaaagtgctccgtcgcctctttgtctgtctcgatccgacttctcataaaagggacaacatccttgaccagattccagtgtctactcgctcggaatgcccaaaggaaagcgggatggctccgggtaaggtcgtcatcgttgaacgtctatatagttgggggaagattctgcatcagcacagttcgggaatgaattagattgcaaacataccctgccaacataacgatcgacaatcttccggctaggaagcaacgcgtgaggagtgaccatgatccgcccagactggtcaaagaaggcacaagtcaagacgagctgtcgagcttgtatgttcagtcttctccgatttccaccagcaactacggcacacgccgtcaaaactccgcaagcagcgcatgcctaacatccgttaacatccgccacatcaggtaaccctggacttcaaacataccaaaacagaactgataatgacaacttggctccgcgaaagctgaccattatgcttcatggttgtgtcatgattgtagtagtatgtgccaactgcagcagtccaatgcatgccggagacagcaagggcaagtacacaaccgcaaataccgcgtcgccaccaactatctgtccatgtagccctccaccgaaagaagaccgtcaacgcaacagtactagcaaacaccgcgatgatggtggcaccgacgatgtttgcaacacggtagctacagcgatagttgctgataccgagctgaccgatataatgcataccgcatactgcacctcctgtgagtacaccacccgtcaggattcggatataaccggctttctcgctggctcctatgctgtagaaggcaacaagcagaacgacaaccgggagcacaaaggatacgcccgtaaacgtcatgctataaatgatctgaaattgtgcttccccgtttcccaggacaatggcacggtttccaatgtaatgcatgcaccaaataccgacaccgcccattgttatggaggaagtgagcaatagatacctatatgtacggttagacaggcgcttgttgttatcatgcagtgaagatatcgtaccagttgtacaggccagacctcgacgtccgtcggtgcagaagctccagagtggtggtacatcccatcacactgactacgtaagccaggaagatgaaaccacccatgtaagacacattgacatggtccccgtggggagccctgtccgtgagcaacattctcggcgtgagaagcttgttagaaccaaatattacccgcaagacattggcatggagaagatgatgaaagatccctcactgcatttgcgagcatacaacactggggaggttacacaacagcagcaacggggcgatgcatgagggaaggcaaaggcagagtaagcctaacaggggcaggcctaactagcaacatgcgggaattctttttaatataacaatggcattcagcttccaggagctccacgcggctgggccgtactacgtattagccatggttctccaggtaccagattgacggaccgtaatgcaatcaaggacattaatttatcgagcagactaaagtgtgttatgtccgagtgggaaccacttattgcttgcggaggccacagagacccttcaaatttttacgttggctgtacgcgtccaattaatatgcgagggccccagaatgagggtctggcgctcttccagcgttcacattgggcaatgtaaactaaaatgtcagtttccttccaaggcgaatcaaagtgtgatctgtgtctgattggatcagaaccatcgatcgaggttgcaatcaggaaccatggggcattgagtttaccgggtcggttccagacttgcagccatgctcggcgagtcagaaacatgattgaagggccgaaggctatgatcagattagtccaggaaactaaaattcttcccctctgccaaagtcggttattacttgtcgaccagatgggtctacgtttatggctctcggcggataaggaccgctaaagccaaccctgtcggacgagggccaagaaggttcagctgcgccgtctggctgaaccttcgctcttctccgaagataaaccagttttgcactatagggtgagccatgcaggacaatttcatagctgggaaaggcctatcggggaaactgaaagatgattacgtatcttaatgtcgagcgtgtagacttcccctaatggcgagaagcccgtcagcacatcgttcgcaactccatcggttaaatcatcctctagccactaatacgtcacgagtcctcaacttaggtagcaactatccagaggggccgtattgtagcgtcagcagatgaaactcaaggcggaaccagacaatcagaaccgagcaccatgactgatggtacactctgaatcgagattttcgacgggatggaaaagggcagattcgccaattgccagcacccacgcggttgacaaggaccctgagtggtcagtggacgcagtggcgggcttagctcggggcacgtccattgggaatcatgcgattcacaggcacgggtaagacacaatcaatctctagcagtggaactgagaaggcgagctggaacccgacggatgggaccagatggagaccaccggtagcacgtttgaaaccagagtcttgcaccgttggatgagctgaacgtggccgagtgggaagtaagagagggggaaagatccaggcggagctcggagatgcactcccgttggaccatcacgcgtgcactaggccacttcggggttaggcagcagccccgtgactcagatcgtgggttccttttctcgattggctaatcctgatctggctagctggccgagcatgaactccgctagtccctttgtggtcgccacccacacaacactgagatcctcttccagtgaaatctgtaagcgatggcatcttctctggcagtcagtcaatatgtgctagccgggctggccaggaaattggaaagagtaaggttttagacaaggatgtacttcctcctttgctagtcagaaaccttggtaggatattataaagttaaacggacggagtacccaaccatttcaagtcaacagcgatgctactatctagtagtttcagtccaggttgaactctaatagagtcagtagaagtagtcaaataacatcaggtacttttgccctcgtggaaatacaacaaaataagatgggatccgaactatgagcgtcgtgtcccgtcagcagcagcagcagtagtagtagcacgagaacgcgacaaccaattaattattcgccaaatccttccggttaacccctgccggatattcctcctactaaccttactgcgtaagtcagaactcaatgatcaactcgctccttgtgttgactatctctatatcaaagatgatgagtttctgtcctttgggaaaaatccactgcaaatttttgttataactgagccagaaaccaaaggcccactaagtctgattttcacggaagtagaatatcctcccgagcaatccgtgaaaaaataaaagagagaaccaaacaaccaagtgattgataaccatggaagggaatgtttccaattccataaccattccatagaaacagcgctgacccgctgtaagcacatcaacacacagtagcacaagcatgagcctgcaggctgcagcagccagattaatgaatttgtcaccctttccgagttgtgctgacagcactggcgctgccgcccaactgatcggatccttcattcctccatcgcatatgtagattactattgaagtatctaggaagatcctccatccttctacagcccccaagaataatagtaattggtatgcagagacagccccagaccaggcctaacctagcagaccacatacatcctgattcctccccgatcaacacgctccgatcatacaatccagcttattccgggatacctcggcctcactcctatacgatccagccgagcagcaattgggctaggcaggtccatgactagattaattcatatgacagccaatatcacccaattaatttagtgggcacgtgcctcactgaaggattttttctattgcataatagggtatagcctcggcacgcattccgcaacctcaggggataagcaataggagaagtgaaacaagaaggcacagtagcacaacagtacagcactgcataacatagcacggagcagtgaaggtgcattcatcaaaaagtggctgtgcgcacagtgcatgtgtagctgaatgatggagccatgagccgtgttgtggtggtcctctggcccactcctctgggaatcctttggtgtgccgaaagatgtccgtactcggacggggctaatgcggcagtaaatcttgataaggtagatgaagtagcaatccatgaaattttttgattaggggtgattttgatagggaaagagtagtttggatgataatattttctgtgtagatgcgagaatctgagtatactcagtagaccacggccacttgtggcatctgcacgtgttgtgatgcgtctagccggtaccttgcatgaaaactccgctttgacaatttacaatcctggataagcttctgatgtatctcaaaccatccctataatatagtattctgtgatatgtggtaacccccgtcgatattaatattgtatccggatcaagactcgaccaagtggctggaagacctgcgactgactcgacgacccagttttgttcagaccgcttatttggctatgattaatcggcgaggccaatttcgaggtacacagtagttaattatcttatctattcattctggttgtttatccagtgcacagtacctattggggggtaggctcctacactatgcttgttggtcaattgccaaatcatcacagcaactactcaatttctatctccatctatatatagtcatcatgggggccactcattagccagaaataatggcggatatatagagctgggggccaataatccaattgattgctctttttaggcaacaataaaatactagtgttaaagaactgagtttcaatcttttggaccaaggacaatgtatcaccttacctacagaatgttatgaatccctatcccataagctcatgctctataaggtaatgtgcgtagaagcacttaaaagcatacgtgtcgacactaagctactctcctctcccttcgatatgattcctcctcttacgatcaattgagagatgaatgcctgagaaaagagcatctgatatatacgataatgacaatctattctctatttccggacgattgatatattgctcatatttggggccataactattagacaatgcgtgttatttacttatcataagagggtacataaaagctttaccatccatactctgcttgaccagtattcgtacaatcatcgggatctatttgcagccaccttcctaaatactcccattctattgcaatcacacgtttattactcaattcgaccattttcgttacatgcttttaacatgatagtcaagctgctacttactgtatgagcagccaggaacagcaacatggaagaccttaacgactatcttttccaccagtgggtcccggaggtttgtgagaagttggccaggcaaagtaatagcagctgcataacttgagggagtattcgaacctctgttcatacccgtgacagaggtcaagaagacgtatgatgttgtatgattagtctgaattcccccccccccccctccccaaaaagttagagtatggaaaatcagattattagcacagaatctaaacgttctaagcaagtcgcagcttgtcaactggaccgaactcaccatttggacaagtgggtattctctgtatataagtcccactaggtacctattcaatcaaactggctattatctagttatcggagtagtatataagcaggattaactagaaagccctgctatattcacttcatattacatttctagtactatctatctggagaaagcgaagcctaatctcaaccaggtacattgtgaagctgtctacaattctgatctgtctgggtaatacttctgtcgtatctccccgtactagatacaatggtgtccgcgaacttgaatattattattatgattccaagatcattggggggggggagaagccggggttgctcaggatgagaatccggcttgttttggaattaaacaggaaacagctaagctgaaatatgggatggtgtatatgcagggaaaatgatatctaatcaaattacatgcggcatagctcctctagtgaattgagattcgtagttatgttgttgtttgtttacaccgaacgtatcaggatatttgagttcgttgtggatagtataccaacttgtttgcatcgaattgaaagaccaaattaagtgcggtcacgttgtactactactacacttgaagacggtagtttgctgtcttgcattttttattctatcggcatcaagatggtattatactataggtcgaacctaggaaagaccagcatatggggaatactgttgagaatgattgatgattcttctcgaccagagcaatgcagtagcatttgtatgccttggagatgctgtccctttaagcgcgttgctagtacttgctgcatgacgcttgtggtggttatttaccatatattcattgggtgatgtacgacagactggatatgtctgaatccggctaagattgtgtcatttatgctgcttcaacaatacatagtataagtagcaagatacagggatttaagtcgtcgatttgctcttgtttgctgcgatgtctgatcagagtgtaaagtgacaagcaagcctgatgtcatcttacattagcgtatgatatggttcgatagagatagatatgcaggttacctgcatactagttgaggttttgattgaatcgctactatagcccaggaatacgaccataactacatctaaaattgacaggtaccaccatcaattctatatagatagtctagacaaggtgtgcggggtaagaagcccatcaattagatttcatttgtaactagcataaccatcaaggtatccccttattatcatctatcaacggggaatttatgcaagcagagcctggatcttctgctccagacccttggggttggcaccggtgaggtcgtcgaacttcttgccgtccttgaagagcaggaaagtgggcatggcacggataccgagctcggcagcaacctcggacagttcgtcgacgtcgatcttgtagaacttggcgttggggtaggtgttgctgaactcctcgaccttgggggagatagccttgcaaggaccgcaccaggtagcgaagcagtcaaggacgatggcgtcggtggagttggtaaccttctcggcgaactcggccttactgcaaagacagtaaaattagtagtggtctcagaatggatagaggggtagagtgcggggagagagaggggcggggatgtctgctggtaagacgatgagcttcgggggagaaagggaaggaattgcacatacgaggtgatgtcgtgaaccttgtgagacatggtggaggatgtgtgagagaaagcgcgacggctgtggatgaacggagttggacggaggaaagagggcgctactgcggttctagtggaagactggagagagaatctagcggaggaggaggaagagaagaggcgtcgggaggccagagtggatggtttaaaactatgggaaggttgagacgacgattagctccgaatgaggggcagcccagcaacggaggggcacaaatcgaatttgtagtttgagtgacgttgcaccgccctctgactaatcaccccggggcgtcgaagcctctcggtcacagtcgaaggcaagggtcgcttctgggcagtatgggcttaccaagtggcgcctcgtgagagacgaagacgggtttgatttgtcaggctaacagcagacattctggctgcaattgaatagtataatcaacagtaaggtatattacgggccggttgggcaacttggttggtggaagggaaaggggaaggagatgcacgaaacggtgaaggaagaaacccccaaggcaaaatgacgtgctcccgtcgcttatgaatcgcgaccggtctggacaggcgcgctcggcctgaggcagcagcagcagcagcagccgccgccgccctcggcgagtctctccgatcacctgactcaagagcggaagaagatggcagtataattcacgggtgtatttggggagagggttcagggagtcattcgtatcaagttggctggtttattgtctggggggtatggaaagatccatctagtgatatttacaggcagtaggtaagcggtccaggatgtcatccatctctcgaaagataacaggccgcgatactcgagcatatagtacagtcaagacattaaacaatagcacgggtggtaatcgtaataaggaaacgtgaacaggtagattgtgtcacaatatgtgcattgaactgaagaacgagaatgcttcgagtctatcaaaaacgcgtaagtgcctgcgatcactacaaggcagtgatcggggccaaactcattcaaacttccgctgatgtgggggtatcaacaaattcgaaaagtaacaatgcccaccaacaagaccagagcacggacacaaccagtgcttgacccgatgagagcgttgaaggaatataagcatggctacatccagcgccatgaaccctgaggaaatccgccggggaagtatgaggggaaggggaggggggtttctggaaggaaaaggagcgacataggaaaggtctaaacgagcgactggggtatatacgggaaataatcaaataaaatgcatcgtgctgacatcagaagaatctcgacacgggcaattattccacgtagtagcaagggcgtcactaggatctacctctggtgatcgaagcaacgttgcgcacaggatggtccgttggcgacctggttcaattcgagcgcccattcccgtggttatcagacgtttcgagctcaaactcagcagagtgctcttcaatgggactgaattcttcttcggcacagaaggactggacattcttcaagagtccttcgttggacttcggacggattgctggagtcacaagtacaggtcgccgggcaatttgatcatgccaggtctcctctgcttgctccggtacgctatccataggcgagtccttgtcaggcgacgcaccagctacatcagggccggatttgagaccctcatcctgattggtcccaaatctgacaagaggttcgctaaccggaacgtcatctccattggaggacccctcatggccctcttccatgatgtttcgcgatgagctaaggctggtgcgcagtggattgctcgccttcttctgagatatgcgacgtaagaattgtcccgacatccatgatccttcggagtcaatcgatgctagagattgggacaaaggaagattgtccgggtcaccttcccagctgtcgcctgtccaagaatggtgaggatttctcgggatgtcctggggttctgacccagaactggggatgggatactgggtccccatgttgatatctgacatctcatcttctctctcgaactcatccaacacctctgggatatcaggtgattgaagcctagagtccggtggagaaaggggctcgtcaccgaagtgttcggtaaacttggactgcgaccgcttgatggtacctgaccccaggaatgtccgaggagcagtgacgaatgagggaggtgggccagacgactgcgtctggaccttgaagaaagattcatgagacgggttcgagtgctcaggactgcgttcatggaaacgttcacgatagctgcgtttgaggcgcgagctaccacgtcggaaaatagaagtaagcgtattaacacgtccgctgccatggtcagacaagcgccggtctgagtctatggttcgcgaaatatcggatgtggattctcggcctatgccatagagttgcgaagaagttgggctatacagctcacgcctcgacggcgaatgagacaaactgctgccagacattcccatgtcttgcgacggagcgaagctacgacgcatcacaagcttcggttcccgaatggagctatcgtcgatgttaccaatgacatgcacactatcaacggactcgcggccacgtcgatctgtgtctttggaagcacctctcagccaagatccagaagaattaccgcccaggaaggcattggtttcgtttgtccgaggagcatattcttttgaccgatcagatacagcccggctctccgcgccaggccgaccacgtggagctaaagatgtgtcttcagcctcgctggatggttcttggggaacagcatcggcttcggcttctgcttctgcttgccgctgttgttccgcagcgcgttgtaacttccggtgaagtcttgcttgatcttcaagttgcttgcgctccctacgccggcggtccctttcaagcaattccctgagggcaccggcatctaagtcgtcggctagcttgtctactctcttcttagaacgcgagtgctcgttgtgcgtggcataagccggtgtcttatccttccgaattgaaggctcagacggcctttgactcttagctgtcgacacccgaggagcttccacatagcgtatgaccggacgaggcgtccatgcagcaaaagtgttgaccttgaacgtataggattcgaaaatatccgagagtgaggatgcagcagagtcacgcatcgaaagactggtgtcagaacagtgccgatcggagcgtcgactctgggctccattagccctgcgtgtctcaatggaaaactgctccccgggtagcggagagggacgacgaggaatatcgatcggagcagaagccaacatccgtatttcccgttctctggcaatctcgtacgccttgcgcttactcagcttcttctttaacactgccgggccattctcgttacgcttggatttcagcaacgatgcagagcgagacaaagaaggttgttcgtggctcatggtggagtaagttgtgtaggcatcggaatgctggcctgctcgggagaccgggacccggttttctttcatcggggtcggttgctcactgtgtgacgtaggtggagggtactggacgacaggagaagacgtcggatgagaggcatcgtgcaaaaagctcgggacgacttcgacgggctgggcgtgtctgttcttctgacgtttggagtgcttgcgggacagtctgccgagcttgccgtcatcgaagctgtggcgaggctcttgtgacgactggacatccgccacggcaggtgcatccagttggatcgtatgccgcttgttcttacgaccaaacggccatatcgccatggcgcctggttgatgatacctcgtcccgcctgatcagtcaaacgtggacactgaaactatcggagatgacgttgaaccgggtgactggactcatcaggaaggaccggggaaggattagacacgcgaccagcaggcgaatctagagtaaataacaaggcacgggtaacagcctgaaataaacaaagcaccagacagacagggtgactgaagaaaggaagagaaggaggaacaatccaaggtggtctgtctagagacggaggcgaaccgagacatgcaaagcggtgggaaggactagggtgcagcggagcgtgtgggttgttgtaagtagtagtgtgtgtgtgtgtgtgtgtaggcagtggaagtagtaagttcaaggatgatccaggcgctggtaattggctaccggagtagtgtaggtacgggaccggggggaagatcagaaggggtcgtagcaggtgactattggtttagaacgaacgggtaatcgtagcaggaaaggtagtagtgggaatcggtttagtagcaatagtgagaccgggagccacgccacatggggtggcggaaaaacagagatacagaggggggcaatctcgttttttcgggtcacaaacaaaacaaggagtagaaaggagaagagaaacagaaaggagtggaaaagaggggacagggggagggaggggaaagaagaaaagcgagagaggggaacccgatgagatgagaaagcgaggaagatgaagaaaggaggaagagagggaggagaggagaaagggagacaagacgacgaagatgtagaaagcgagagatggatggtaagtaacgagcgagacgagacgagcagaaaggtaagcaagcaagtaccaggtgatgagcccaacgaggaccgacaacctgcctatctggcagcggtttttcctacttgacagccagaagagaagcaaagcaaagcaaagctattctgcctacctcctagtttaccgactagtaccaacttactattactttacttactcacttacttactcacttactcactagtagacaaaacggtcaaaagtcgagagcgagggactgagagggccgagacacaaacaaacccgcccgtttctgaaccaggggatctcgtcggttggttagtggttacacaccgtcgaccctccccggggccggccgtcacagcagaaccacttggaaccagtccaaatccaccaccgggacgcttgattttttccgttatattttctgattattttattattattgttattttattattaacagaaggagattagttcgttacgaacttacttactacttacatacttactccatacatacagctctctctctctctcttctgtctctgtctttttgcgctgctgttcaggtgatggattatatgcatcaacccgttcttctaattaacaaccccctccctcccctttcttttcccttacccaccaagatgttccttcgtctctctactggatagaggtccgtcccattttagggtgtctagaaggagaaatgtccagcacatacctgcagatgccgcctcccaactctccaacagaaacccgttttatgttttctttcttttttccccttctgtgtggttatcatttaatacacatctagtctagttggttcctattcaggagagagatcatgcgggaaacctgaaagacacaaaaatcgattgtcgaaaaaatttcttccaaatgtggagaaaagaccactagtggcacctaaactgccagattgcagcccaatccgattattgttaccagaaactaggggcaacttcattggtacctgccttagggagtgcctagccagtgaatgacccatggtatctgccgtactccacactccatacttagaaaccgaactaaaccacagcagctagtaatttatccggatattgttactgcacgacgcagcccactttacagcacactcggtatgtgcgagctcggtcagtaccacctcaaaacaaggcgccaatcaatacagcctcagctcctcccggggagggggggcgccttcggggcaggaggcaaggcgttttctcccttgaagatcatattatctcctagaacatacttaggcagatactgttattctttcgagatcattcttacttaacttcacgagatctgctaattaggacaaaatttatcgcccatgatgtcatgctaaagcttactcttccgacgactctcacatacgagatccatgcagcctgatcggaattgagtttatcgtgataagagagaggaagcttttgagaatgtgttaggcagctgctccttagccttttcggccgatgccaaggaaggctcctctggttactatcgagggcgcgcgcctatgacatatatattcagtgagctcgacatgacctgtatctagaagtaatcacaaccgcggaaagtaccgtgcaagacctttccaaacctacctacatgagccggatgcacgctcaatacccccgctcatcttaccgacggcaataaccgctcctcattcacaaagtaccctggaatactgagagcatgcatgattactcctcatgcctacatggtggcttcgcagtatctaagcgatcgcacttccaaattacagtaagcacgatgaaagattttcaagtcccgcgcccgggccttagctaagcagttgggccccatcctcgcgacatgaggaatgcttagaggggcgaaatgacggtccaacgggcttcttggggtggggagtcaccgtccccaggagccataaccgcgatacgaaaatcttagcttggcttcagccgagtgtgttagagccgatgataattttaccagtcgatacgatcagagatccagaccagcagagagagatacagtgtacttagttaggtgagtgggttgtgttcgatgctactctggcagctagggatcggtacatgaccatcggtatccaataggtatcactgctggttgatcgtatggagtaagcctagtactcagcaatgtcttactcacctgctacaaagtactaaactacctccatcggtctggaattggctaacttttcaccattttgcgctcctccatcacctgaaaaccactctcacacaatttacttagtcaggtaccgcccacatcttacaggggtgtatggactatggagcaccacgatgggagttcatgtttaacttcccgctcccagcccatccaatttccgctggccacaagctaataaattgacaattttgacagccattgacaggtcgagtatgcattggccaaagcgtgcagcacccatcacaataacgtaaaccgtaacggtcgaatacccattgtcagttagggagctgctgctcgcaattacagtggggccatttttttccgactaaagaaccttagggtccaaaggttgaacaccacaaaacttcagtcagtgcgatgtccgtcgatcactgtggttttgatccggtcatatattcgaaatgggcaagtccgcaggcctggacagaatcgaactgcgtcagtggctcactctagtcagctgcgatgagcggctcgactgtcctgggtttgagtgacctgagtcatccaccacgccaaaccccggcaacggaaataatctcctcttgtttactttggtccttgcagattacttactcggccccgactctccctacaaaccaactaggaacaagcgagttagtgtctagcccactcgagtcttcaatcattagttcgtactcgaccggaaatgccgaagtcaggcccatgcgagcccacttacgcgcgtgctgcattggattaggaagagcgcagaacagtcgcgcaattctactattgacctagatactattcaattactacacaatgttgctggcatcctatcaagttaccctattcgggtaaacattaacgatctctctcatcgttacctatctcgtgctggttagagcctgcgattgtcatgacatctgctagcccggtgcatcatcagactactacaaagtagtcaccgatgcgctcatactagtctcaaggttgtcatttcgtccactcgtatcttcgtccgttgagttcggcccatcagcccctcgcgatgatacacattggttttaagggtcatccagcgcaaatcagtggaccagtgttcctgattacttagagacccggctagatctctgtctcacgagaggcacgagatggaagaaggagtgagacattccgtctgactaacatccgctggaaagagattgggcgtgcacaagtggcggctagcttttcctgccttgcatgtacggaggcgagagcaggtggccgtcggcccttgttaatggggttttactcggagacttcagcgtggcttaactctgtacagcattcggctaggcagggaaaggtagccaacactcccggtaccatggttttagagcagctctaatcaaacgcacaggacgcccagagttttcttggtactagtagtctgttttgtctagtccggcgtccccctcgttctagatagataactagtcatgcgctccgctgcctatgcatgtcatgctccatcggccatatggagcatccagatgtgggttttcgtaattatcattcagtcactagtaaattatcaccgaacactctcggtataaacgctcttattgataggcggattaatttcccttctaggagggggtgtgggtctccctaacattaagaagccgttgtgtatccaaccaattctggtacctgactccccaacttattaggatagccgggtgcgttaccctgcccattttgtgttacatgctggactaccgaataaatattttgcagtgtcgccgaagtgtcataggcaacggagtatatatcatgattgtgtatggctgagaagataccgtgcagcaactaatgcactgcaatataaatgtccattccaatccgcaagtacatgcagtgtagaatcagcactgcattcaatacgtccatgcactctgcactccatacagaagagtagtactagtacttcaaccttgcgtcgcaaattcttttaccctcttttctcaagtactataaacatcctgcatgggtttctaatcaattgccctggcgacagccaatatacaactcaacacgccggtgtagtagccttctactgccgggaaaattctgcccaatatcgcatcatgttagttcacactatatgatgtctaactagtctacacatcccataatagtgcatgtcctagttccttactataatacccaacatctgagcttgtgatgaccgcgaacagacctttgtcaactgcatcatgctgtcgaatcaatgtctatatatagtatcgaaatcatgatataacacagctttgcagcatcaaccaaccctttatccttcatatgaaaaactatacaaccactcatcccgacatatgcatcatcggaataccacggaaagataccaatttgacaacagagtcatgaccaaaaccatggacgaccgcaccacacccccaggaaaaatccagccatttcaatacctagaccaccagcacgaggcgcccacaccataaatccaacaaccagacgcagctacaatttaagatgcgcatcgccaatgtcgaccaaatcacagacccgatatgacatgtccaactgtcaaggcaaccagacattttcatctacatacatacacacacatacatgctataacgtccaagcatcaaatccaaagtcaactgccagcaatccagccagtccagtctatttccaacagacgttgaaagaaagacggaaaaaatcttgttttggtacccttggcatggagctaacgtgaagcccgggagctgttgtaaggcaccacgtcggattgagctggcaggcaggcaggcagacagagcaccgaatacttacattttctgtgtgcgtgtatgcatgcatgcatcagtgctttctacgaaaactgaccacgaagttactgttatcattatcatcttctgatgcttcactttgttgttcgcatattcactatactcatttactacgaactacctacacaggcaactacccgcattacatgtggcatcaataaaaggcatccagatggacgattaactggatggactcgagctcggtcgacgtcgttccacactaaagtcaagtccaccatccgaactacggacaaagtgagacatgaaaagaagtctagattcaaccagacccattagtctctaacggacgtgcgcgccacgttgttgttgggagggactgactccataatctggtcccatatggcgtgtgccccatgtccgacggctttcctgtgcccaatataattcagtcaatatctgtcgggataacaccggagttcagttcattagagagatacggttgcgatggggatagtaccaacgccaagatccgacgtggaaacagataaaaataaaagaagaggagccatggatgaaaatgggctaagcaaaatagaagattggtaataatgggagaaaaaagccatgcaataaaaaaataatatgagctccgagttcctgacccattcgttcattcaattgatccttgggacagacatgatgatcgtgacattaggtggaaggacaccatccactgataagcgtacatgatagtccaataaaagaaacaaaataacgtgggaggaaattttcctgcgggtgccgatagatacctaatacccaccaaccattccgcggttggtcttcgagcggaatccgtgggaataatggtactgtgtcgtatctagtggcatgccccatttcaacatcaacgccaataagcataggagggaatacgatttgttctagccttcgaagtgaaccattgcagcatagcaatataattaatatactatgaacgccccgaacaagaacaataacaatggttataacggcaaggataatgataaccagaaccaaatcatgtgcaaagtgataaaataaatagatacattcaccccattcccatatcttaatttcatttcatcttatctcattactgagtaaacctctttctcagccggttcggctcgcgttccggaacacgatatcgacgactaacatgccgactgagaaacttctttatggaccaggactcatcgtggcttttctccgtagtactagtagtagtctgtttatcattactactattgtagtagccagttacatggccgaagaaagaccctcgtcgtttgtaaggttcaggattacagaaatccaaatcctcctggtctgcgtggcgtcggagtgaggttttcattgactctgtgctcatttctcccttttccctcactgtcacgcagggaaagcgtggttgcaaacggagactaatgaaatggaagtggtccgtgtcttttttctaattgacgaacagccactgacatacacacaccccctgtacgccactagataaatagatagatggatagttagatcaaatgggaagaatcaaatttcctctttctttctcttttctgcctggtttttggtttaggcaataacaacctggctggctggtggtccgctggggctggctgcgtgttatggtgttttcggggtcttttgcggatttagaccgagagagcaggcaggtagacaggcaacgaagattctgaaggcggggttggttggtttggtttggtttggttcgttggatggatgaatgaatgagtggtgggtgatcgatcgattatttgcaaggtttgtttgttggggtcatgcaggtatggatcttgtgtctcttgtatattgctaatttagacaagggttgtaaagaacagtttggcgaatccaaggattatatgttttggaagggttaagctcctaacaggcaggtaactagatacgtatcatgtatgaggatgcaaagcggcagcaaagaggacatatgtcaatttacgatcatcagtaatacgggcgaggagagacaattagttagttggtcaagctgtcctaagagagagactatgctaactactgaggagttatgctgggaactgggaagctttcactccgcgggcacaggcaccatactcattgtgatcattccgggtccctcggaggggctgcgggacaaatagtgaagactgaaagagggactcgatccatggtttgccgacccggactgagagccagtagtgaagcagcatggcggaagatccagtgttgggaccggtgttccgtgagaaaaaagcacgtgtttgttttattactatctaccccactatagatgacaggtggtggtggtttgcgatcgattgtgtttcttccagaagagtccgatcattagcagatgctctcgtttgttttctggggaagtttgtgatgggatgacccccaagcatgctatgagcatgggggaagcctgaaagattgtaacgattgactgattgattgcatgtcttacagcaggctgattcgtctcttcggacttccttcgtatccgatggtatcgttaattgataagcttacaaggatccatcggctgacgtggaagagctccagtgaggacggcttgggtgaatgtttgtccgttagttgctactgttcactgtcttgagttatacgctcatactggagcagcagagatccacggttcagcgaagacacaaaaatagttgacatgctatgttccgtaatattatttgcgttgggaacgaaagctggatgccaggtgctcgtgtcgatctgttggactttcggttctgtgggccatgacacagatatactatcgggctcggttggttgcacctcaccgccaggttcagtactctataagcggataaacatatttatgttcattgtttgattcacaccgccaggtgatgggaagtagacgactcggccaatcctctaccgatgtattgtctgatgtctctgctcaataggatatctggtgctctgagagcaccctttgtgttgctggtggtaaaagtatcgggcgcatgagatgaaatttagctactgttctctaacgtagtagccttattatataccttctatgtccgcataagtatgaccagcctactagtaggaagtgatctgatcagactttagcgtgctcatcctgtattgcattatatacatatcctaccgtgtgattgacattttcctcgagtgcctcatatgctggtaagtgggacagtagccaaggttaagtaaggtatataatatgtaaaatggctgggcatattaacaacccaagcatgttagctcaggggaagagcgccgggctcataacccggaggtccctggatcgaaaccaggacatgctatccaatttcttttttatattttttgtccatcgtcactagtccccacttttgctatatttttcttcttctatataccttcatctcccgtttactatcattattcaccctccaaggcattttcaacaaccccttagagctacataaggagtgataaaaataatttactcgctgttgtagctttaactatccgtgattaagatcactgtaccagcacgtgacgagctggccgcccttgagggatgccaagccggccaacacgcaaaggacgggcgaggctctcgacgactgaccaccgccgcgttgctgctgctgcatccgatcattactccctgaccccgtcgttattatatcctccatatcaccgacccccggattgcgcagactggtctcttcgcatccgttctttttctccgaccctccccttcacgtcaatcctctcccttcttctcacctccccatccgggggtccttgtggccgccatggcatcccgtaggtgtccttgtgttgaaccctcccccacattgctatactgctcccatgcccctgtccccggaattcgatcgctaactgtcgccccctctcccgcctcttatatacagtcaagcagtttatccggaacgtgcgttcggccaagacaatcgccgatgaacgagcagtcatccaaaaggagagtgcggccatccgtgcgtcgtttagggaagagagccatgattcgggcatccggttagcattgacaccgccaacctctagcaacactcgaaccagcttctcatttatttgcacaggagaaacaatgtggctaagcttctgtatttattcaccctcggtgaacggacacactttggtcaaatcgaatgtctgaagctactggcctcccaccgtttcgccgacaagcgcctgggatacttggggacgatgctgttactggatgagaaccaagaagttttgacgctggtaacaaactcattgaagaagtgagtctgtattcaaggtcggcttagggtctcctagctaatgttttgcagtgaccttaatcactccaaccaatatatcgtcggcttggccctgtgcgccctgggcaatatcgcctccgtcgaaatgtctcgagaccttttccccgaagtcgaaaacctaatgtctactgcaaatccctatattcggaggaaggcggcactgtgtgctatgcgtgtatgtcgcaaggttcccgacctgcaggagcatttcctggagaaggcaaagactcttctgtcagacaggaaccatggtgttctgctgtgcggtttaacactcgcgattgacatgtgtgaagctgaggaggcggaagaaggccaggagggggtgatcgagatgttccggccgttggccggtggtcttgtgcgctccctaaaggggttgaccacctcgggatacgctcccgaacatgatgtctccggtatcaccgatcccttcctccaagtgaagatactgcgccttctcagagtactaggaagaggggatgcggcgaccagcgaaatgatcaacgacattctggcccaggtggccactaacacggattcgacgaagaacgtcggcaacgctattctctacgaggctgtcctgaccattctcgacatcgaagctgattcaggattgagagtgctaggtgttaacattcttggaaagttcctgaccaacaaggacaacaatattcgttacgttgctctcaacacgctgaacaaagttgttgcaattgagcccaatgccgtccagcggcaccgcaacaccattctggagtgtctccgtgacccggatatcagtataagaagacgtgcccttgatctcagcttcatgttgatcaatgagagtaatgtgcgtgttcttgttcgagagctgctcgctttcctggaagttgccgacaacgagttcaagccagccatgacgactcaaattggtatcgctgctgaccgatatgcccccaacaaacgctggcacgttgacactattctgcgagtactcaagcttgctggtgcctatgttaaggagcagatactctcgtcctttgttcgcctcatagccaccacaccagagctgcagacctactcggtgcagaagctttatctctcattgaaagaagacatctcccaagaaggccttacccttgctgctacctgggtcattggcgagtacggtgataaccttctccaaggtggtcaatatgaggaagaggagctagttaaagaggtcaaagagagcgacatcgttgacctgttcaccaacatcctcaatagcacatacgccacgcaaacagtggtggaatacatcactacggcctctatgaagcttaccgtgcgcatgtctgatccagcacaggttgagcggctccgtcgcttcctcagcagccggactgccgacctgagtgttgagattcaacagcgggctgtcgagtacgtcaacctgttcggctatgaccagattcgtcgtggagttctcgaacgcatgcccccgcctgagatacgtgaagaacaaagagtcttgggtgcaccgaccaagaagcgtcaaagcaaaatcctgaaagacaaatccaagaagcctgccaagcaggctgagcaggacatgctcctggacctcatgggcggcgatgctccaccgaccagcccgactaccaacggttcccaaaatacggctgatctcttggccgatatcctcggcggcgattccagcttatcgtcaccttctccccaacctgcgcagaaggcagcaggatccaccaataccagcgctatcatggacttgttcaacactaatggaagcacgccctctcccaaacctgcggagcctgcatcttcaggcttggatcttctagcaggcttgagctcttctgcctcgcccgcacccactcctgcgccgtcggcgactcctgctcatacggcctttaacaagaacgacctctcccttgcccttcaagtccaacgtggtagcggtggaagtgcgcagattcaggctcgtttccgcaacaattcaagctttggccgcttctccaatgttggattgcaagcagccgtgcccaagagtcagaaactacagctaagcgcgatcaacaaggctgatctcgatgctggcgacgaaggtatccagatgctcaaagttgcagcactaactggggtaagtcaaaaccaaccgcgccttttctaattgcctttgactaatgtcctgcaggccctcccacctaagctccgccttcgtctccgtatcacgtatgccaaggatggctctgatcctgtaacagaccaggtagactggaccgagccgtgaacggtaaccagggccttactttcatgaatccttatattcgccttacagtaacctttcagaccgcccatctaattttattttatcaacccaattattgtactaggagggaggatggaagcaagcaagccaaccaacccttgggaggagactaccagcgggaaaccaacgcctacttgaccattcatagttcctcacattacatacatgcatgttcatacatacccggtccatttctagctctccgttttcagcatttcttcccttcgctatcatgtcttcttcttgccttctatgtaaatgcttggtatgttgctgaggcctaggagtggccggttcccccatatgttggggtctaaaatgaaaatgttcctgtgctctttaccacatttgtctcctactgtagtgataaatgtagctcgcctgtcatagtcaaccagtagaagtagtaagtagcaagtactacttcagcaaccaccttgccatgctcaacatatcgacgacgtgggctcagtcactccgtcctgttcagtcatggacacccactagtagtacgctatagtatatactctactactgtaatatgaagacaagccagcacagcaggcctgagaacagcacacaccactagaattaaaccctgaaagccagaagtggaaatgatgaactcaaaacggtactatatatctcggagttagaagaaatgccatcacggcgttaaaaacaaatgtccggtgagccgtttgtttgcgcttcagtgatgccttgcaatccccaaactaccatgattgtgactatgactgtacccaaagccgggtgagacaaaggattagaagttccacacgtcatcgataataggaatgaggcaaatcgacagggaccggccatctatcacagacagctgcggcctccgatgcactcgtgcctaatgagcagtgccggggtcaaggaagatttcatcagtctgaaatgcgagatgtgagacattaagcttttgtttgataatgctggtcgggaagataacggttgatgtatatggtaactagtagtagtgatcgttaatatttctcggtgttgaactttcctttgcttcttcttcagcgatctctccttctatttacccaggtctggcttccaggcgggttttgcagggcgcgtatattgaccaattcgctcgaagcgcttatgcatcgaagaggatggtgtggctcggatgagttggcctcagtgggacaaggcgtctaagctgcagccgaccggattaaggctgcttgcttcgcccaagtttgatcgactctactgatcacattgtccaggcacaaggacgcctatagcgttttttactggctgcttcatgatcgcctcaggcagtagataagtgattgtgatgtgatacttggcggtcatggctcctgagtactgggctaagatccttccctcgttgtaacttttatagttcaacaagcaatgctggttactgttgggtatgaatcggcaaatttattgataacgtaaatgaagtacttggtggatgcctttatccttatccccaccatcttctgagcgttgggctgcagaggttccacttagcaatctcgcctgatggcaaccataaagtaggctgttcacctgaggaaagggcttcgcaaggtggtgtgaacagtagctattacttgtttctggacggcttttatgcagtcatcctcgactgctttgtttgacgtcttgagtccaagatcgaaggattatacattgatgcctgatatgacacctgctatccggtccacactccaggcgggattctacgcctatgcatgaccttggtacatttgactatgcagtgtcagccagggcttcaacgcctcttactccaatttgctaaggatttagattgtagatcgttccagaaattgcccatagtgcaagcttatggtatgtcagatcagatagatgcaggatacagaacagcgggggccatagcctcgcttctgggggagtttacactgaagacggatgagctcggagatagccatgtctgaaagtcactatctttcagacgctctgtagtatattcgcgacagagtgactcgagaagatgtatcccattgtagatcgcatggtgcatcaccgacaaacttgatgatgacgatgtcaggccgacatcacgtgtaataccgtattgtgacccccctcatctcccctcacccgccgttcagtgtctgcacctttccgaaaacagaccaatacctaaggataccgcgtaaggaaagcgtaatagagtcctgaggccatcagcagcgtcgcgcggttcctcgttctttctgtctctcgctctctctctctcttcctcttctctttcttcctcatcattctcttgactgagcaagcaagcaatcaacgctcatcaatcgcgattccattagatccagcatcatcatcagtttcatccatcgagtcctctccgttggagaaacaccatttatatctagatctccgttcgatctcattggtgtcgggggactttctcgcaacaaccagtgatcgttgctcgccttgccagggacttctggttcgccaattgattgctgcgcgcatcgcggccgtccccagtaatacctgccctacgaccatttgcctgctctctactggacggtaagccaataactcaacacgccccatccatccccagcgtcgtgggccaccggaatttgatccaatcgcctggtcggtcgctccctctttaattgttggttttgctgcttttcccagctgcgcaacgtgccacactgccagtctgacccacggttacttccgtgttgcattacccgcgtcacatcccgccccgactgttcccagatcttccgcgctggaaactgtcaagtgcgcatggcttgctgacgtgaccactcctgcagtcgcgcgcgcgccccctctaaactccctccacacagagccacaggggcttgcccaaaaaagagtttccaggtttctgggtgctgtatcctcttcactggctaatcaaatcagatccttccatttagaagaagaaagaaaataaaacaaaaaagagaaaaaagacatacgaaaaagaaacgcgcaggaaatctcaagaacagacaggcaagacagatttaaagtactttagaaacaataacaaacagaaacgcctgctgcgaccacaaccccccctccaccctcctcgtcgaataatagatcccgccggtccttgctcacgacgctaaagcaggactatcgcagaagcattgccaatcccccacacgcgcaactacgcccgtctttccccgttcaggctgtcgtgaagcgaatcgctgcccagccagacgcaccctcgttgtccttggcgcggctgtatcatagcgcgcgagatcgagaatccaccgcgtgctgcacgcagctctgacgtggtttgccaacagagcagttagagacaagcccccgttctaaatccagtatctctgcacgttctcagaacagctaaaaatcatgtcgtcgacctctccctcgaaggaaccggaggtggaacccgaagttcaatcgggtgaagaccaggaacaaatggataaggaacaacaagacactcaggcgcagggtcagggagagttcgaggtgaaggagcaggatagatggctaccaattgcaaatggttagttacgttcccttgcagctttctctttttctgatttgcgcgtaccttacgtttatctgctggtcaaccgcctcttgccctactatggtggttcacccaccccccccttcaaccaccccctagttgctttatctgatcatatccgccggctcttctgtataattttttgtgacttggattttcatggctcggatacagcctaccttggcccttttatcgttcgtcttctggttgctcgcacattacccatcatagaagctcgcatactcccccccaatgtctggaagtaaaagacgcctgatcactttcatctatgcttgcgactcccgcatttatcacagttgataccaaattaggatactaatgttgcaaatcaagtggcccgcatcatgaagctggctttgcctgaaaatgccaaaatcgcaaaggaggccaaggagtgtatgcaagagtgtgtgagcgagtttatctcattcatcactagcgaaggttggtgcgaccacacctgctctacaagctctttcactgacggagtctcgcacatttgtccgtagcctccgagaaatgccagcaagaaaagcgcaagaccgttaacggggaggacattctattcgccatgacctccctcggctttgaaaactatgcagaggcccttaagatttacctgtccaagtatcgcgaggtgagacctgtgcaacgtccctaatcatgttgcctctttttcgtaacaggcgacattgagtttcatgacgtatccggacgctaatgattcctctagacccaatccgccagaggcgagcaccagaaccgtccaacaagcagtggatatggtgctggcgcgcccgtaggggccccgggacctgccggtcctggtggccgtccaatggcaccaggtgcagggtttcctgatgctgctgacagcgccaacaatatcatgaaccaaagcttggacccgtctgagcaggacacttccgcttatggctaccccccgatggtcggccagccgcacaacggcaccgctggtgaatcttattagtatgctattgtgcgggagaaccatccgctggacttgacgactatcccacagcaagggtcttcttcggaatcgaacaagaagagaatcgaacatcagcctcacctcacacccacagaggctagatgcccctcgtctccagcatgaaaagcggctgggatcacaggcccaaacgacgaacgttcccggatgttactccctgtacagcaatcctaataaagcggtacgatacgatgggttacttacgggatattaacggaacgaatacgaatcaagcaatacgacaggattaacggagccgagagatagttttactgatttggtttgtttttgcttctgattcttcattttctcttctacaatcggctagagcaccagccgacctgccaggcccacttggcgcctcagtcaccttcatataaccaaagcaaacctctcaacatcaagccaaccaagagagaggctgccatatattctcatgcttacgagtaccaatatttatctgcgcgttatggtgaccagagaaaagggtaccccacctctttgcttgggccagttacatgtaattattgtctgagttgagtatctattattgtgtgtctttgtcattgtttatgcagagtatgggatactgttcagaagaagaagacaggaacctgacaaatagaacacggattggacttcactgtcccctgacagaaaaaaatcacgtggttgcattttaaccgtagaagccaagtcttaagttaccgctagataaatcctgtacgacagacaatagttcatgaatggctcacgctgtgtaacgctgaacccccttattacgtactcaacaaaaacgagctatccaccatataaacaacgggacgatagaaagaaagaagaaggaaaaaatcaaacacaaaaggtcatcatcatagtcatcatcatagtaatgaaatgccaatctaagcaaccagagaaagataccacgactcgctaaatcaacagagaacccaaccgcacgttccacgcacgtggggtatgatgtgaaatttatccatgcatccaccccccatctaacagaagatctgacatcggagtctcttgccagtagatctgacgccattcatcctctaactctggtagcccttccatggccataggcagcacgggctggtccagatccgtgaaggagaagagttggcgccagtcgagagattcgcggggcgcgtcggcgtcgatggcgtcgacgacgggggtcatggtggcggatggcggaggtggggggatccaggcgtctagatggtgatgttgttggggctgagattgaggttgagggtggctgtggtgagggcttgttgggaggtggttcgtggaggagtctggggtggggacttcgaagggaagagggcggtctgtcggggttgggttggggggtcttggtgtctgcattgctgtgggtgcggaggtggaagtggtggtggagtgtagggttgttttgagttggtcttgagggttgctgaagcggcggggtggtcgttcgctggtggccattcggaggtcttcttggaggcgtctggagtcttcgaagaggcggaggatggtgtttgcgtggaaccaatagcttgctagttcgcggagggagtaggaggctgagtcgaagcggcggagggcgttgattgctaggacggggttggagaagcggagttcgacgcggacttggatcatggctgtgaagagggtgtggacgccggagtaccagaggaacttgaggcggtcgtttaatcggagttcttcgaagatggaggtgatgactcctgcggctgcgctgcagatttcggcatcgtgcgggccgtagtcatctgagtaggcggatgctcgggggtgtgggcggtggaggaggatcaggaagttgttgtaggtgagatggagcatggcggaccaggggtccatgtcggacgctcggagacgtagtttatcgggcagcttcagggaccaattggcgagggcttcgtcggcttctaggaggacggctttgcgacgctctgcgctcactcgtagtccgaagcggcttcgaacgatgtacgagatcattactgagagctcagtgaaatggatcacgtagtcggattggacacgaggtccgcagccctcgaagtcagagattgtcaatggagacacgtcggagtcttctaggtttctgttgtcggaagcagtcagcggccgatcgggagggtaaggagggggctatctgcttacattgcctgcggtcgaccatacgaaagtgataccataacgtcgaattgcactataatgtgccatagcctcctccacatccggcgatcacgggagacaaaccggctagagataggatttcggtgcattccgaggccagtagcaatcctggcagctacacccacccagtagtgcgcattcgctgcgacatcatcgtcggcaccatccgagtgccaagtcaaaagtagagcagcttgcaccaggatatcgcgattacgctcaatacgtgaatcaaacagccacttggcacgacggaagaaaatatccttgagggcatcgcgttccgctttgggacgagtgacatgggctcccactagcagaatcgcttgtagcagcaatatcgggggaggatcagcagggtcccggttgcgatactgcgccatgaacaagtcctcgtcaatgataggataccctgggttgacgtggtcaaagtaagcttgcaccagttcatctgctagggccggttcaggcaaagtgagagcatccatgaggagctgatcatggccggtccttaactgtcgtcgcggaatctcattgcctgcaaagtgatagacgtcgtcatccttgtcgcgttgctgacggatcaagaaagacatgttcgacagctcatggcccacgtatatagctcgcacaccccgacgaatctcccgactgcccgattcttcctcatcgatgagcttcactagtcgtttctccaaatccgcgtgggagtccgattcggccgagacatcctggcccgcgggacggttatatgtcggagattctgcagctgacccggcgccattatggggagggtggtgattaacattatgattaagcgtttgatgaagattatgaagacttgatgcgggatgtgcgacaggtgttgtcacttccggttggacgccgcgaaaggtggtggtgaaagcgtcaggtggggttgtagccgtgagaggcagagagtgtctgtgtgtaggctcagaagaagcaggaggtggtcgacagcggatcggaacggggtcgaggattgatcgcaccgccagacgcttcttcttttcgtgaatccgacagtcggtctttcccgcggaacggcaattggagcatgggaggccgacgatgcgggcatcgcatcggactttgcgccgatggcagtggacgcaggctgcggagcctagaggggaattttcattagaaccaggagaagaatagcagatatatgccaagtccttcatagacattgcagagcgtacctgacttgcgcttagtcaccccattcccggcgggtgaatgactgctgtgcgctgcggaggtcatcgccgaaacatcgacacagatccaagggtccggagactcgctaattcgtcatctcttatccgagagatctgagggagagagcataaggtcagatcaggacatgatctacccacggacagaacgattggagaggagaatgaagaagacggaaagaagaaagaggagaaggaggaggagaaatgccagacatgaagaggagaaaaggcgggaaactcgaattgctttgctcggcatagctgtgattggccgataatgggcaatcgggtggggctcatccagggcgggtctgggggagtcacgtggcggggttgctgatcgattccattgaatttgttttaagaccttcgatgctttttctcctcgtcttctggaagcctgtcatgatccgccgtttgcttgctaccatcctgcccatggttacctaaaagcatacctagtctaactacccacgctcaggaccccctccatgtcttctgccctgcatttgcgtgacacccggtgtcttcttccgtgcgcttatccactccggggatccaccctggcgtcagctccgttatcagtccgcctatcgtccattcctgtctttctcactggacggttggtggaattccttatcaacatccattctcgagataaagtgtttgacaaaaatgtacggctaaagcggagtcatggtcctaatattgacttcttctgcattgcggacaagttgccctcgggacttttctaagttcacgccaattcgcattctatcaagctttccactcccttttccaccgtccagatcttgactaccttcaaccccacagattcaatcaacgtagtccagtgcttctccgtccgttcccccgaggcaattgacatcatgatcatgtcaaggctagtcgtctcgaaatgcgcgtcgagactggggacaacatactcgttgatcaacagcttactgtaccctggtttcatggctgggataaggttggacaggatctgaccgcacacatcgtcaggccagtcatgtagaaccgaatgcatatagtacacgcgtgctcctgaaccttatcagcccagatcttcaaattatcagagtaaatgtttcatagacatacctttcaccggctgctccgtaaagaaatcatgcgccattgggtcaatggatacatgcaagtccctcacagtttctataacctgaggcagatcctgcaccacaaggcgcccagacacctctggccacttccgacggaattcagatacatcgtgcccggtgctaccacccacatcaaccaagaagacgtccttctcgctcagttcggtacccttaattaaccgttcctggactgggtagaagcctttgtccatccagctaggtcgtccctgatggtacaccgacatgtggttgccgaattgtttgttaagggtagggttcttttgcacacattcgaagaagtgttcgtcgactcgctgtcccagctggaatggggacttggtgggatcagttggattgcggaatccagtctgtttaagaaaggcagggatagcgtagatacctgggtataaccaagccgagctggggattgacatcaacgttagtaaccagtctacgggcgccttggtgtcactcacagtgcggggaaagcatctccatatcgttcgacacttagtgtggtcgagaggttcgtcgcgatgtactcgtcaggtcccgcttcagtgattacgctcatagatgccagatgtttcatgatgcgcgctaggaggcgtaagtaaaacacaactctacctacgcaatacatgccacgaatgaaactgaaccaaccagtaagtacttacacaacaagaccggatcactctgtgttatcactgcaagctctgcaacggactttggcttgtcccgagataactcgctcaacacacctatagctagagccgtttcaatagcggcgtgcagagtagcctgcagcagaaaccgtttgttagatcccagcaattatgcacatcaactcacaataccgtcccaagctctcacgtaacagacaggacttaccgtagtccagcactgcctgacaatcgcctctcgcggggtctccagcgcattagccagggatctcgcagcatctcgtagccttaacctttccaccgaattctccagagatatggatttgtgggatgcgatctgatcgatgagagtcgggacagcatcgggtgcatttggtgaaatggcaatcgtatccacgttcacgtccgacttggaaggcccatggccattggaatggatgccatttgtatggtggccattagtatgatatccgttggtatgatcaccattagtacattgctcaacaaccgttgagacgttcgtataagtcattctgtagttatcgggggtatgcttcggggtgagttacagggaatatgtaaggggtctgttcgaatggcgccatctacttaataaggtccggcagccggacgaaacgagcagcctatgtaggcttctcgccttgcgcttttccatagcactacaaaatagcccgcactataatacctttatgacgcttagaacaatatagttagcctctattgtcttttgtgcctactgtggagctaagtcaaagagataagctagctgctgccacctccactggtcatttatctcactttcaggctgcccactctggtgacctgcagtagagtcgctaatgtagcggcgacgcctggatagactccacttcctggcgaggggtagtaatggccctagttagatacttgtactgcccccggcagatgatggaagttcataccgatggaacggctaggccgcaaaagacgcgggctacaaaaaggcaggctcatatcgttttaattcactggcgagagatagagggcctacagagctctttctccatgttctcactggacaagctcgcgcagtggataactagacaggatgatttaggacggaaaagcaattttgaggatacccacaagtgagatagcagcggcaatataacgctatgttagcctccccgccgatattttgtgggtgttcgagactggacggtgtagtaccttagtgcagcacttccactaacaaggtcacggaaatagcaatataaataggcctggcttatatggagacggagttcggggatgggcatccgctcataagatagagtcccgccctgacggcttcgcaccaaaaagcaattagcgcactcttataaattccagtgctgcgccgtatcctgagactaatttatctcagtaggcagactccagataggattcgcgagataggtgtcgtgtaagtgcagaggataccgatagctcccacaatcgccagaatcgaagtttggaaaattctttgatcttgaaccagaggtagcaggcatcagggaaacgagaaactcccactcttgccacgggtttcagagagcgtagtactgcgccagtactgccaggagcatccgtatctcaataacaaaagcggaggtgcccctgagacggacaaaggttgctttcaattaattatcactgcgccaacgggaccgctgtcttgcagggatagttgcatagcgcatgacaccacacttcgcgccattaacatccataggcccgggcctgcatcgtacttttggactgccttcgtgcaactagtctagagttgggtatccgacggatgattcattaacaaataggaaatggctgaatattagcaccacggtacgaccttgtagcaacagtgtatttggctgttgggcaactctgcggtgccaagaacatggtggatcgcctaggccagacaagcaattctagcgactcttgatgttcagccttaaatgttgctgtagggggggggggtttgatatccgtatttgggggcgctttcaagttgcgcacggatgctatcatttgatcgtctatctcaaggaagaaatgcaacctcaagaatcaccgattagctgagatacttcatcgtagaggtgcgacttctgttattaattaatttgcgcccagtagcgtccaaatggacaaagaaggcagcgtgatccactaggccttgtagtatacgctaaggatagaacggtgccagatggtgcgtgacgccggcgccgtcgctggtggaaccggactccaggcagactcgttcggaagtcggaactgtgggaaggtcaaaaagctcggtttatattgggacctgttctttcatatgattattcccttccttgaactgtctcgactaatagactagtgttcaagccactaatctcgatctagcaatgaccgtctcctgctctttccaacacggaacgtctcttgaaccctggaatgtcgggcatgttccttatcagggctcagctctaggctgaatttgatgccacgctcttgaacaatgcgcggaagtgccatgccccctgtgctgctattggtttgcttgcttagcgattaattggacaatctcgatggtgccatccatgatgtctcaggtagtggtagcatggatattatttccggttgatgtttcgatgagtccacatcactctggatctaggcgtctcgactctagagtctagaattagaataatataaagattggagagcaagggattctcgacgaaactctgcggcgacttcggatgcacgagatggtccgtaaccggcctggaagtgacagggattctgttgcacagctagtggactaattgacactaggggaaaagcaaattatgttagagtacaatgaaagaactgtacgtaaaccccttaagttgggcctctggatagcccaagtagcccagtgagcacgttttgctggaatcatatcagcgttggaccttctgatgtttgtgacattcgactacttcacgccaacgcacagctgtggatgttggacacggagcgatgactgctgtatcttcggaatatgcccaccagactaagggcccacgaatattggctgtcttttggaccatgactagtcttgcaattctagctgtggcagccaggctcttcatccgtatcaaagtcttgcgcaacccaggtgcagacgactggttgatcgcaacgtcaatggtaagtcgattatactatttctcaggtccgactgccacagttgttctttttgttgtacattctgacggctgttagtttttcagcatatcatattctgtagtaaccacggtcgacgtcgctctaggttacggaaaacatgcagtcgtcatagcagatagactagaactcgttctgctagtcaactatatcaacttcgccttgggcataatctccttcgccttacccaaattagccgtggctgccctgctgagccgttttctgaatccgacaacgatacaacgcgcgatttaatggggattgacggggtttgtggcactggtgtcgtgtatttgcatcttggtgctctttaccatgtgcgatccagcgaaagctctttgggacacgtcccttctgtcaaagggcgcgagttgccggagctcgtggatccttgtggactatgccatcttcactggaggtatgtgcgagtatgattcaatagaaagataagtctagcttaaacaacgatagccatatctgcctttacggatctgtatttggcaatttatccgacagtcatcttactaaagcttcatatgtcgatgcggaaacgattggcgttgtgtgcagcgctgggtctgagtgcagtgtaagcaagaactcaagaagctcatcgtcatcagtattagctaagaaacaaggctatagcgcttgtgcaatggcaatcatcaagtgcatgcagctaccaggtcttgccgatctcagcgatacgacatgtgagttgttcttgatgcaaaactgtactaaggccggatgttcactgacactatagcagatgccacggccgaccttgtgatatggacaaggtaagccaccatgtgttacttcgtgacaccaagcccttattgagcagcaattccggatattgacaatctcccggcagtatcgaatcaaacgtcgtgatcctagcctcatgtatccccacgctacaaccgcttctcgaaataattctcggaaagcgcagtctgagaagtaccggcggatatcagtacaaagagagcagtacccaattgcccgagtctaacaagtggagcagcaagcgatctggacaccggaaaagtaaaggcaatatgatgattgcagacattggcagccaggatagcatcttgcagataggtgatgatcacgaggacgaaagccattatatggggcacatccgtcgtacagataaaatcactgttgtgtacgaaagtgtgacaccacagccaggtggtggtgataaaacaaatgaccctgtaaaatagaagagttacactgacggtgtttctggcatgcttttttgttctccgccttctttgtgtgttggtctttcattaagtgcttgtagtttttccattgaataggcgcaaagttgtatgagcccccagagatttttttgagaagctgaagtgcttcatccagaataagtttagacgcttgctatgatgatgtgttagcatgacggttcaacactatcgagcctaaatgttgcgttgctttcataccttcatatcgctaccacaacaaaaaatcttccatatgcgattatgtacgtatgcaagtccagggctaatggtcttgcatgtacctcatgttccgcagttgtattgatcatccaagaacgaacctcttccagttttcagcgagctgccgaacgccttgatgtaactcccacccgcggatattgcagatctgcctagcaatttcctccagcaagtcatccatctgttgcccagccgtatgcagatcgctctcgatgagtattctatcatcaggcaaagccttgataacgttgatgaccttctgtgacgaaggtccgccgaagtttatcacagaagagaaggagaagtagacgtctgacggattagattgatgcagaaattgcttcaatggctccaccggcccggaataagaatgcatgcagatccgtggtgggaatgggagagacttttcatctgactttgcaggcttctgttgcattcgttcatcctccgcatcgctctctgcatgcgcatctggaacactataacgtcggcgtctctcccgtcgtgaggcgttctttcgctcatggccagaccaaagggccttcaaaaggtcaaagaccgccccatgagcttgaacgctatgcacagaaactggccgctgaagttccccagctagccgcaactgagcctccaagacggctttttgatgcgccaactgaacacgatacggcgaaagctgtctaccttcccgagatccaggggtcattcgctcatcccgagtttctttttcctcctcggtccacgccttgggaagcctaaacgcacgatcaaggccaacctcacccacaagagaacgaggatacgccagcaaccgtgctcgagattccgacagcaactctgacagcggctttggatcaggtaacgacaggatgaagtcatcatctggctctggagtaaggaccttcttatagtgcagcttcttcagctcaattggtgaggtactttcatcggtcttgggcgaaccagtcgtatcgtcgatgatttgatgcgagaaccatgggtgccagccaaagcacggtagcacaggccctgttgccgaactttgggcggagtcctgaccctgggtcaaggatgtagcggtctgaagcaccaagtcctggtcctccccgcgagtggacatgactgttaatgtcaatactttcatttgggggatttccgcaatggatgacatggtgtcagtggggtgacaatgggcgtcgaacacccccaagtgccaaggaaatgcatcgttctgatccgtctcagacatggtgcatgtgaaaaagaattgatcggaaagccgaggcggaattagagtgccaaagcgaaaagaaaaatgattcagaggcagcttggggatgtgttgattgacaaaaagtcggatgatgaatggagagagagctaagctgtgacgtaaggaaaagcccgccgatacacacgcgatacgtggtgtaatgatgccttgggcaggcaacggacatcgagcatcacatgcttcttcgtcgtcttgcttctccgcattttggttctggggatgcagtcatgatttctattccctgcatggacactgcagggctattccttcatactatagccatgccacttgatttctatatatctagtaagaaaataaatatttccatgtattcaactccctcctttgatcttctatagcctacctcatagctgccctactcccctcatcttcatgtcctctatctccgccttcttgagtcttcccctcctcacactcttttccctccctctcgccctgttggcatgcttcaccaccttcctttccatcatatttctcctcctacgcttctctgtcatctatattgagctatgccttgccataatcacaaattacttcgtcatcccaacagctgccaacacctccctcctcaacttctccgcatctgaacccaccaccccagcagcctcaacaacacccaagcgtcgctcagtcgaccacagcttaaacaatgggcttctcactgccctcgcaacatatcgtccaggctacaatcctccccgtcgaacaaacagtttaaccaccacaacctccacttcctcaacctcccaagacactaccactgttccactctatcgcaaagatgaacccgcaaataacgctccctctgccctcctaactctgatcagtggcgacgaaggccgcgactttgaaggtctaggcggctggcgctgtgcgacaacagcaaaagcagcagcagcaacaacaaccacaacagcaagatacccagcccatcatctcctctcagacaccgcctccccctcaccaaatatcaccaccagtgaatacgacgagagagcatggctatccatcaacgagagactagaactcccctcccaacctctattatccatccgaaacaacagcaacagcagcaacaacgaagctctcgaatccctcccttggagacatcggcaaatggcttcaaccagcccgccccccggaggcagtaataacctcattcgcagtccccgccatcaccatcgttccgcaaccacctccttactatccactagcctgtcccctaggtcttcactgccagacgccgttccccaccacggtctagaccatccacagcgtagggctacctcgccactactatcacaacagcaaaatagtacgaataccctcttctgcacgccctcgcccactgggaagtttccaggcgcatcgatccctcgggtatcgagccctactgaaggatcagggggatatttttccttgcgacccggtagcacgagcagcacgagcgggtcaacaacaccaggtgaagagcgacgatcgcctagaccctcggccaagtccatggtgcattaccccgcgggcgtgagatatcgtcggaggagtatgtcagggccgaatagtggggtgaaattgaccaaggcgtcgtcgggcacggagcgggcgttgtaattgatttattatggaacatactcatctgatggtgttgattgcgtgagatatttctggatatggtattctttacctcatcaattttgggtggatctgacagcgttacgtttacatcgtcgtagcgatttaccaatcatgacacagatattttcaaattctctatgcttgccatgttctcatcatatgtctacttctaccgttaaggtatatacattccacgtagtccatgatcgacagatactatttgagacatcgcccgatctttaaatcaaaaccatcaatgtttacttgctccacaaagaacaagtttcacaagcaaaatgaacaaaacccgctatttgatgacccaacgtaacgtaaacacctctttaaacagaaaagaagactttggccgaaagaaaagagctagattagactgcacaaagaaacagagctctatgaggcgcgattagctctctccttctgagccacctcctccatctcagccaaaacgatgcggttgaagtcttcccatccgtctagatagatatgatggccggacctcttgataatgaccaccttagctgagccattgtccgcttcgcgttcctccactgttgcgttttgcaagatacgctccttctcttgatccaacttagcctttgcggctagcccgcccttcacgtccatccaatcgtggtcaccgtacatgaagattatggggagaccgttctcgcgcttgggtgtcgttgagggggtctgagagggggccgagttggccgaggaagattcaagagtagattgggatgtggtagctacagctgcggctttcgcagactcgaggacagcagatgcgggtgacggattttgctggatgaattgacgaccgacgccctcgatgcgtcggattagcggactgcgggcgaatgcgcccggggcgagaatgtacgatagagcatactcgccgctgccgcgcatgctgaagatcgaatacgaatagtcatgcagagatttggcctcctctgccggaagatgggagaaacgccgggatgtccacccggagaccagacgcggaccgagtggtcccgcccatcgcaccaggctgaagggggagatgttggcatcccaaagataggcgaaccacttgggaaccatgcgccggggcggccgatcttgggaagcgccactatctgtaggggaaccctttagcaaaatattgttatcgcctttctgaagctcagttgggggaaccgaagatgcagattcggcgatattgcgctggttctgagtgagctcattcgccatggtcgactcgtttggcgcaggcatctctgcccgcacagcgtacgggtcctctgggattccgacgggggaagcaaggataagcttgttgagtcgtcccggatatttgagagcgtatgccacggccatgtagcctcccaaactatggccaagtagtgtgaaacggtcgatgttgcgcttgacacgccactcttccagcgcatccacgaaccaggcttctgcttctttgatggcctcctcacgctccttcgctttgatacgaaagggtggtcgcgtactgcggcccatgcccaggaggtccagcgcatggagttgccaccctttcaggcgactaagaggctcgaaattcttatagaagaaccccaaaccagcaccgtatccatgaagcatgaccagatgttgatctgcttcttcaccaatccgctcgacagagaactcgttcagagcccgattcttcccgctcagctccaccatactggagcgccacattcgggggccgtatggatcattggtagaactggctgatacctcaccctgttgcgtttgatcggcggactggagactgcccgtcccgccagagacactgctcgttttaccggtttgtagatgggttgggggttgatgctggaggtaagggaggtgggaaagaaccctgtgttcggctgtggcggcgggtaaagacgcccactggaagaaaacccagtctcagtcacccatgcgacacttgactttgttcctcagtaaagaaacgtacccattgactgaagccttccctgtagcctaggggaaaccaggccaagggggcaggagttgcgctggctccgcgagctgcgtgtggcgtactctctcggcgagaagccacgggttcctggctgcggccccgaaattcgccgctgggcgagttgaacgactcggatgccatcgtagatgtagacgacgagcgtctagaatccgtcggtcgggaagaagaggaaatatatcgagcgctttcgaacgaggtccaggaacgtgagactgggacctgaaaagaaagcgaagggagtcgcgcggtcgacaccttgtcgttaggaaaatcggagtgacagagggaagagccctgtcactctctcggctgcaacggaaaagaagggagtatttaaaagacagcgaaggggaaatagattaaattctctcttaggggggcgcagtggaaagagtaagaaacaggtcagtggaacaaaatgagaaacggttgaggcaacgccaaagaccgttaaccccgatccgagatggagttaagcaacaggcaaccaatgttgatgacgctgaaggtgaggaccagaaaaacctcagaaaagaatgttcagttcctaacctgcacaattgaagaccctgactgtcaaaaacagtatatacttggaaaagagaggcagaggattgaacgggggggagagatgaaagttgagaaaagctgaaagtccagcggaagtggagcctcaaccaagtgttggccgatggaatggatgacgatgcttcactctttcttgtctcttcttctccctctccgtctccctctctctccatgcctctctatcttcctcaaaacctcttctctttccatgcgatgagataacgccgggccgcaaaggccaaaatctaccactgtgtttttgaatttcacctgcgatttgaacctccgaggttaattcttgctccctctattcttttccgtccagacgaacccgatctccctgcctcgcctttcttcttctctggcttccactccaaagctcaccatggcttcagcaagcctagaccaactggttaagggatctccagcacccaacagtcgccttgcatcttctgcgacatcctcctccgaatcattggcgcctgcatttcactcccatcctccctctagcgatccctcttccccgccacggtcgtcaacccccgatccactgtcgaccctcccctcttccccaccccagatatacctcaatctcctcattctcgagagctccctgcgagctcagtacctcgctcttcgggaacgccgccgacaaaatacgtttttccttctcttgcttgccgcctggatcgcctactttgcctacgcgctctttctccgcccgcgcgaagatggccgcggcgtcggaggatcggtctactgggtggtcgaaatgggagaaaaggtcgccctgatgggcggcgtggtcactgcgctcctggtctggggaacagggcaatgggaacgtggagtttcgttggccgcggcgctggctcgccgtagccaaccgcggcctccgcaccatgaacaccaagatcgtggtcatccgaggtccctggtggcaggagcttttctcctacctttctttcctatttccattctctgcaccctttttcccgtcccccgtgggcgatttccactacgtcgagcgccctgcgtccgagagacgtggtagtcggcagcactaccagcagtactacaaccacgacgcggaatcaggtctggtacaggaagacctcagccccggaggtgactacattcgacttcttctactgccgaagtcattctcgcccgagttccgcgagaactgggatgaataccgcagcgaattttgggataaggagaatgatcgtcgtgctcagctgcgccagaagctgcgccaaagggagcgtcagctagtccagcaggatggcggctggttctggtggttcgggttgagttggaaggcgtcgcaacgccgacgagtcgctgccgcaacgatcagccgacccggcgatgctgacaaggtccaacatcgctcccatcaccaccaccattcgtccagcatctcaaagctcgcccttgaatccaaatcgcccttgcggcgcggtggaccacgctctgaatcccactcccgcacgccgtcacgcagcactacccccgtagacaccgacgaccgacccccgtccaggtcgtccgtcagtggccgtccccgccgcggaagcacaagtccaagcactgaacaacacatccagcaatcacggaagaagaaggcatccaaagccgccactcgtggtctgtctcctttgacgcaggcccaaatccgagagggcgtgcgcactccgtccttttcgtccgacgactcttctttcatgggcactcctagcgaaaaggagaaacccaaggacgagagtgttgaatagcggttccaccatctttatttcccttaaacccattctggtctaatttaccaacttctcccccatatgtctattgtcaatattataccctttgaaagcacaccacgaagacaaatactatctcatctcgatgtacttaccgccgtcgtagggggggtgtcgaaataaagctcttctcttctcttccatttttcccgttccatgcattgccgatttctgctttatacatttcggtgtctttttcctcctcttcccatctccaattgatttctctttataataccccatcatattatagcagatttatagtgcattttactctaaattttccgtttttggcatcagagggtatatgcggtcgactgagtggatgtttcgcatcgcatcgcatcgcatggtggtttcttttccaacttcccctcctattcgaaaagagattagatcagagtccgattagtccttgtcctggatagtatatacacatgcatatggggtccttttctttcttttctctttcgctcttttgctttcttcaccgtacatgcactcaattgtaatacaatcagtggtggacaggctagactacttagtcttgagtaggtaaactcaaatcccaaccagtacctgcgccccggatgtaagggatatgcaagataaaggggcaactagtgaacaaaagcaaggtctaggggaggggtccaaaaaaaagaaagtatactttagtggcaatccgtagtctagactattctctgagataattttcttgataacgtaatcaacggtcggacgggccacacggtcaggcgggccatctggtaatactatacaaaagatatctttttaaacataatatatctctaccatccaggtctagaagaattagatttcttctatatagattttaaataatataaataatatctatataccttctaaaaatgaatatacttttacttatggacttatcatattacaatatctgtatttatatgtattatataagaatctggtttcattatcaaagtaaaaattctaaaaatctgaaaaattcatggaatacttattcttatatatataaactatctacaaagttagagcttcatagaagtagtactggttgatatataatagaatcaaaaagacatcttttatatgggatttcaggatggcccgcctgaccgtgtggcccgttcgaccgttgattacgttaaccttagtcccggcttatcataacatatcaggaagcctctagtgtcagggtctagataggaagttgttccgtagacattgatatgagaaatgtatgatggatggcatttcgatcaaaatagagatgcacatggagaaggaaatagacaattagagacaagtaatataaacgttgagtatccgagacgccgaactatccttcaaaacaggttatatgtattcaggaaacatagaggcaagtgtaaagaaatcatgcgcatgagtcagccgtcacgtaggtatccatcccatttctctaagtcgtataacgtggttaaattgagtttttgttctttatgattagattctgtagacggtttcgtcttcctcaaggtacctgtttcgaagaagtcattagcacttatgtcatgttatggatagaaggtttcaggtgcatacattagttcgttcctctcgttcatagccctcagggcctggattgcttctccgcgctggaagacgtgtgactcgcccagcgaaggtgtgctgcgcagcgcagtgttcacagctccaatgagcgattcgacgtcggcggtgtcaccgtgggtgaatagtcgtgtgcccatcaggggacccagtgcttgcctgaagaccgtcaaacgagcgggctggatcggttcagatgacacagtagtgttctgtgactgcgagttgtcggtctgcgactcgacgagctgtgacgcgggtcgagatgaagccacagacatacgggactggctttgtgtttgtgtctgcgtgcgggatgtttgactagagcggaggcgttgaccgcggggactagcattgtacaagccatcgccatcctcggagaccgcatctccatctgcgtccatttctgtgtcctcgttggtggtagaacgtgcgttggctccacgggatcggagaccgcctctcctggttgatcgaggagtggcgctggatgtttgcgcaggagtgttgtcgtcgtcatcggagtcagagtcgctgctctcggagtcttcgtcgaacgaagcgacctttctccttttgcggcgctcgtcttcaacaatttccttgaacatggcgaaccggaggatagactccgcgatcttggcgtcgcgctcctcgactctgttggagaggcgtgacttggcgtgagccgtggacagacggatcaaggtttccaaggtacgagcagtgatgggcgatgttctgcgctggttaccggacaattcgtcgtttctcagagcagaatatgttgcgacaatgtggtcggcggctcccttggtcaggacgggcttgacacgagacttggcgtattggatgtatttcttaatgaaaggaatgctcaaaatctcaatgttcttgctcttggaccggctcatgtgggccatgccggcgtgaagcatgacattgaacttctcgtagacatctgtaggctggttcgagtcctgcgtatcctcgaggccgacaccaagcgtttggtgaagctgttcgcggacaggagcaccctcctcagtgccgggctggcggtagcggtgcatacggaggacgtgctctgacaccattctgtctcttgaatcctcaatgtcatcggtcacaacgaagagcaaatcgaaacgcgacaacagagaatcaggaagggcaatgttcttgtgggggtctttgtgggggtcgtattgtccgtagatcggattggcagcggccaggacactgcatcgggcgttcaaactcgtgtgaataccggccttcgcaatggtgacagtttgctgctccatgacttcgtggatagccacacgatcgacatcgctcatcttgtcaaactcatcaatacagaccacaccgcgatcacccagaaccatggcaccagcttcaagtctccgctcgccagtttccttgtcagacgtgacggcagccgtaagaccgacaccggaagatcctcgacctgtcgtggcaattgcaagcggggcggtgttcaagacgaaacgaagcagttgagacttggcggtcgaagggtcaccgaccatgagaatgttgatatcaccacgcaagtgtgtgccgttgtccaggttcttctccataccaccgagcagcatgagcaggatggccttcttgatgtaatcatgtccgtagatactgggcgcgagggagtgcgacaagagttcgaaaacgcccttcttcttggagaccttattgatgttgcggatgtcggtgtcggtaatggtggcctgtgcgattcctccaccagattttgaagacaattggataatgttattcgcaaggacaagcgtgcggaatgtggcagacgtagacgaagcgtttctgttacccagagagcggtacactccgacaagctggattctgtcacctggcttagcgcgatcaaccagatcatcgtcaacaatcacatccacactccgaggcagctggccagccggggctctctcgggcatttcttggatcgagatagtctgatggtccatatacgtggagaaaccgtattctgtgacaagctaatatgacgaagactattagcctcaagatatcggcactgcaccaatcgaacataccgggttcttctcctcgtcttcctggggataaatgctcatgctcgttgcaccactggcggtcatcgtcgcatccatgtacttcctcgtaaggaacttctgaccgcgctcgctccaatgcacactctgaataatcttaggtcggaccaaggagcacttcgtgacgataccctcgagggagatcattcgattcaggtgggaggaaccgagcgtcctagggttgcaggaatattctccgaatgcgccgacaaagccgcaatggtagttctaggcactgttagaagccgaacgagcaacgtggatgtatcaagtattcccataccacatcgtctcccgtctccctcgatggcctattcggcaaagtcttgatgatctctttaagggccttttcaaaggcatcggagtattcatatggcgatgtgagaaggctgtaagcgattagccagggcgtctgtatgagtgtgcgtatgtttcctacccatcggccatttcacggttatgcgcacggatctcatcaatgctaacctgcgcaacgtataggcattagcttcgggaacgtatatgctgtatatatgtctgaggccttatgcatactatcaatcgacgcaacccccgattcaacatcaacaagatatcagcccgataactagtagcaagttagtgtctgtcatggtgtcgtctcccaaggtcgttgagaatgggttggtgagcaacggacctgcgcgctctcgcatcacctagattagaatcaagttagcctatgtgatccattggaaccagtctgtcagagcttacttgggtcgagaaactcgacggcggcacgcactcgatcttgtgcggcgtcgtcaaactgtccctccatggcggcggactttcccacggactgctagtaagaaaaatagagggggtatctggtgataattggcaatgaggcgtgaaaacaaaatgcagctagaaaggtggggtccggtgggagaaaagcaagcgcggagaaatgtcgaggtgatttttgatgctcgttgatggggaagaaagggtgggttgccgggaggatctttcaggttgccatacgcgacagctcaatcgggtaatattggagcgcgtccgccagaaggacgcgtgcgaccgtgtcactgtatatatgagtcagcggtgcataaccctacatagaatacctgcattactacgactttatgctctgacaactcataacaacagcagtgatgccatcttcttcttatctttctcactttacttttgaattgctcgcatctgtcaacatgcttaaatctctcaagtttaattcacagcgctacaatcgtaaagtactcccaaaggaaccgcagcttctgaatggttatagcccaaattcaacgccataatctgtcccacagcgaccccatagtaagtagcaaagtcttgcagggtaccatagcccaaggtaaattgagtcatagtacaggcagtattgtcgcagatagggatcttcaccgtctcacccgtctgaaggacatcataggggccagggttcagagcggcaatatacccagtttgagcggtctggttgatgacagactcgaccgtgatgttgaatcgttcgttggcgatcttctgaatggtgtctccaggcatgatcgtatatacgtggggaccactatcgatacaagtgttggtggcctcggtattgttggtgctgaagcagctcaggtcatctgggaaggtcggttgagcaggaatgcgaagcacctcgccagcatagatgaagttgggatcagcgaggatattcagccgggcgagatcacaggttcccacgccgtatttggcggcaatggctgatagggtgtcgttctcttgaacagtgtaggtctcgttcaaagcggtgatatctaggtttatcactgttccggcggttgggagggctgtaggtagtgcgaagagttagcgtagctaggttggctgaggtaaaaatgaaaataaaaggacaacaaaccatcataggtggatgctggaagagcgacagccactgctgacaggctgagaagagtagcagcgagcatggttttgaacttcagctctccaaacttgttctcaaaggaaatgatctgacattcagatcaaaatctgtctggtgcggtacaagccctatttatataggccaaagaagcacttcgaagtcaaaggatctcaacccgcccacttggcgcaaccaagctaccgccaggccaaagacatcactatccagaattggtgcccatgaccgactcgagaaagccatgcccccgattccttggtcattgggcgcctccctcgccttttcttactcggaccagcatagcttcaacactaagtgccagcggactgaagctataacatggagattttgagggatgccgtacccttccacatgccccagagcatgaatgccatgcggggacttccccacaatgacctgggcacgtatcggacaaatggaattagtacggcctcatccgaagcatgggtgagtgtggcctagtgcaaatgtcaaagcactaaccgctagaccaaaaccgataaaccgctcttggctagccaggcgacggagagatatctgtcccaacagtaaatagtgtagaggtattagtatctgtgcggctggacgcttcggaggtcgggggcgactgtaacttccgacctccgtcggctttgggacaagacctgcccttggttgggcttggccaggtgagattttttcatgaaactcagactgtccgatgtcacacatgcgagcaatatccatgaacttcgtcatggtggcttcatgagtaagccagtagtcgtaactctaaagaaaggtttgttttacattctgatattgaaggagagaagtgataacgagattagatcccataacagctgtaataatacagagtgaactgaaatgattttggatggataatacggaatcctcctatcctcatttcatgataagtgggtttaggtcttcgaaatcacgaatgtgtgtacataccatccttggccacctcgtcttatgttttgtctagtagacaggcgtaaggtaggcgctcaacttccagagcatggcctggatagaggttgcgttctgttcgcagaccatagtgttgttgtcagtccagtatgggcgcgacggccaagtgcaaagctcctggacttcgcccttgtgctccccagaagtaacagtggcattgattctgacaggtactacgtcttcctctacccacttgatcatgtgggcgaaattgtcccgagggaaaccagcattgggttgctcatcgttggttgcgcagtgggctgcaccagggacgagatagaaacggtaccagtcgttgagtttctcattgccctcagcaaaagagaggtcaggatacatgatctcgcgaaccgattcgtggtagtgaatggatccggtcgggggaacactgctatcggcctctccatggtaatgaagcagacggcctcccttggaatggaagggggtcaggtcaggaagagtggtttgaagagagtccatgtatttggtcattccttcgatcatccatgccttcaggtcatcattggtgactccccacatgtccaaatccgtgacgttctgccaatttaggaatttggtaatccattctccgttggagttgggagatgtgatcgtccaggaatccgtggtgctgtcgtagacagtagtgtcgccaaagccggcagtaggctggaaagggaaatacacgaggtcaccgtttgagtctttctgttgggtttggaatcatgtcagcgaagtttggaggcagagaaactgtgggtgtcggggaaatattcataccagtccagttagaaggtcttgaatcacctcaatatctttggcattaatggttccattttgcgcaggggtggctgaagttgtttgcctcttgctccgcttcccatatcccaagccaaggctagtggtcgacccagcctcgcagtagtacgacttgcccagcattgaggatacattgaaattctggaaacagagatcgctacgagcaaccactccatcaatcttgccgtccatgccatcacaggcattgatcgttgcgttgatcactgtatcaaacacgcaagaaggcggataatagccgatagtctggatctggatgggaggagcgatgtgattcacctgctgctggccgtagcgcatagcaggggcaccagcaacgatgccatcgtacaattcgggggcacgttgggcttggctcattccctcacgtccaccttcagagcaaccgatgtaataggtgtacaacttggtaacgttatttccgacgttgaagaagttgttggtaaaggcctttccaatctgggtcatttcggcaatggcctggtatccccagttgtatatggcaggccagttggcagttccattgccgagaatgacaacatcatcgaagtcagtgccaccccagtaagggaatccaccgtcggtgtagccagtggcagccccaaaggcgacccctccggcgatatcacctcctcctgagccgttgttgatctcatacgcggaaccacctgtagcgaggaatctgttctggaaaaggtctgggctcggcatccaatattggacgactacgcggtcatctccgttctggtggctgtaggcaaaagatacttcacagaagttgatggtcaaatcctcccagaaaatggaatcggtgagggaatagttgcggtagatactagcagatacagagctagtgtcgatggtgattccagaaggaatgtcatcgctggcagtaggcagaaccgacgtgacatagtcggttgtacacacactgttcagcgatgccgcagatgcgacaccgacaagagtggcagcagccaggctgtacattgcgaatgaagagaaaggacgggccattgagcccagaagaagcaattagagataggacaaaaggaattaaaagattgttattgtaaaaatataccagagagaactgggccttcaggacattattataccattgggatcatagcaaggtaatggttcatttagttcagtagaccccttactctctagtgtaactagggcacttacgtatgtctctatatactaacctctctgcgtgaaacactggacgccgatcattgagtagcccatcccccataggagcttgatgagcagtagttatagtattcatctcgaatgccattgttgagcctaggcaaacttctgacagcataagccttgctgactctcaaagatacctcctaaaccgaggccatctagatcaatgacttacctgaagaccatacttgtctctaattgtatgttgtatgtatgatctcagctgctcgatggttagtctctctcttaatatagtagtgatatatgaatgatgaagatagacttcatgatctgcgcgagaccccgaggaccctatcctaccatagagtttgaatgcgagaccccgaggagtttaaacacttgattacctgtgagtggctaataaagtctccaagagtcgacatcttcggagatgtctcttattttcggactaaacacatcggccttcggccattgccagtcggagattcgggttcagtttcctcaaatgggctggcttttctatcatcaggcagaagacccttcccgaggccgagcggcaattgagctttttgagacgtaattagagtagccatagggcactggtaaggttatagggtgaagaagtttagatcctgttagtcttatctgtcatggaggggccctgttagctagtttgtagatatggtaacaacagacacaaacttgaatccctcgtggcgggaaagaaggccaaactaccaaacaagtcggaattgataccaaaaggaagtggattgcaggatttcccctccctcaatgtccataaatacacgcataaagcggggacaacatatccccttccagtactaacattcatgagaacaacagtagcatcctgatagaaataaccacctactaataaagttcatcttccacactagcggttagatcgcaatcgctatggttataagcgacatcggtcaggatgaacccctcgacgattcacagatcgacgaggaatgtttgtgcggattgatctactttgccaggaatcagacgtgctgttgaggcaccagtactcccgacaccatcgaatgatgaccaagcatatccagctttctttttcgcttcaaccatacacccagcagtctcaaccactcctccccctggatgcacgttgaagacaacacccacttaaccctacaatgtctcagcctatccctctcaccactcaaggccttcctcaaagaagtccgtacctatcctcgcaaggtctccgaatccaccatctcaatctaccgcacgcaatccacacctcgagatatccactggatgcccgtcgccactcgcctaccccgggacatctccaccatcatcctgaacgagaacaagaaacagaagattctccaggatataaccgagtacctacaccctcagggcagacagcggtggcgatccaggcgatcaggagaagcagaagatagaagacgagaaggagaaactgcaggagcttgcggacgggttttcatcgtatttgcctaaggattgattcagtattgctgatgtccaggggttcctgttgcagtataaacgggagcctgagaaggcatgtgagaatgttgctggttgggttgaggaggatttgggcgtcgatgatgaacaaactactaatactgaggaggaccgtgacaaatagaagaggggatggggcctgctcaatgctcaagaggaaaatcaaaccacttatcaccatcaagtagttgcttgtaactgagcatagcagggctcggctctatgaaggactttcaggagaaaaagtaggatattctctatagacaaacatggtcgcgcacaatttcgtcttacgacttcgtttttcagtatattaataatataacaaggatgactgcctcgcaacacaccagtacagcattggcatcaatctaacttgaactcctcagtatccggactttgtacccctccctcccctctacctgaccctactctaaccttagcaatccacagcatgtaccgggtacacgctcggttcagcgctcagccgcaaatgcccacgccaggtgcccccatggctgaactcgcagcaacccacagtggtaccgctgttgtgcagagtagtcacacatttctccactgcggccagaatcgtctttttctctgcggtcgtatcgcagttcgaccccgttgtcgtcgccttgtacgcatatcccagcaccttctccccgctgacatctgtaccataggtcaaggtgcacgagtccgcgtccgacttcgacttgatgagacccgccaaaaactcccagatttcaagcccagccttgactgtgaagattacgtgggaggcaactttcgctgtagtcacgactttctgaatcgtaatgcccgttcttttctccaagtccgtcgtgtcagatgtgacattcgcccattgccaggcgtagtcggcgttgatgaccttcaacttcactgtcatattgccagcgccatcatcccagtctgcaacgattggtgtggtgatcacatcatatgctgtttcattgtctccagcaagacatggatcaataaacccgcatgcgagaacgccacacaggaccttgctgagcttgaccattctccgtcggtgtagcgatgatataaagcacagagatcaatgataaggagacaagcaagctgcaggaggttcatgcacactaaagagaattgctcagtcaaaacagattcagtgggcttatggaacaagttggacgcttccgtaccttgggatgagtgctggaaataacaggtcaaggagaaagaaaaagtgagtgatgagctgatgtagaaagcaggaggactcattggattgggtgctttatatacctttgcaacctggaggacacaaaccttgccaatactcgcttgaaagtttccaatctccagaggtgtatatcaaaggctcttgaggtatttggttcacgctagcgagtcaaaggatcagctcgctagcttgatttgtatagcagattccgacgagatcaatcctgtcgcctttaccagcgagaatagataagaggagggagcactctccaccaccataggaagggccatatcaatcggttttgctgcgtgtgtccgccatgccactcacgttagctatgtcagttcgcattagattaatcgtcatattgcatttagtgatgttattgtagaatgtacaacttgtaatggtcaaaaggccgaaaagttgaagtttcgcctgacctgtgcagaaaactgaagcgatacaaagtcccacttcagggagccgacggttcggaaggcacggccctcgttaccgatgcggaaagagctcatatcttccttctgcctaatgatacagtgtctagtcccaaaccatgatcatagccggtgaacatgtgctgggttgattctggtgacgcggccttatgaggctagaaaacttaagcttctagtttggatggatagacggagaaattccgggatattcgacagcctcatggctactagcagtagggcagagttagtccctagggtcaaaatggaatagttcaatttgtataagcagtccttcgtgagtccctgctttttcgcccccactgactagttgctcgcatgattgaggtaatacgtaacacgtgaaagtaagtctgtccaggttatcgagtggataacattgcagtttcttttgatcccatcgttagcgctgacgagaagccgtagtacttacgaaggttttgctgttacctgatgtgggttacaatcgagtcaactccctagaataacgcagtagaagataggggggtgtcaatggtgagtatttggaagctagaaatggtggtgatttggatattaggatcaaagcaggattaatgggaaagcgaccaagctgtcacagaaatcttcatccatagtgtacaattccaataatgatcagatgctatgctttgactatactactatacattcacaaatctctttatacatatatacatactcgcccaacttgaacatcccaccccgtttggggtacatcctagaaatacactttcaactcaacgagtctcaccctcgccttgagggatttgcccttcgtcttgagggtcatatatgtcctgttcggcggcatcaggagtatcttctccttcttctgcctcctctgctatccagtcttcttcctcttcttctttttcttcttcttcttccatctccaggtcctcctccagatcgtcgaactcatcttcatcatcttccacaagactttcatcgtccatcaattcctctttcgttccgagttccttgcctctttcctcaagcagcgtctcggcctccatgtcgtattcgtcggggtagtcgagggtctttctgaacggcgagggtgcaacatcggaatcttgctcatcatcgtccagctcagagataccaacgttgagcggaggctcatcaattggattcgaagaggcgtcctttgattcgactcgaacattgctgctgtcttgctccgccttatcaccagtcggctcaacccgcgacttagacctagtcaggccgccaacgccaagaataccgcctgtccatacatagcgatcgcgtccaagttcatcaaccatctcgcctttctcctgccgacgccggaggagcacaccttggaacttctcacggaggtaaggcagtctagcaacggctgcgattgtcttcggcgccgcatcgtagatagcttgaaggtccgtgcctccctcgtggatgcttcgttcgcgaagtcgcctcaatgcagcagccagatataccatggacacgtacgtgggctgcatgaagtccggctggattttgctccagtagcgccggcccagtttgcccagtacattaggcggctttgcacgtttgggattctccatcgcatcaatggttgaaggcacacccggcggtcgtgccccatatcctcgacgaagattatcccacccagggaagttgggcatgaacttatgttcaaagacagtgaaagcttcaatctgatcggacaatctgtcggaggatgcaagcatctgcacaaatgtggaccaattgaaggttgtcatggagaagcctgcctccacatactttgctataacctcggagatcttcgaaacttcgtttccataagccaaagaacgcagatacagtgagagcgggcgagatagcatgaagcggtacgccggtaggatcgggtctttctttgtcgtagctggctcgcttgacgtagcctgggaggaatcgggattcaccacgagttcggcatgagatggtaagggcggtgtaactgggttaagttgacggctaagccactcatcaatatcaggggaagtgggactggctatcttcaaagcgcgggtgaaagccaagttccagcattcttccacctggtggtactgttcagccttcaaatgtgcgagcatcaaggcagacagcaaacgaagaggggcgatatcatggtaattttcttcgtcggagtctttaggtgcatgacttgcggtatagtcatcgaaaagcctccgagccgacagataagcccccttcataccataggcagagatcatatattcgtagtaaacagcagggaatcccttcctggcagacattctaccagaacccagcaaggggtactttgtcgccaatttggtagagtggtaatccgcaagagtctctgcgaggaacttctcagagttttcgagacgaatatttgcgtggttgccgacctgaccaccctgtgccaaaagttgtaaatctcgctggatctgactcttgagcacgaggagcctcgagccaagtcccggctggttgaatctgtctttaatttcgcggaagatgatgtgcaccatatcccgattgcgatccttcagatagccatacaggatgactgcgtagtggaattcagtagcgtaaacgcggcggcctctgtggagtgccctgaggatgcgacgggcagaatccgtctggcctataagcacaagactgagcatgagagcagaataagtcatatcatcgggctccaatcctgcggcatccatccgcgagcgtatccttgagatagcttccaggtccatccggaaagcataattccagagtaggatattccacattcttacgcgagaacccttgacgtcgaggccgaggcaagtctccgcaacgtgctcagccatctcccactcggagttgttgcaataagcctccacaactgtatcaatcatgggggcggttatctgcacgttatgttgttgggccaggctgagcaaatcgcggacatgagtgacatcgccccggttagcacaaagacccatcattataccgaaagtgtgcgagctgggctcaacaccctcctcaatcattttcttgaacatggcgaaggtccctgaaagatctcctgctttggaataagccgtaagcaggatgttccaacatataatatttggttgaaggttgaactcttctgaaattcttcggaattgacgcgtagtcttttcaacatcgccgattctggcgtaaacatagagaagcggagccacgagtttgcggcttcgcggcttcccgtggtccgaaagaaacctctcgaatacatgctggacgttatccacatcaccggctctcgaaaaaacaataagcgcctgcctgtagacgtcctctgtcggtttgcgatggaattgggaaatctcatcgaggaagtataagataccagttgtgatctcgaacgaagcaagacgcttcaacagcttagccagaagctttcggggtggagtttcttcttccatctgccaacggaaattccgatataccacgatagatcgaacaaacgtcgatcggtgctctgattcttggaggatgttgataagatcaaaataattccgggaagtgaccatgtccaaatgattgaacttttgcagtagtgctagtagggtctccgtcgcagtagcttcggcaaattccgtgctagaaaatacattgttgagtatgaagcgagtagcatgacgtactggactgtggagactctgatcttgtaaataatcagcaagtgcaaacaaaggcttatgcacggaagacaactgtagccaaggcgcgacagcgtgccatagtgagttgtcgcccaacggcctcgatctccaaatatcttgcacataatcccatcgttcagagttcacaaattgtgcaaaacagtatgcccagcatgagacgccgcggccacaggagactgcttcgcgacatatcccaattacatccgaaaaatttcccgtggcaatacaagacttggtcatgtgcaaataatcctcagaagttcgggactcggtaggcagagagttgaggagtcgtctggcccttctgctatcaacgtcacgctcagagctgccaattcccgccagcaatgcagaagtcaggtcaagagggtgaccagccttcgaaaaaaggctccataatttatcggaatcttcgatctcctccttatccaataacgctcgaagttcattcttggcaatggcgcggtcttcatcggcaattatttcagcagagtcgtcgagcatgtgagcctcagcgtccaccctgcggtctaggctaacagcctctgacgagtaatttctggaaaggccagggacggccttccttttccgtcgcgggacaagccttctcggcgaacgtatcaagcatgtcgctataaactcctgtgtgcgggggggatagagaaagtcgagaacgggggcccgcgggtccgtggctgtccttccggttgtcgaggtggcggttgaagtattcgacgcggatctttgcgttgcctgtaggaaaaccaaaagctccgcccctgcgctactgaattgcccaagagttgaatatatcgaaccccgacctcgaacagcgccgttgggatcccggaagaaacgccgtcccgcgttctcaagacatccggcagcccgttccagcattacctcgagaaattgcggtgccaaaccctgaatttcaccgaaacttgactgcgatgcataacatatcgggatcaaagctggattcgatgccaattgaggtcagtgggctgagcatgcaggaatgtgcagggtgctaagggagtcaggccataccacgcaaagcaatcttgtgcacgaagctcacagcctgccgttagatggctgctcctcctggtaagaatcaagagaagatcctgcttgagaggaaacaaaaccgacggctccaagcaagaaggccagggggtggttgatggccgggaggttgacgtgggataattttcgagatggccgagcagcaagctttcccgatgctggaaaagagaatcccgcgaaatcagccggggatttgtttggccgagacttgaccacctcagcccgcactcgttcgggtgggaacaccaccatcgccccgagctcccaccccagtcgtcgaatattgctggcacgatggagatcaccgacttcattttctcccagagggaggagagtctcttgacgggaaactacaacgcttatcgagcacacacgactcgcaagttgcacagcgcccgcctgcgacttggacagaccacccccaaacgcagcaagtacattgccaaacgacctgtgacggcggaagatgtgaacagcaatgtggagtatgtctctgaagtcatctttgacgtattcctttaaacactcatacggctgggtcagctatggaaattgtactaacactccggatttcttagatacgtccacaccctactcatcagcgccgaacgggcatgggcgaacgcaatgcacatgaagaccactcactcggcagacccatcggccaagggggttagcggtacgactagggggcacattatttcgaaactacggaaggcagttacatttgcgaagcaattggtgcacgttctcgaggatcaagaaacttctggtgctgcagacactgatgtcctcgaagctcgtgcatatctggcgtccctcttgggagcatacttcttggagaagcgcaattgggagcagtgtctccaaaactactccgtgtcaagagtgatctatgcagctctgggtcagcaagtcaagaaggacgccttccgagaccttctttccggcactgtcgaccccagtataagatacgcagcatatcagttgaagctcccgcggtcaaagcccatcccgtctttggctcttagttatttcccatcggacgcgaccatcaggtccgaagttgagaagttggaccccaactgtctgaaggaggatgcagcgggcactcggaggaccgctgacggggaggtgcagcaactccctggaagcgtcacatggagatcgcatacagttggcttggaagatgccgcaatctcacaggctcttgcgtccgcagcggcagctgagtctcgtctcactacgtggcttgcggaaggtgagggcaaaaacgcctcctcgaaagataaagccgctgcctacgataatgttatcatcgccagtcaagatgccgtcgatgctacaaagactgcgatcgatgaccttgccggagagggagttgacccgagtgataagagaatgcaggctctgcaaataacgcggactgctgttaactatgatctggttgggtggagaatcggacggaaccgtgtcctttgcggagacaacgacggcgtttcattcgaatctgtctcaaccaagttacccaagagtgccaaggctactgccaaacaggacgatgctacgggtaagaagctggcacggctgcgcgaaagagtcgtcctgtatgattctacccttcaaagtatcgagttcattcttgagcttcccggagttgccgcggatacggcgtttgttcgcgaattagatgcaaagcggcggtacttccgtgctttaaggtacggcagcgcagcccttccataccgataacctgctaactggagtctttcttagatgtctgaccattggacggtcgcacggaatcctgggcaagtctaccaatgccctcgccctatttgcgcaggctttggcccttgtcacagagaccgcacggtcgccgcaatccttgactgaaacggaaggaccaccgaggctggatatttcccgtagtcaggtccagactctggagctgaccttgaagggcctggttgcgcaataccgcggtttggtgactttggagaagatgtccgctgaagcacagtcaaaatctgtaactcagcgacccgcagtcgaacgtctacacgattttgccggtgatgctctggatttgaccaacattgttccttacccccctcagatgcagccgattccagtgaagcctttgttcctggacgtggcttggaactacatcgagtaccctcgtcaaagcacgcctgctgcagacaacagtcaggctcaaccggaaccacagccggaagagaagaagggtggacgacgcggctggttcggctttggtcggtagcctgctagtgattcaggctgtggaagggtttaatttctccacctgcttcatttccatgacatagtgtgtaatatgctgttgcatgtcagcacctaccaggtgtatctagcgtacatagtaaatctgatgatgacgatactgcgaccaataactcgcttacagcagagtgaatcttaacaacgtattccatgtgatctattgctgcctttatacaaattgtgttggttttaatctcaaaatgatagattgagagtatatagttgtgcctttgttgcagcactctgtgcggcgcactgaaggacactttttttttctgccaccgcctaaagttacagttttctccgttgaccttttcaggactgtatgttcttaaatccgcttaaatccggacttttttcagcgaggttcgctaggttctgccgcctaaagcggtctaaaaggcggtaaattgtgaggcacaatcgttcatagggcacatcgcttgtagtaaattagatgtcgggagagaatagttccccatactactgctatctatcttgtacattgaaacagccaagatctccttctattctctacactgtactgataggcggagaaccatccgggcgtctccgactacatccactcgttctatcaactgtcaaagatgctcagttccccgtggaaaccgcacgggccaattctccggataagccgagccacatccactcggaagtttgacagccggatcacctttctcaagtccagcaaatggtacgatggcaatttgtattgcttggccactggtaacctgcgtcgtcatacaattccaatggcccgttagtggtcggctcctccgggcattcattttattgaaccgaaggtgtggaaagatgattgatgtggcgtatgaaatattaataatctgtggtttgcagattacctcgctacggttcatgcagtctagatgaacaaggtttgttgtgagcttcatgggacggatacgatgatgcagcttgtctttgtctatgtagtattccatggagaatggattctcgaatgcggtactgtaattagtattaatattggatctttgggatacagatggctttggatgaatcaccactggtagatatatattcgaagcgagcactatgacttggaaaatctcaacaggcacgtgcttcacaaaacatggtcaggaaactgtggagatgaccacctcacagcctagaccacattataataaagtgttttatattgacaatcaatctaagaaatgacggaacatcgaacacacgatatccaaagggttcgtaatacaattgccattcattcaatatggatttgaaccgttctgactattgagcgggaatgtcacccgctttccctttacgagatcggtacctggtgctagtgattcaagctagccacaatccgcctagtgactgctcaaaggagcaagcgctgcctgacaattggctgcagcgcatgtgggatgttgccaaacgagccattctcgtcagaatcgggacacggatgtacagcgtggaaatacgcgcgggatacgagcgatcatccaggggcagctcgactttctctccacatcagccatcctcccgtgcagatttgattccttcgagcaagggtttgcttaagattcccacgtaagcccacaaactgcagggtgtcagtcaccaaaaattattctcattcgaccagctctctctaatcctagtaatatactagattccctattattgactacattatactcctgtttcctgcagaatcaattctgctccgtggaacctcaagactttttaatcataatattctgccgatcctgcacatcgggggcttcctgcggcgccgtactgccagactccggcgttccggccaatccagagcgagtttgcctgccctcgccaataattctgccccgaaattagagttgcgtctcccctggattcgctttcctcttcttttccctccgccgccgccgctctcctcctcctcctccctccgtcttctccttccctaccccgttggagaccgttataccgaacccaattgatcaattgatcatccgacatggcctctgtcaacgggagcttcgtctccccctcggctgatgccgtcgtctcccccaggctctttgagcccaccggtctggtcgcctctgtcctcgagggcttcaccgtttggaaggccttgttgactctgttcgttgccgctgtcatctacgaccaatgtacgtcttctctccaagccaatgccccgagaatcgggcaaaatcgcgactcaattttaaccatttatatagtccgttatctctggctcaagggctccattgtcggcccagcatggaagttgcctttcatgggacctttccttcagtcggtgaaccccaagttccacgaatacaaggccaaatgggacagtggtgaattgagctgtgtctccgtcttccacaagtaagtaatgcttttgcgacatgttccgggtgtgcgcggaggcgcatgactcgaagaggccagattttaacttatctgcttataggttcgttgttatcgcatccactcgcgacatgtcgcgcaagatcttcaactcgcccacctacgttaagccttgtgttgtggacgttgcgcacaagcttcttggtgccgacaactgggtcttcttggacggcaaagaccacgttgaattccgcaagggtctcaacggtcttttcactcgccaggctctttccttctacctccctcgcatggaagaggtttacaacgagtactacgcccgtttcttgcgcatctcgaaggagaacaacttcaagcccactccctggatgcccgaattccgtgagctcatgtgcgccgtgtcctgccgtactttcgtcggccactacatcaccgaagaagctatccagaagatcgccgatgactactacatgatcactgctgccctggaactcgttaacttcccctttatcttgccttacaccaaggcctggtatggcaagaaggctgccgacatggttctggcagagttctccaactgtgctgccaaaagtaaggctcgcatggccgcgggtggagaaatctcctgtatcatggacgcgtgggtcaaggctcagcaggattccgccaagtaccgtgagaagatcgctcagggtattgccgtcgaggccagtgacaagcccgcccaggtcctgcgtgacttcaccgattacgaaatcgctcagaccgtcttcaccttcctgttcgcctcccaggatgccactagtgctgcctctacctggctgttccagctcatggccgaccgccccgatgttcttgacaaggtccgcgaggagaacctgagcgttcgcaacggcgatatcaaggcccctctgaccatggagctgcttgaccagctgccctacactcgtgctgtcgtcaaggagactctgcgctaccgccctcccgtcatcatggttccctacctggtcaagaaggacttccccattaccgagaacgtcaccgtgtccaagggctccatgattatcccctcggtgtggcccgcctgccacgatgaggaggcttaccccaacgccgactctttcgaccctgaccgctggattactggtaccgccgaacagcagaccaagaactggcttgtcttcggtaccggaccccactactgtcttggccagacctacgcccagctgaacctgatggccatgattggcaaggccagtatggagatggactgggagcacactcccactcccgagtcggaagacatcaaggtctttgctacgattttccctcaggtatgttttccttgcgctatatcgattcgagttgaaagctaacaaagcccaggatgattgcctgcttgcattccgtccccgcccttaagcgttcctgccgtcttcgctaaagacgtcaggcgctgcaacgtcagttatgccggattctcctgccttgctgaaaaatagcaagcgcctgcttcgtgactacgggcaccctcttctgtcctggtgatagaatggctgcaggcatttcttctttgcctttctgaaatgtaactacttgtagtattgtttttcctttttctccaatactttctgaacctttgggatggggagttgcggacggtcgaccccttgaggtatggccactggcctctgtctgttggaggtatcgacaccgcggacagagtgtctggagtaacatgatattgaaacgatccaactgcggtcgtccgctcccgcgatgagcgacgcattgaaggacatgtcatttttagaccacgctacctagaattaataataataatgtgacacccgagctgctagccagggaatagaataccatcactagccctatgtgaaagttgtagttgaataggcttattcccatacaaacttcaataacccgtgtctggattcacatctagccctcgctatcactactacaacccttcactaaactacagccatcatgttatataaagcccatcccttcccgcttcctcccagactttcctacttccaacaagctactacataagctcccacactcgagataagaaatatatacaatactatatacccaacaagaaaaatgcggcatctctccaagcatatactattcctcaatcggctatgttcaccggaaatccactgccgatagcaatatatccatccaaaccctacatcaagccaagatgctttctcacttactacacccgttatctataaaacaccgaatatctccaacaaacttatatacaatacaccatataccaaatagcaaaccaaccggcatgctatcgctgccgtctgcgtcctagtgcctcagaacgagacgaacacaaagaaggcaggttgggctcccctagtgaccactcacacttacggcatatacggaataaacctacatattctgctcccacccgccatctgcatccactaagccactaccctgccaaatatgatggcatctaggcgcgggagcatatctaccagcaagtagcttctacgctaggtggatgtggaagcatatgtggtttctgtttcaggaccatactgttcagagatggttgtaatggaacaaaccatggacacgacatgtttttagaaactggttgggtggctgttgaggatgaggaacaataacattgtatatggggacatatctctccgtctactctgcacgtagacgcgatttattgttcttggtctactggttagcacgttgacactgcatgtggagaacgagacggtggacgatgaggatgaggaccggagcattcattgaagtcgtcgcttcgccgacgatatatcatatatacgcactgccttgcaagagagcaagagagtgagggaaagagtcttagatgctcttcctatttctgtctcttccttccctctcatacggtgattgctccaatgtgaatgcagcgagacagaacagcgcggtcgatatgtcagacgtatctatgctgaaatattacatcataatggaatggaagggcacatctttgcggctcttatatctgggatgctgttatatgccatggaaaaggcagccaacgtctatggactatatgacgcctgttcagcagatccgagctttaatgccggaccgcatatactgcccttccagatctgttcttggaaagtacaccatcacggacttcacgctaaaccctattttggtaacggtagatcggcttggagactctgctctttttctctcgatctacaagggcagtccaatacctgtatcttgcgttcctccatacagtcggccttcctgtccttgggttcaccatactatgtcggatgcaaagaccgctacagaggctcaagcatccgcgttggagcagaaacggacttcgaattagcattcgagttaaggtccggtaatcgagatattttggcttccaaaattgttacaggccacacccctccgaacgaaaccgtattggcattcccaattagaatgccagctatttctggatcactaccgtcacctttcatctcgaatcctgccatataatccatgctaggtgtaacaaggtatcacagacagaacatggtggaggcctatggtaatctacatagtcgcatcatatctgactgcgcggtttcttgctttcatgatcaggtggtggttatttgttcgagtccgttgagtacggacccatatatctgaagcaactgaatatcctgttagaaatgataaggtagtatgtaaaatgaagcctgtttagctttaaacttatgctaataacttatatattcagtcccctgacctatatcttactggacagatctagctagcattgttcaagataagatttcttttctccaggtcacttcctagagacgctcggacacgcaaccagtcatactgtgggaacatataatggacttctcgaagttcaggttactagagatcgtgaaactgggaagctaatcaccacctgtgagcatagagttcttggctctagccagggaacactctttacttccaagattgacttaggagccttattatatgatcgcgtgggagaaacacacggtatgtattttgcaggttctgaacagaaaaatcagacattcttcatatatattggaaagagaatggttcttgggcttaaagagattctgtggctataccaggccctgcggaaattgctgtaatactcttatcttacaatttataaaagcctgtattccttcctggatcctgtattcttgccattgttctaatttcaagcaatctgcagacttagcattcgaaataatcgggtcatggtagttgtagaaatagaacatatctagatagtcccgaaggcggtcaacactgcaactgacatcacccgaagccggacttccatccgtcggatatcggctgtcactctagcatatcagctcgacaactttctggacttgcctcgatctccaacccagacatatcaagtcatctttctctggggtaagtactcctctactcacgagccactgtacaatttagacaatagacaccatataatctcaaaccagacactaacttccgcagaactccaccaactacctgccccattcgcgcaacagcaccagcaccagcaccagcaacaacctcacctccaacccagtggacgaaaaccaacaacaatggcctctctcctccccctccgccgggcacccacgtccctcctctcctccacctccaaacaatctaccctcctcgtccgctccctccgagccagcaccaccatcccctccacccggaccttcacaacaagatcctccaccctcctccccaacaccatcaccaagagaaccaccattacccccatttctcgccctcatcaccacctcctgatctcctccacttccatccgccaaaaaagcaccaaggacaacgatgcccccaccttccgccaatggggctttgaagacgtacgtccctacctacctactaccataaccccccacccaactaaccaaagaatagataaacgcttccctccccaacagcccgactgaaaagcccatcattttaatcgacgtgcgcgagcccgccgagctctcctccaccggcatcatcccctcggctgtgagcgtgccgctcgcctctcaaccggacgcactcttcctgactccggaggaattcgagacgaggttcgggttccccaagcctggtgtgaagggggatgaggagggtgccgagattgtgttttattgtaaggcgggggtgagggcgcgcgccgcggcgcagttggcggagcaggcggggtatgaggcaagtaggctgggggtttatgatgggagttggttggattgggcgaagaaggggggtagggtggagaggtgggaggggaatgataattaatcttgtcttctactaggtatggatggtagtaggtactgattgtgtgggtagatgatggttgtatgtgtgccgggttgggcttgtatatattgtatgttgccatagtactactagtatcatcacatcaaatgggttcgtttcgaaagtgaacaatcatcactaagtactactagtagtggtcggtataaggtatagttagcttctactatgctctgcaaattcgaacaaacaatcaattcaactagagatccatgattatcattaacagaaaaacaaaaacctaggtatcgaccacgctttacttttccaaccacctcttctcttctcttctctctctctttcccccctttcatgtcatgtacaggcatcttgcttttgattgaaagtcgtagtcatttctcatgcaatgctcttttactttttcttcatcaaatcctgagaatgcacccacataaagcagcacttgtctcatcatcgcggcaatggaacttgagatcgctatacaataccacgataatggcatgctgaaacccgctaccaagcgccatgaccccgccacgctgtactcaagtgagtgcccagagctggtgatccaagggccatgcatggggctgggctcggtatccgggctacagagggaactggtaaggcgatcatgggatgtcaaagacaggcttgagcttcttgacgagaccccactcctccatcgagacatcggagcggtagaactccttgagggtgtcgatactggcacgggagatgtgcgagtacagggtgtccttgtcttcgagctgacggccgtacatgggctggttgcttccctcgatcttgacggccacggagggttgacccctcttgcagacctggatgggcttgtgatcacgttcgatagagacactatatgcatgattagaatatgtaaagtagggataataacgggggaaaacttacactctgccaaggtcgatgatttccttagcgccagtctccgggttggccttgactgccgcaacaggagtgtgcagacgcagacttccttccgcaacatcaacaccgatgacgatggggtccttcttgttgaacacagccacggtcttgagtacgcaggggaagacagcaagcatcttgctctcttccttgcggcgctccgtcagctcagccatgtgcttggtgaagtcatcgaacaggtggtagatgatgtcggcagtgaaaatcttgacaccgacttcatcggcataggcagctgcttccttgtccaccttgacatcgaaacacagcataacggcgtactccttggccttctccaacatggtaccggccatcatgacatcacgcttgtacacaggaccgatagaaatgttggcgacgggaatcttggagacacgaaggaactcgagcagagcctccagagatccgagagtggaggcctgcacgctgacaccacgctggtccctagagaccttgctaagcaggttctccagatcggacatgacctcttcctcaatgtcctcctcgtcgtcatcaggtccgacaaccatcaaacgagaaccggcaatggcctgctcaaggtcgttggcggcaatcttaacaccaagggcagccttgacctccttgttgtgcacgtactgcgacttaagacgcagttccttgagaggagccggtgtcaacaacgctcgaatattcgtagatataggaccgtttagaccgcacaaaacgattcgatcaccctcgcggaggataccgttcgacaggactacgtcaatggtagtaccgagaccctcaatgaccttcacctcaagcacagtacactcaacctcggacaggtacatcagggagttggtcatacgctcctgggtaagagtggtcaacagcttgagcatgtcagggataccttcaccagtgtgggcggaggtgggcacgagagaaacgttgcgggccatggacttgttctcgtagaacagctccgagttaaaaccctgttcggcgaacaagagcttagtgcgctccaaacgggtgcggaattcgttctgaacgcccttgttctgcaaggccaaactctcttggaagccgttgttgtcgatcttcttccagccgtacagacgatcaatcttgttgagggcgacgatgaaaggagtgcggcgatcacggagcagcctcatggactcaagagtctggggctcaagaccgtgcatgatatcgacaaccaggatggcgatgttacaaagggaggaacctctcgaacgcaagttggagaaggactcgtgaccaggggtatcgatgatgagcagaccagggatcttgaactcaaactggccgtctttgttcaccacggcagtcttctgacgcagagcatcaacagggaagtaagtggcaccgatctgctgcgtaataccaccagcttcaccttcctggacgtttgtctgacgaatcttatccagcaacttggtcttaccagtatcgacgtgacccagaatacagcagataggagaacggaggttgtccttggagcgcgcggccatagcctcctcgtgctgcttctttctccgctcggcggcctcggccttgcgctgagcaatagccttctgtgccgcggactgctcctcgtcctcagagtcctcgtcagaggtctcatcggaatcatcctcactctcgtcttcctcatcctccttggaggcaggcttctcggcagccttgccattggtggcgggcttctcctcttcctcgtcgctaggagcatcccagctgtccttcacttcctcggcatcagcagccttctcccagtcatcgagctcgctctcttctccgccagcggcagcagcagcctcagcctcggccttggccttcttctcttcctcctcctttcttctgcgttcctcttcagcttcacgctgggccttggcgcgggcagcagcagcctccaggtcatcctcctgcttcttgggtccacgcttcttccggttctcgtaaacagggcgcttcttctcggcctggccctcttccagaccagcaaccttaccaacaccagccgcaagcatctgctgcatgcgccgctcattgcgctccttggcttccctctgggccttggtgagcagcttaccctccttacgaagctgctccttcttctccttctccttctccttcttcctttggcgggcctcttcccgcttcttctcctcttcctcttcaatacgacgtctctcctcctcagcggcttgcgcctcggctaacaggcgctcctcctcttcacgctgctggcggagagcctcctgttgcttctggatagcaagcaggtgtgcagggatcttcttcttcttgccgccggtttccggaacgggggcagcagcgggggcgggggccgcctctgccttcttctcaggctcggctttagcgggctgagccttctcagcgggggcagcggtcttcttcttggcagcctagatgataaggtggacccatcagttcgacacgatcatgaaacgatagaaaagctgcaaaagcgcaagaaacatacctgctccctcttacgctgcttctcacgctccttcttctccctctccttctccttcttggacttcacacggaagccaccctcctcctcctcagcgggcttgggctcaggcgcagcagcagccttcttaggcttagcctttccggcgaacacatcgtcttcatcgaaggtaccctcctcaggctgcttgctagcgaaatcggcatcgccgttggcctcctgagtggcatcctcaccctcaacgaagtcattgaccggctttcccttcttcgccttcttgttcttgttcttcctcaaagcggcgagcaaaccgccaccgcccatgccagcatcctcgtcggcaggagcaccttcttcagcagcgggagcttcggcctcgccaccggcagcaggggcagactctccgagctcagcttcccagtcctcctcttgcctcttatttcccttcttcttgggcgccatattgataggttgaggattcggtcgacctcgtttttattcctttagatggatatgtggatggatattaccctatgtggattaaaaatgaaccgttagttaagtgaatagaaaggtactatgtgaccgagcgatgttggcagccaatgtggatgaatggtggtggtgcgcactaacaatgaggtatcagctttctccggcccgcgcgatctgcggaaggcaaagagtggcaaaagatgagcccgaaaagaaaaaaccttccaaaagggatcgtgaagaatgggaagaaaaagaaagagcgaaaaacaagcaaccgttttcccccctggtggtcgataagatccaaaggttggagactcgatgaggcgggaaggacgagttgcctttggggtaataagaattttgggccgggcgtttggtggggacaatcgccggattattatgcgagaggccgccggtggcccgcgctcttattgttcacggcgggcacacaataatcaccttcatagtattaacctgctggctgcattcaatttgcgtcaaatattttgcatctatgtacacggtacaattctatatatatagcttggtgtcaaatattatccttcacaaccgaaattggtagatacccttagacatccaccgggaggatccgctgcagccatctcataacgctcgcaaccgcatcgcttgtttcccccagtgcgtgtctagtcaattccgcaaagtgctcggggactccctgctccggacggattcctggagctgccggaccaccgagcgtctccttacttagcatctgcattagatagccaggcccgcgtatgagcaagcggctgagaacgtcaccgtcaatatgcatttgagatggctgagggtccatcagcccgaccgggttgcgctgtcttctcctcttgggaataaatgggcagatcatgggatcgcggatgcataagtcctgcagcaagcgtagaaggcgccactccttctcaccaatagtcaagaaacgatagactgtgccattcatcgcagtaccatagaatacttgagaggtagtggaaagaggtgacttatcagagccggagctcagcctcatcactgatgagggaaggtgtgcttcgcacagagctgtgggtagcatcttgttggtctctgtcacaccattctccgtcaaaaggctcacgcgcccacctctgctggagcagaggacaaggttcaacttcccaccaatataaacatgggcgagaccatcatgcttttgacgatcataagcatggagtgttaacttgtcttctgtggccttgagcaccatgagtgattctctcgacgtggtcatgtagaggtacggctccctggcagttatgaggaccgccggagacaggacagagtatctagccgctcggacccatcgtgtctgcgagaattttggttcaagtggcacgatttcatggccagtggaaaccatcaaggtgaacgcaccgtatggcgcaattgcgaaaaccggcccctcaaacttgtggatatatttcacagagcattcgatccgcgacggtttcgacggatcgcggtatgcctgtaagaatatgactcggccgcgctcttgctgatgtttgcgagaagtgccgatgacaataaagtgatattcctcgtccccttttctgggcgtccactccagtatgcagctgatcttctctcctgctgcaccttgaggtctccacggccggggatcgtcttccaaaggattttcgagggagtcgatgagcgagttctgcatgtcagggtcgataaactcgatgaagggccgcgtgtagcgcttgatggggtctgcgtctgtgtcgtattctgtctgggaataaaccactatcaagctcttgagatatcgcgaataagctaatctgctagcgctaccgggcaagtcgatcctccttggaacagtcttcgtcccttgctccaaggtacatatcatgagctgtccatcggcgacgcagaaaagcgtgttggaaaatccatccatgtcttgactcccggagctcgagatggaaaagctatgaatgctttttgggtgatatgcaggctgaaggatgttagtgtttgtgatcaaaatgatgggcttatgtcactcacattattctggtcagtgacccatatcctctgaagtgagtaatcggccagtctgccggtgcaagatgcctgccagaacccttgtccacaagtcaataaggcgaactctcccttgccctgtacttttaccgatgtgtgccctaggtgctgcggcgctacctgggttaatgctgcatatcaggccaattagcataggaattaatgggttgaacttgtgttagaacaaatctcaccaatgggggagtcaatactctccctgtccagtaatagcccgaatggaaccaggataccgcttcgcaaaccgcatagaacagtgcacattttcagtgattcttcaccggcatttttgatgatagcaatactgtcaatggctctcgatatgtcgttctcattctcgacgttgacagtggcttccagtaagaaagagatgctttctgataggcgatacaccaagatccttccgttgctcgtgcctacaaacagaaacagagacgagtcaagattttccatgatcatacaaatcggctcatgttgaatcaacgagggcgtagcgacatcaagcaactggtgctgaccatctgatgtgagtttcttgaagtgaaggcgtacttcatcttgcgtcctaacaacagcggcgatgagtgaggccggtccatcaacagcagccaccacaatagtctggccaggaccgacttcagagcgatagcccggcatctctggggttgcgccaacgcatactgtcctgtctgtcacctgtatgatagcccccgatacagtgcatcctgctgccagggtctgtgtgctagagtcgagcccagattctgcctcatcaatggcgcaaagttcttctccaaaatcagcaggcaagtacaacagaagtgaggacatagggtcagatgttagaacaaaaacgcccccagtcgatccgtctggcatggtccatatatctctggttccagacagctcctccagcgcaacaatgagcccgatttgtgcttcaacgccgtgccgcagctcaactactgcacctcgagagaatgatgaagcagagcagacaaaaaggcgatcgcttgcaatatccgaaggtgtcgtatcctcactcttcacaacaacggagtcggtgacaggggtccaattcataaatttctggacacaccgcggatggtcacgagccttctggacaaatagcccgccatcacctgtggtgcccgctgcaaggagcaggtcaccaccttcgtagccgatgtccagaatgtcaaatgctgcatcaacatcacagcacagttggcccaaatgtgcctgattctcgagctcaccgtcagtgccaattcctaagtaggttatttcaccgtcctcgcgacagaggtaaatgtcatcatgcttctgattgtacaaccagttgcgcaacggccttgcccatctggtccagagcggtgacttctgagattctttttcatagacagggagcgggtatctgctagggagtctttgagggtcaagcttattttggtataccgttatcgatgttgtcgtgacgagcatgaatgaagaggtcttagtcaatggaatcaacattgtgggaagcctatcctccagcggcaatacttttttggtcacccgtggggtagcctggcgtaaagactcgttggcatcccactcgtaacaaacagcctgtgtcaactgatcctgagcaaccaatagtagtaaagtaatcttgtcaccgtcttcagactttggatacaggaattccatggcaatgatatcgccttcaacgcggaagaagcgctcctacaaaggatcacacaggttagctgcaattcagtatctaggatcatccaaaactatacctctgctatagggtctagtctattttgggtcatctgtgcttggatgaccggcggtctcttcaggacgaagatcccaaaatagtcacttgaagcactaacagctaccgcacgagacctgcaaaatctctcagcctatgatcatcataaacaggttcatgaagcggcataccttggttccacagcaatattccggccgaatcgttcaaaagcactgacatcatttggcagcggccgacgatggtagacaaaatggccactcgcgttcgaaaaatatagaaatactagctctttcgaagcaaggctaagaaccaatatttgtggaggaaggtcctggcgcaagtccgagttcgcgcgcagtgtcgaattgctcgccccaagcttcatctcctcttcccaaggcaattcggtgctgacattaacgacctttgctgccatgatacatgagtcgaagtcacttttggtagtgacctcctccaagtgaacccccgataccgcttctttgatttgcaaatgccgctcacccacgaagacgacatcattttggtctttgcttctgaggtgcgcggggaggatccactggatgataggactcgatactagagtatgtgacaatagcccaatttttgcctgggatgcagaatatatgttctctgtctcgatgtccatagaatctccggtcgccgaagtagttacggctaatcctgcaccgcttcctgatgtagccatggtagctactattattgactgtggggaaagcagggcccgtagaatcagagggaaaatatctcttgccaaacgaaagaatgagaggaggacacgaaatggaaagaaagaaagacgcgaagatgaaaaaggaaatcaaaacgagaggatatgacagccgaccaacggtgtccacagctgcttttcgagggatcccgactccttattctgtggagctgaaaattcagggaagaatggaaggggtggtctctcagaactatggtttgagaattttcatgcttaggatgatatgagaaagcaatttcatgtcaggaaagtgctgagacaccagaggcgaagtgaacacagaacgcagtgctactatgcgaatacaaatcaaagagtaattccctctgtagaaatgataccgctatgcaaaaccgaaagctagtaaagtatcagcaaactgcaatctatggaagactgccacagggcaaggattcgggacttacactccaaaggtatcttatgcgaacgcttgcggtggtgctggtgatatgcactgagacggcttctcgattctcttaaacaccatatggttgtccaaaagtttatgtttcacaatgaaaaagcgtttatgggacacagacagcggggaagtagtatgtcgaattaaacacgatggccagcagtggaacccaagcggtttgcgggaaggtcaattgaatatgtttggttttagtatgatgccatcggcccactatgagtttgcagcattgtctgcagctatctttgcgaaccagcaagataaatttgcaaggatgacagaagttgttgcttgcgaataaaccgacagtgactctgggactcgtgaagacctcagccagccatgtaagaagttctggaggggcagtggatcgatcatcgaagcctcgcctgctcgttcgggcggtcggcgatacagatcaaaccaagcaaatcacagatcacgggacacagacctggtgtgtggcctgaggcggccacgcgtccgttttgggtttggccatggccgcagtcacctccggctttgcatatcgcctatgttatcccatagatatttcgttgcctagattgcggtgctgtcggttaatctggagaagctagggccggaccggaattgaatactgggcgttgatttccctaaagcaagctctgacctggcgagaggcccgttcatccgttgcatccaagtatagactactcattgttaacgctatacatcgggatacaaaattaatttatatcgtcaaattgtttcattcggaggctggcctgcagagactcaaattttatacacaccagtgttctgagatacactgcccgcctcaacgatggaccagccatctgagaataacgagccagaccacatcacggagacaagtctggaaacagagcagaagactgccgccgaagccgaggcccttgagtcagaaaggctcaagaatgctgagctcgaaagacgcagagccgagaaagaaaaggccattcgtcaagcatgcgacttgcgcgattttgatgcactagtctcatatgctacctcagaaggcggcttcctcaacgatgatgtccggcgaactgcctgtgagaactaccctataacgctcacatgcactttctgacgttctatcagggcctatccttctacagtgtgatcgacgtggacccaattttgattttgcaggatgggaacaactacctgcacatagtgacgaagaacaagttcagcttgatgtgaacaggtcgttcgtctactaccctgaatgtaagtcaccctttttatggctctcggtggtgtctaacttgaccaggctctgaccaggagctatccatcaagaaggatgagctctccaagttgatcaagcaagtcttgcggtgctttcccatgctctgctactttcaaggctatcatgatatcgttcaagtcctgctattagtgcttggtggccaaaatagtgctgctgctgttgcacaaatttcccttctccggataagagattacatgttgccgtccctttcgccggcgctgaaacatctagagctgatccctgcgatcatcgaaaaggccgatcctgcattacgacgtcatctcgccgaaaccaaaccattctttgcactcgctgcgactctaacaatgtactcgcacgatattcaagaatatagtgacattgcacgcctttttgactttctgctggcccaggaaccggtagtctccatatacctttttgcggccatcatcctctcgcgcaagaaagaattacttgagttttcagtcgatgaaaccgatatgttgcattttaccctgtccaagcttccaaatcccttggatcttgagggtctgatatcccgcgcgatgcagcttttcgaagctcacccaccggaaagtctaccatttggggcctggaagcgcattccagagtgcagtgtgctcaagtcttcacgggaccttgtcaggatccaagcacctgatgagacagtcggcctcttcgcgaaacaagtacggcatctacgttacgaggagcggaaggagaagaccgttgctttcttgtggaatcacagacggactatcggctccgtggcagtgacgatatttattggtgctatgtcgttctggatcaagaagaggggatttgacaatacgatatggtcgtatgtcagtagattccacggggctttgcaggcccgaggttacatttaaccttatgtcaccattgggaaaagacagaaaggcaccggctcacaaaaaaatatgcttgggaaatatatgtaatattactgcacacgaagaaatatgtgataagaaaggaaatataatagttttgagagatgaagaacagcctcagcacacagattagccagtagaggcggacgcacaaaatgcgaaacacagcccgcgtcagcccgtgttgaatagatggacagtctccacatggtggctagtgcgtggctttcccggcagccgctgaggtgtactcttgcattcccgcatctcccaggaaccgagagctcaacaaccacctttgaaaacgaacgtgagctgcccaaaatggcgaaccagggctacgacgtggtagtggacgttgacgccgaggtaagaccccgtcaacagtccgcatctgtaaccatagtctactaacagcaatttccagggcgatctcggccataccgacctccaagaagacctcgaattccaccgttccagtaagctagctggccttgagtaccaacacctcatcccaatgcacacctacttacctccattatctcagacttcgaaaatgaccaacgcaatgccaaggcccaacaagactcggcccccttcctcggcggcggttcatcgcgcggccgtgaccgatcccccggcggcacaccctccaagctcaactggtggtcgatccactactactcgcaattcttcgacgtagacacgaacgaagtcctccgccgctgcgtcgcagctctttacccgcgcagcaacttcctcgacgtcctagaaggcaacccagacctctacggccccttctggatcgcaaccaccgtcgtcgtcatcctcttcctgaccggcaccatctcgcaatggctctccaacaatgacgacgagcacttcgaatacgacttcactttgctatccggcgccgcgggcttggtttacggatacacgggcatcatccccattgcgctgtggggtgcgctgaagtggtttggcagctccagcgcggacttggttgagtcgtgggcgctctatggatactcgaacctggtttggattgccgtcgcccttgtcagctggagccctttgacggcgttgaactgggctctggtgggtgttgggttcgggtggactgtcttcttcctcctgcgcaatctgtacccggttttgagtgctacggatgcgaaggctagtaagatcttgctgattctggtcattgtgctgcatgctgggtttgcgttggctattaagatcttgttctttgcgtaagtggttccctactattctcccttccggtgtgattatcttactgtgaggggttctgactaacgtgataatttatgcagacatggaagccctgtttcgaagaagaacaaggaccatgatgacgacgatgatcacgacgacgacaagcgacggatgttcggtggttggtagaaaagaaaaggtgctagatgtcggtgttggtatcggtgtcgtttccggatgttatactgttcagttgctgtctttcccctcacatgggaccatgacattgctccggcagcattatgtcatgtcatgtctcgacttgctggtttatgttctcaagtgttgttatctctgatatcgtttccaccgttttgtctgttgaacgtttttcctcttccaagccatgctgcatgtgtatgtgtatctactaagaatgcgacgagagctttttttgaattttacaggttgtgctttgattgcaacttcttcccgaggagtcaactatagacatttgacttcggctataagtaatgattcatcattccaacgccatgtagaaaatctcccacgttgcaatcgtatcgtaaccccagcagctcttttccccagcaacgcagaaaaaccgtaataagataatcgtctatttgagcttcttcttggggcggagctggttggtgtgaccacacttcttcttgcggcagttggtggcacgggggggaagacgggcctaatcggaggatcaatgttagtgggggaaatggttcgctaggcgggactcaaaagagggcgggatcgagtcggaagaatagaaaagtagaatagatggatggacgtacgtagcacttgcggcagatggacttctcgcagttgtacttggaggcgagagccttaagggagggctcgatgataccaccacggagacggaggaccaggtggagggtggactcctatagtcgagaaaaagaacccgtcagtcaaactatatccccaatagtcaagtcgcatcgaatgtcgatagtcgtgaaacgttcatgaatgcgaccgtgccgattgatcctcccctcaaacccaagtagtatgttgtggcgccccaaccgacccgtatcgcatcatgttcgtaaccgactatccgagcagacgaaatcgacgtatagatgattcgcggaaccgtttcactcataccttctggatgttgtagtcgctcagggtgcggccatcctcaagctgcttaccagcgaagataagacgctgctgatccggggggataccctccttgtcctggatcttggtcttgacgttgtcgatggtgtcgctcgactcgacgtcgagggtaatggtcttacccgtgagggtcttgacgaaactattaatcggagaagagcctgggtcagtttccttatttcattttcgatgatatattcgtgccatctttcgggattcgaccgtaattcgacgggtggttgccaggggacttggaatgacctacatctgcactgcagagacgcggaaaaaacgacatgttagtttgcgacttcagggaacacgcatttcgcattcacgaatgaagagggtatacgtactggctgcggttttcgttgttgctggctgacgatcggctgaaaggtcggtcggatgaggcgatgtcaatttcacgatttctcgcttagcaaaggtggaacggaccgcacgtgatcagggtttagggcagtccggccgcgttcggggcctctccgcagtctccatagcccgtagcctaactacttttacatcatccatttagcatcatgcatacgttggaggctgtccgtggtccgtggtccgtggtccgcggtccgtgttgtgattgtgctttcatgatgctcgatctaacactactgttcaatgatacaaaacaagcctcccttacaaatttgtaacatgcagagaagcctacgaccatatatgactaacgatctcggaagtttctatttttgatgtttatatactactacttcaaggccgggacccaattggctccgtttcccagtatatatgatcgccaagctcaactttactcgccctcctccagctcagacatactctcttcgtcattgtctgaatccgtactggactcctgagagaattccatgcccatcgatccaaagtactcaacccggcgctgctcttccagccaccggttgatttgattctctgcttgtgatacagccctgatcaatgtagatatggaaacgccgactaccttggcagctgtctcgtagaaggccctcgcagtatccggaagatcagattcggttcgataccgcgtgtaagagcatcccggccggggagtgtccaggtcatcctttgcaatgacttgtcttgctcttaattggctggtggacgccttgaccaattcatccagagcttcctcatctgttagttctggagtaggagctgtggcctggctttccccagcacttggaccagtcggaaagagctctgcgaggggatttgatactggaacactattcagcactgagaagaaaataatgtggcatatgtctcacctttactcgcatcaagccaattattctcgtaccaatccatatactcgtcgagctgggacggcgtcatgctgaagacgtctctctcagtcaccaatatttcctttcccttgccaagctgacccgcaggcgtctctcgattgtcaaaatgcctctgtatttgtgaccaaagactccaatcgatcacttgcactgtgggctcttctatgttcgtgggatatctttcaacatcgtcaaatgggaatagaagcttggtggagatgacaactagagcgaccagttgcagctcgggcagttggaggggccttctccttccagatatgcttgtagggaattcgaagttgaaccctagaagatgctgcaactttttcgcggctggataaatatcgactggaagtaggttaacgaatgagaataattgaagatggggcgccgcatacgaggaagcgcaagtctcttgacgtatttatataacaagactggccagttcaaagatggaaattgcatgttgaatttgccatgataaagcagcagaaggtccgagacagctccgtgaagatgctcggcttggagtagcctctatcatatagtcagatacagccatctatttctgacatatcataggcactcaccgtggtctcaagtatggaaatgaactcttgtggtagtctatctctcatctcccgaggaatatcctttacaattctgatgaaaggaacctcgccacgcataaccatgctaaacattcacttagcccttgtaacattcaaagtggttcatgcttaactactcaccgataaaaatccccaacacccaccggcagcctcattaacagagcacctagatagcacagagcaatgctatcaataaggcgaggccatgtagcctgccttcctctgaacttgatgtcctcggcgccatcaagccccgaggttacttgcgaactgaagaactcgggctcctcatcttgctctgaaggatcattaatcttttcggcgtatgtctccaatcggagcgcccaaaggtcgcgaacgacaggctatgcccgcatcagtcagccgcttcgttagtggtttcccaaagggggctatgccatgcatacctcgaactgtgacggaaagccgcggtgatggacgagcgcgtgacattgcttccagaggatcaattggtagacttgcagaaacagactatacgcctggcgtccccggtatgctgcccgatattagctgatgtggagagcgcgtcacctccaaaccatgatggtaatggtgatggtgggtggtgatagtagttatggtaggttaggggctctcttactcttttgagacttctccgcagcagccttctttacgcgacttgtccggccttgtgtattaaagtcttcaggatcttcttcgacttgacgtccctacgcggtgaatgataaatgagtgggctgatcggtcgcgtgtgtagaatgcgtgaggggcgcggagaggggaagatcagacctcttgttgatgaccccgcctgcagaaccagaggccattatccaggtaataccgtcgttcacggcacccttcctgcccgcaaacccctcgggtgatgtactccatccagggcagcgctcttcattcttccttgtccagaggatgtggaggaacagaaggcctgggtcttccggagcgggtcagcgcagctaccagaaatcgttaccagtcagattttttctaccgttgatgcaggtcccgaaaaagtaatatccgcatcgcgccttatcgcccactgcgtagcccttgattcttgcgataaggttgcttcttcagtgtttccgtaggatttatgcacgcctgtctcaggatatcggatctatactagtatgctgcttatcttgtctacaaatgacattggagtatattgggtcgggagaaaaggtagttattttttattcgtcaaactatcgtgaaagtgctgaactcaagaactgtttctctgacaaggcaggatttatgccgccaaattaacgtgaccatcatggccggctcagcgtatacccaaggctaaacagacggatataagagtacgtggcgccgtagctgcccaaaaggccgtatcatccacctgaccaagggcaaagccgagcgaggctcttcaaatacaccatggatgacagagcagttaagggtccatagacacaataatttagttgcccttgggagcctccttgacatccatgcagacctgctcgcccatggaggacaggatggtgacgtctgaaaaggaaaattcgtcagtaatcttgccaacagccacctagccaaaacggacgggtgttactcactgcagtccttctcctcatcgtggaacatgcggcggatacggtcgcccacctcaccttcggggaccttgacgtcgtccttggtgttaccgttctcgtccatcagggaaaggaagtcgtcgtcagtaacgtcaagctatagctgtgttagcgagtcaagatcaccaagaccgttcatgttccaaactactcacgagctggtattccttgcggtagacgttggggacgtccatgttgtgggtggagggggacagatcctcaagcttcttgccagtgaagatatcgatggcaacgatgtggaccttggcgtgaccgtgcttgccagtcttggaggtggacatctcaacgatcttgcaggggcggcccttgataacaacgtgaccgttcttgcgcagggcagagcactgcatggggaaggtggccgaggcgccggcgtcggcggactcgaaggtctcgtggtgctgttaaaggtgaacattagcgaactagcccatgattgaaattatagcagatggtcggcgagtgtagcaaaatatgcaatgtctgcaggaacgaggggggttgggtggggggcagcgatcgagatgcgaggccccgaagacacccaacccaaccgagcaagcaggacaaagataggccgcaactgagtagaccgggaagttcgcagaaggagagttaacacctacctcgtcagccatggtgatggatattagggggtatgaggtaaaaagtgaaagggagaggtgaggaggatgttggaattgaggaggagattagaggaaaaggaagagaaaaaagcgaaggaaggacgaagagggggacacaggcgaaaagaaatcgacaaatggactgcgaaaaaaaggcactggttgtggcggggttttgtggtcgctagtcccagtccagcctagtctcggacaaaccacgtccgcggttgctgcagttcgccgtagcatctcggcctgctattccacgtatactcctaaccattatagtagcagtagttatctactggttatctcctgtcgacaatatcagcctggtctcggtcttgatctccatctcctcgaatgttcgccgccctgtaacatctcccagtacccatctgtgttctgggagaacttccctcacccctctacctcacccctcgatgaacccggggagctctccgctatccgcacgcttctccgtgccggcctcccaagatgtggctagaccgcatttcgggccatgcgacgccctccggtccccaattcgatagtcgcagcagctctcccttgcctcgaaggacctcttctcgcttggctccaacccctcagaacaatcgccccgcgtctagtcgccaaggttcagcgttgtctctcttgtcgaccccgaatgattcgtctacctccctctctgcgcctgcgcgaggcgaaggatcctcgccaaaaccgagtgctacaagaccccgcccatccgatgtcgctgatccgctcgaagtcttgaatgggatcattgggaaacaaggcaaaacaagagacagctctccagcgtccgtcgcggaactgaaacccccggagctcgtggaagacattgattttcatggactcagcctggaggactttatcgcggaagaagaccaaccgcgaagagcttggcaaagcgatgtcggtgcccagaccatccagcaatttgagaaagaaagggacaaattccaggacctgcactcggcaatcactggctgcgatgacgtctccaagtcagttgaaatgtatttgaatgactttcagaatgaattgggagctgtatcggcagaaattgagagtttgcaatctcggtctatacagctgaatgcgatgctcgagaatcggcggaatgttgaacagctgcttggtcctgccgtggaagaaatcagtttgtctccgaagaccgtccggttagtggcggaggggcctattgatgagaactgggtcaaggccttgaatgagattgaaactcggacggctagcatcgaggccaaggcctcaggcaccaatagtagcaagtctatcgaagatgtgcggcctttactgggtgatatcaagaaaaaggtactgcttccgatatagattcactttacaaaccgactgacaaactacgtaggcagtggaacgaatcagggactacctggtctctcaaattcgagccctacgatctccgaatatcaatgcgcagatcatccaacagcagcgactagtcaaatttaaggacttgtacggctacatatcacgagcccacccaactcttacgggagaaatcacccaggcgtacatcaatacgatgcgatggtattacctgtcgcatttcacaaggtatcaccaagcactcgagaagatcaaggtctatccgagtgatcggaacgaggtattaggaggggacccaacctcacataaaacaggtgcgttcgggcttgccactcggtggatgatctgactggtactaactggcacaggtaatatcgttcccggcggccgagctggttctgcggcgcacgaccccttctctctcggcaggagagtcgacatacttagggcgggtaaccaaatggcgatatcttcctacttggcagaggaggacaatgctttccacgggctcgaaattcccttccgtaacttcaaccttgctctcctagacaacgtttccgccgaatactcatttatgaccgagatgttctccacattgggctttcaacaaatatctcgcaaggctgttgagatcttcgaaccagtcttcacccttgggcagaccctgaccaagcacctgatcgaacagactacggatgcgcttggagttctgatctgcgtgcggttgaaccagcaagccgcttttgaattgcagcggcgcaaggtgccagtggccgactcatatgtcaacggaaccaacatgcaattgtggcctcggttccaggtcatcatggacacgcagtgcgagtccctgaagcgggtagcagcaaacaccggccgtagtgcagtttctgcgttgtctcttgccggaggagacgacctcaacaagtcatccgcacctcatttcctcactcaacggtttggacagcttctgcacggcattttggtgctgagcagtgaggctggggatgatgagccggtttccaatagtctgggtcggttgaccacagagtttgacaaccttctgacgaagctcagccggattggcggcgacgccaaacggagggagaggtttctttacaataattactcacttgttctggctattattagtgtaagtcgatcgatccgccgcggatactggtgctgacggatgcaggatacccatggcaaactagccaccgaacaaaaacaggtttgtgctgcattgccactggaaaggatcggactaacgctacgtagcatttggaagacatgcttaagaacgtaggtaagcgtggctagttgatagacgttcttcatagaagcacgctgggttggtgtctagatgtgccattgtatattccatcgccgattacggcacgcccaaatagtctactgtacgacaatataatccatagaagcgactaccccatataatagaaaagagaatatttttcaatcaaatacccctgatccacatttgaaatccatgttccgatccccaccaaccaagtatcctgccaggaacatcccaaaagataacgatagtagcagagcttatcggcatcggcgccgatgccgactccgcccggcgtggggaacaaccacttaagtgcttctcctcaccccaacaacgcacccccgtacaatgcaggcattgtcacaacgattccactgagccacccagtctcaatggccactcgtatcctccgttctcttcccaatagccgtcttctatcgcggcgcgccttctccagcaccgccgcctccaaggccgacgtcacacatgcggtaactaattcctaccagcacccatccatctacattctcgactcagacacaaacagcaatctaacacatcactgttaaggttataggcgcaggggtcgtcggactggcagttgcacgccaactcgccatgaaggagggcacatcgacgatcctactcgagagacatgaagcgccggggacggagacgagtagtcgcaattcagaggtaccattccagatttcgattatgccaatacgattatactctcatgaataaagctaagcaatctttttataaataggtcatccatgcaggcctctactacggcaccgacaccctcaaaaccaccctctgcatcaaaggcaaagagctcctctacgcactctgcgcccaacacaacatcccgcaccgcaacaccaagaaatggatcgtcgcccaaaccccagaacaatgggaagcctgtctccgcgtccacgaacacgccaaacgaatcggcgtgcccacacgcatcctagggcaggatgaagcgcgccggcgcgaacccgaagtgcgcgccctcgcaggcatcgtggagagcccgacaaccggcatcattgacagccattccctgatgacctatctacagggggatttcgaagaccgcggaggggattgtgcgttcatgacgaaggtgacgggcattgaacccgttgctgccagcgaaggtggcggataccggattagcgcagtatcagcggacggaagcgaaacgaccatcacggccgagacggtgataaacagtgcaggcaatggggcatgtgcgatcaataacatggtgttaccggctgagcggcatcgcaaagcgtattttgccaagggaacgtatttctcttactcggcttcaacgccgaagacgtcggtgctggtgtatccggctacgttgccgggcacgggcggtctgggcacccatttgacccttgatatgggtggcaggatccggtttgggccggatgtcgagtgggtggaggacccgaatgatttgaagccgagtccgacgcggctgcagcaggcgttaccggagattagagcgtatttgcctaatgtggatgttgaggcgattgatctagactattgtgggatccggcctaagttggggaagggaggggcggtcaatacgggcaaggggtttcatgattttgtgattcaggaggaggaagggtttccagggtttgtaaatttgttgggaattgagagtccggggctgacgagttgtttggcgatcggggagagggtgagggatatcttgtactgagcttgaaattatccctatgtatatagagcgtagctgtatgggcatacttttcacatatcacactaaaattcatatcacgaagtggagcctgcagtagtaacaacacgcatacaaagaccagacagacagacagacagaccaaagaatcgccaccacagtctagacaaggctacaaggcttacttggcagttccagcatcgaacaaagacctcacataaccaaggtcaaatgaggcttgttccgcaggcttagcatggctggaacaccatcagagacgacgcgttggactccacctctgattaagcttctccatcggctacgtcaagactctgggcaaaatagatacccttttaagaaacgcagcatcttttccaacaataacgttgtaaagtagaaggatcatattatctatctataacgagaaagactgtacctgaattgacatatcacatttcgtttctatttccgtcaaatacagtaaagtgatgaggagatacggagggatctggaaaggacaatcagcgaggaattacccgatgcggaagagacgggttgtttgccacgccttgcaaagcagatcccccaactcaaggtcaaagtccagacccggacttggatcgacgggttacgcgtgtttgtgatactgtgagtacttatatgttatcttccttttcattccgtagtgtgatctctactatcatagtttattttatcatactacatgaaagattgaattgactatttcactttatacttctctctctcttcacttctcttctattacatattcatctgtactattgctatctactatctactatccactatatactcatccaacatgaccacccacctacaacaaccacatcaccacaacttccacccacacacttcctcctacaacccctaccacccctacaccatccccaaccacgctcaaaccaagaaacaacgctcacgtccacaccgacgccaacgtcaacaccacccctccacaaaacccccgaacccctccgccctcaagaccccctcctctccatcaccctccaaaagcaaccgctgcttcacctggctgctccttcccccagcaagcaacactcacatcgccaaaaaccgctcttctttcagcagctaccgccgggcaccatgcaaaatcgccaaccagcgggtgttaggcgtaggcacagtccagctccgagtgcagagggcgccggacgaccctcgcacaaatacccttgtgctacatgacgtgctgcatatgccgaatgcgaggtgcaatggcattagtgtggctaaatatacgggggagagtgaggaggagacggcgtcggagggggggagtagtgctggggagagggcggttgtggaagaggttgagaatggtggtctggtgaaggtgaagagtgagagggaggatggggaggggttgtggtttgcgagagggagaagtaggggaggtcagggcaagggtgagggtggggatgatgggttgagggttgtgttggcgggggagaaggagatggagaaggatgatggtgctggtaaaggaatcatgggggtggttgcttcgaaggaggagttggagatgttgaatgagagggttaagaatcggtcgtgggtataaaatattcccactttgtggatcatcatattgtacataaattggtatacatgctgtcgtatttataaatgagatcgtaacgcagttgatggcttcggttctgatgtagtggtcattccacatccatcagcacatcgctcatgatatgcagcacatacgaaaacttccgtacgctccacttccccgtatcctttagcagtcccgcgtagtcgagcaggatgcggcgggctgcttgatagcctccttggatgggaacaccgcgtaggtataccgtgccgccattcttaatgaattccaacgctggttcttcagacggtgggaaaggttgaccttttcgaggctccatgaagctagtgaatccctctgttcccactttctgccaatcaatatcgtcgaaaagctcgatggagttcccgccccgctgcatttcagagggatttggcaccatgaagacgtaaagacccagcaccagtgctgcgtagaaaagagaaaacacagagtgaaacattgtatggtccgatgccctgcggttcgtcatggctcggtagatgtgtgccgcatgcaagcaagcccgtctggcagccggggtttgcgaccatgctgcaatgtcatcgagtgctttccgagcagggcctgggcctgaacgaccagctgccatgtcgaagatctgagtgtctgctgttagcgtcatgcacatgttgtgccacatgacggctgcgttggggttcagtcggtcgagcacgtcgccatatttgcttgtcagctggagctgaagagatggtagacatcttgcacgcccgtccatggcgtatgtgttgcacggggcgaaggggtagctggcacgattcgaaagaagtcgataataggcttctgaaagcctcgactgaaccattgctagcactgcatacatgcagaaatcatctaccgggctgtgaagtgttggaacgtcgacattctccgatggcatcagtattgtaggcatcaacctgactttgtcgctgtcgcttagctgcatccagcgagtggaggaagtagctcgaaagagcgcttcctcacacgggagtatcatttggacagagtcaggcacgatgatcggacttgtagacatgaatgatgagtaccaagagtcaagtagcaatagtccagttataagcctgtgatgtcagcagatgctcttctgcatgattgtgcaactaaccgtttcactgattcgaccttgctccaggctttccaccgcgtttcagtattaggaattgcatcgaataagttcgcgccaagcacctgcccttccctagctgcaaatagtccatgtcgctgcgcaatctattcatgcgtcagtcgtattctacgagatccatgagatggcataccgatatgagattgacatagagcatctggcactttacgaggtgctccttttcctatagaaatcagtataagccttcgtttcgcggtgatttacctacccctgtcatggcagccaggttcagaaacagaaaagcagctgcgaatgtagacactgtggacaaagaaccctcaacccccacagaacacttggacaaatctgctgtaacactctcgagcatcgactacgaaaaattagcaaggcacactgcaaacaggctttggtcataccgagaagttgttgacgacaaagtttaacgtgcctttggttcccaacaggaccatgccaatcagacacatggcatagagcaaggatggacgcgcatctttcgcagaaaatgttgggacatggataaacggcaccagtgggtggaagtcgcggaagaatagatctagtgccatatctaggatttccgcaggaggaaaattggagttgttgcgcggtggttgggtaaaaggtgacactgcggtactctcagacgaacgcatctgaaattgacctcggctctgactgaagattgtataaagacgctgcctgcattcttcatcgacgccatacctcgacccctgcatgtaacctgacgggccgctggaagagtgggttggcctaagagcaaagacattgtcctcttcgctgtaggctatatcgtgccataagctgttcatgagccgcccagtgttgttggatggagcaagccaatagcgctgaacacgggcaaaccgttcaattggaatactgcctccagagctcaagctcatgctaccaatagatggtcttgattctgaggaagcaacagctcctcctaacatgccgagattagaatttcccccaagatctattgatccttgctgtgagatcgagtctccctgcggttccagccagaattgcagtatgtcgttatgcaatggatcaagcatagtgcctctgtagcattgttggtccggaacaggcacatcattccagccaagatactcttgatgctcacttgccatgacttgattggctattggttcggtgcgaggctgatgagccgagacattggcaaggaagtccaaggaagtcgactgctgatcgagagccgcagaaaatgccgaattatgaggtgccgacgaaccatgctggagcgggcgagcactctccgcaccgataccaaggacgtagttctgagtatccgctgtcattgttgacgaccgatcagctggggcctgattggtcggtgtggcaggaagaccagcacctggtctaaccgccgcattggcagctggttggttgtgtcccctagcatggcgacttaggacatcactgcaattatgttagcaagatacagtgtgatttgttcaaggggtgaagatagtccacagcttaataccttcgtgagaaacgcttatgacagacattacattcatagggcttctctttagtatctactagacgtcagtaggatgcaacaatatgcaggtcggttgacttacgtgagcgttcgtggcgcttgaaatgctccgttttcttgaaacgtcgatcgcatatggtacactttcgcaataccatgatggtatttctttagatttggtatatgagatggctcaaatagtcaatctttggcgggacatgatgtgggcaatcctcaccttttcttagacgaagaaaaagaacagagatgtgaggggagagcatcgcaaacatatccggctacttgcagccccggcctgacttagccccgatcgggtaaggcgtgggtgccgaactgccggagccgtggggcagccatacggataccagattgatacacagtgcagccaatgagaggtacgcgattactgttagtcatcgcatctggaaaatcctggggtaatcgcccgtattgcactgtcagttggaaggcttcttatgaacgttgctaagggtccatgaagcatcttaatgagatactcttggtggaagagttatcttcaaagactctgtggtgtcaaagttcacattcagtacccccaagtagactcattcattggctcttcccaaacgacttttcaagttgatgaagcggttaagaactagtgaagttcttacggcatcactgcttgcctgcttcactggagtccttcatataggctagaacatccatcataaccaggaacttcagcagatcctctggcgcctgcgtggccttatataaagccttctgctgatcttccttccctcaagacctccttcagggtctcaaggacagatagccacaattctaacccaacatactgatatcatgatattttataacaatattggagttaaaaatactggaaaatgcaccatatgcaggtactccactagatgctttgccttcgcaaaacgcgagccctccatacactaagacaaacaactcgaaagacttcgactctattcccgagacaatacaccaatagagcaccggcagagtcaacaaatgttataaaaaaagcattgcaccaatgcgaagactcagacctcgcattacccatgaacaagtccttctgttccgtaccataatcccatctactataagcccatttcaactctgatgctgctaggttcggaccagatcttgcacggttcacagtatcttatctagctgtgcagaggtccagcagtattcaagcttagtaggaaaacgggaagtactgaaaggccttaaggcctgcgatatgggaaaagcccgctaaagagtttggatgagactagtctcaatgggtaggattgtactgcttatctagattattactacactataccctggaccccgaaatgagtgccgctctgctacgacctgctttactgcattccggatgtagaggggggcagagggaaacacgttagtatagtagtgacaaacggccaacttcagaataagtcagaaaatgcttccggggaagctcaaggcactgattgagtgcaaaataggccatagccctgctattaaaatgcaggaggctatccagatgattgcgtgggtcaagaagcacctttatcgtaataatgatgtcaacaactatatgtgagagactctcctacttagcttatattgatcttgtcatgatgtgtctaataggatgtcacaggcctattcttatgtcaaagatggccccgatcatacatcagctttgccgagtatgatgccgctaactgggtcaatcactcgaacaggtgtagcggagtgtctccactacatctgatgacaatgaaccgatatggtctgttttataccataggcgggacaaaaccccttaagctaagagggctaataatagtttgaaagtttgtaccaggtctgtatttggatttaccaaatggctgccgataaaggctttgaatgaccagcaacgcgtcgaaacggaggttcaaagaaaacactcccctttaagataaaagtctctataggaagccccaacctacaaatgtacatatcgagtcaatttttagcctcgctgctcttgaaataggaagaaccgtagtatactagcattatcgcttatgattgttccctggatatggcgacatttggggctattttagattgacttcagtcagcaccggagtacagctcattgccatcgagatcttttgagcaccatatgctggtcatattcagcacagggtgcagcccgcttctgcttctgcaagtgtactggccccgttggcgcttccaagcgtgatggaactctgacggcaaattcgtggacgccttcgcgcatatgagacaggaaaaatttggcgtaagcagccgccgtggcagcggcatattcctgccattgatcgttcttatgtgagtcggcataatcgcatattccccgaataacgaggcagtcggtggtggttctcatgactcctgccgcctccatctcaacacagatcacattttcctggcccaggcggtctcggtatcttgcatctcgaacgagttggttaccagatgcgatgaggccgtagaaaacgtttgggccgtcatgctgtcgagtcctcggccgtcgactgccgatgcagttgtcacaagttggttccgtctcaacgtgcacatcacctgggtcgaatagcatgtctttgcctgcgcctgggtatgagtattccggtttcattgaggcaatcaaactaagatcgtcaagaagcgggtttgaagcggactcgaaggaaatgaagccattagaccggattttcgtaatgactgctcgtagatagggcggtggttgttgcttctgtgctgtcatcttaaactcagagttttggatccatttccccatatcgccttggatcacgccggtaccgacgacaacatcaccaagacgtatatcgcgggctgccgaaggcactccgcctccgattccaaagaccagacagaacttgagacgcgggaaagttcggatcagatgagaagcaacattagtggcggaattcgtgccataatcatcgtgtggaaggccggcagcaaccacattgaatcctttcatccgtccgagacaatagcagttaggatcatttcggtctttttcgaggtcaggatggggtgaatcgaacaaagcgcggacggcaagaagttctttagacagtgcacacacaatgcctacctcgtagtcctcgtgagtaattccttcaggcggggaccttgacaaaggcaatcgcccgggaccattggcagtggcagaaggagccaagattgttccaagtcctgagtcgtggaagtcgtcgtctgagtcggaccccgaatcatcatctgaacacgacaagacatcttcttgttcagggaagccagtgtcattccaggtccatcgcaagtctctgttgtagccaaataatatcgcgccatggctccaaccgcttggtctaacggcattgtgcttcggtattcgcttcctaaagtgcgagggcaagacgacttgtgccagttcggaatgaactgtctgttccgggcatccaatgcatttgcaagctggaggaccattgcctaggcaattgcaccatatcaaattgcgggtcagccggaccgggctactatgtggatttccgaaccgatcgatgatgtttgcaagatcatacccactgactgcaaggtaggactttccttctggcattctgctccaatatgggcatagttggccgttatcaaccgggcgaaggatctcaccaaaccccgtcccaaacagcactgccgcacgaacatctctggttaactcaacccagctctttcctctagttcccaatttacaaaaccgaggatacaacgggtcttcctgggtcgccaaatccttgaaatcccacccttccagaattccccgggccattttgcgagacgctgcgccctctgtccccatgatctctgcttgatgatccatgatcttctcaagcatgctatacaaacgatcgaccctgtctttaatctgtacagtcggtaaagttgcctcatttggttcgctctgtttcgcgtggtacagtgtcagacataggttatcagggttcaacagaacctccattgcagagctgggagtgattgtgttctctgggactttgatatcggtaggagttaagtggaatgcaaagccgagtggaccagtcctgttgaaatggagcgaggcaataagaaggtgcaatagagcgcaggccccattcaccaaccaccctcgttttcctcccgcatcccacattaccacgtattgcctggcaatccacgacagcttttcaatgtactcgtcccgaattagtcgatacggtaagtctttgttgccatatatagctggatcaccccctgtaattaatctacctgccgcgataaaagtgttgtttaagctgcagcgagaggatggtggcctcaaccaggaccgattgattgaataactggcatccgccgttcctagtgacaagtcaggtggtgaaacccttttgttacaagcaataatcatgctatgacgtaccggcatagcattttgcgtctgaacaccaaccaaggatatgccggctggactccaaatcggccagtgtgatgtgtccgacatgagcctcaatgccatccagatacgaaatgcgatctccatgaacgttatatcgtaggtgccatatcatctgatcctgatcccgaatgtactttgtcgggatcaataagctagaaaatcctttgataaatagtttatcactaaagatgtccacttgctctgcttgggctagacccgccaagatattgagcgggatttcaaggccagtttgttctctggagcggtatggtattgggaagcccatcgccactgtcgggtaacggaacaagtcgtgccagcattgtcccagggaaggcggggaattcgcttgctcctgatcgtcaactttgaaatcaatagtgcatgatactcgtgtgagagttggtgtttgtgaagtcgggattgatgcttcttcaacgctagtgttgctgacgaatggtgtgcagtacgatatcctggagtcgtggggagagcaacggagaacagagcctagccaggcaagttgctctccaatctctgcaattgaaccctctatcccagtgacttcaacgagaaactccttttcatttgcccaagctgcgagctgtgtattatctgggagggtacctatagacatgataagcgcccgcgggtgccaatagggggaaagcgtacatctgtgttcatagccgcgctcatcaaccagtgcagcttcgactagctgaaggatattggcaccatatgaatgccatgtctgatggaggtattgcaagcaagtcattgcttgagcatcctgactagtccctgtaatcgtgattatcttcccaaggaagccttctttacttatatcgtactcctgctctgcgatgaaagatacgggatcccatttgagaaggtatactacctggtatactgttggctggtcatatcgactgactcttcgggatgacgggagggtcttcaggattcggtcgcgaatagcatcttgaacatttggctctgctgggtgcaactgaagtttcctccgaagacttctaagtagccattcatacactgggctgccggtgattaacttcctataggtcgcatattcagggagattctcatcgtcttcaatcagtatatcttcgtcactgtctgaattctctgccccgctgtcgaattgtgggatggcaagatcatcatctgcatcctctagattttgatcccagagatccatgaggtcgcctaattccattttggtgtcgtcttgtcttgacacatgggtttcagtctgatcttctaagtattttactctcaacccattcgcaatttcactgtcaggatactttatcagcatctacatgaaggcaatgaccaagtcttggggaaggacgaactctctatgtcgacggatgaataccatgatatccctgtgtatctgagtcgagccaaattgaccaaatctcatagcaaaagctttcagaagttgaggaagaatgccgtggattctttccggaagattttgggcatcttgatcatactggacttttctgaacaaatcattcaccaattcggaaatatagctctccttatccgaaggggaaatgccagacctagctgtgtagatagattcggtgtcttcgctatagtcttctgcttttctcgggctagctgccgccggaggtgaagagaatctctcctcaccagacactatgctttgaacatcgtgaacatattctgtacggtattcttctccgcgcagaaccttctggtgggtagtagaagcgtatccggaatctgttggcggtgcattgaaggtactttccttctgtcgactccatcccggggttggattgctgtatccacttgcatcggtgcttcttgcttggtttgacggggacatcgcacgaacggagaaggatgctacacgtgtatagggaatttaggagcgcattccagacagattttaagttgattcgaaaaatcttaccagtgtgtatttttttctctagggctggaaccaccaaaagaagctcctttgcataggccgctgccgcagctgctgcatatccttgccatgctgtgtttttgtgagagtcggcatagtcagatatgcctcgaatggccagacatggaaggttatccaggagacctgcggcttctagctcaaaacaaagtactcccagctcctgaccaattcggtctcgaagttggccgtttttcatcacctgaggtccagatgcaatggatccatagtgaataacaggctcttcgtgctctcgatcacgtcgtaaaattaatttggatcgatcgcaatccgcacacgaatcgaatccgatatgttcatattcaggttggaacagaaagtcctcttctggccgcgcgaacttttcagcggcggcaggaggaagtttctcctgcatatcggaaaggtaactggcgacgtgaccccccatacgccctgacaggttgtgattcacttggagggcagctagagcagttgacagaaactcagggacttgatgtgaagattcgtcccagctcaatactttacccaaatcgtacctgatcaaccctccagatttgcctatcggctggctcactacaacatcgcctaatcgaatgtctgctttgctgcttggtatgccaccaccgattccgactgaaagataaaagcggatggccggaaaactagaggatacctgcctctctagcgctacagatgtcgtagagccatacgtgccagctggtaaacaagcaatcacgacgttgtgatctccaacccttccaaggatatatgtattgggatcgtttggcggcataggcaacggtggatgtatttcatccaacatcagtttcgcaactgccatctcgataggcaagacgcatatccacccgacgttgtattcgtcgtggcgtggaggtactttgcggttctgatgggggtgagcgcgcatgtcgcgtttcgatggacttgtgggcatcatctgtacggcggatggctgccagaccacagagcacaagcggggagaagtatagtggatataaaaaggtagagataacagggaaggaggatgggctgtacaatgatcagacccttgacatagtaagaggctacaatggaagacgatagttttgctggccgcatattgttggaatgaccgtcactttgggcaagagtgggcggggttgagggcgaggctgagctttatcccgatcgatctgcctgagatttcccaaggctgaacgagacgagacatcttttttaaactgtataacatttttacatatacaatcaattattcttcatgggatggctctcgtccggattttcattgccccaaattcctccttcgcattgtctcccaatatctctgcgataccacttcgtaccgccgcttcccttctccgtccgggaagctggtcttgctgtctggcgccctgcgcgcgaaacgccagccagctgccggtagcgcctcccaagatgaagattcagagctgactgtctcagcattgcagatatacgcacaccttgatttacctaactaagctttctcgttgtcctcgagccatttccgccagagttttatcatcatagtacgcttccagctgcttcttcaatgcttctttatcagccttgacttgactgagaatctccttgatgtttgggtatgcggagaatttgtcctacatagatcatcagctcggcttcaaccatcgtgcggacctgaatacctacaggtaaagcatcccacactttgggatctggaccttgagctttgaatgtcccacaaccagtccgtgcatattcggtgaacagaaacgaccggctactttcgaccataatggtcatttgatctacaatgtcagttacctgttccaaatgatgtttaatgccattgtcttactctctaagatcctccgaggatcgttcacctggttgcgcatttcatgcacatagtcatcgctgaagttgccgtgtggcgtatggctgacctcgatactacctcctccgggcaggaattcttcagaacgtccgagtccgcttccatacagacacgcaagaaactcggtagccgagttgcggtgaaaatacggaggacggaacgtgttggacgccacatcccatcgtggtccaaaccatagaaagtcggctaatggcgttactgggtctttagacggggcagtcaatacgcaattcacagacgggtccgtgtggtcgatggatgttgcattttgagaggcgaatttggtcaggtcgtactgtagaggactgtcagtatcgtgtttgtctacatcacagaataatcgttgcataccttgtagggtatgacattcccatgccatgccactaaatcgaatgggctgtgaccctgctctatgacgctatattgaccatttgccttgttgacgatttcccagtcctcgtggaggttctcgtcaatatgggccacgggatgaagaaagtctcgtgggttcgctaatccatgaccacctaagggtcctaaatcaggtaactcccaacgagaaccccatatctcgacgatgtacccgcgggcaacattatgctcggggcccaagcggatagtgaagcgtactccgcggggtatgacacagacttcgccgggttgcaggaacagcatccccatctcggtctgtaagtcgagaattcccagctgagccacgatcagaaagtcgccgtccgcattacagtatgctcggtggtccatgtctgcgttgatcatgaagacatagagtgcaatgccttctcgcagatttgggtctccacttcctcccagagtgtgcaagccatctacaaagtcaagtctctcatcttctttgggcagatggaacggtgcccattcagcttgaccagcaaacgttgtcactttgggattaagtgtgaggaagcagttttcgatatctgatttgtgctcgcagtcgttcctgtagccatcttcacaacgtcagggacatttgcttgctttgaagaacgaatgggatccatactgtgtgcagctgccggtctcacccggtacatataagtgctaaagttggcatttctgggtgctgtgaaggccgagtacgtgaggccttcagtgtacagaccaaaccgcggctcttgtgggttgttttggccggctggcaaggtccctgggatgacttctgactgaaagcggttcccaaatccagccatgtattcgtatggatcattgtcgcgggtaggcttccgcgtcatggtgtctgtgtaatggaacactttcctcaggtctttgatgggccttcgctggttggctgtggatgctggcatgatggataaactatgtgatatccggaaagtctatggagttcaaacaagggatggatggattaagacatgtgtaattgagagtgtatggatataacagcataagacgcccttaagtataagatggcaagaacagctgattaacataattgagacatacgtcaatgcataacctgagggttggataggcccctcatgatcccatgatagctgtcgacgtctagaaagatggagtatgtggagcaagacagcatagtcggggctagctgatgatgtgcgagtatccatggcgcatgagaaaagacccacatgggtaacagcgaggtggaagcagttcgaaggagatctgaaagtgtaccaggtttcatagataacccaagagtactgactatcctcactgaccccttccccacagtccactccccccaatgcggggctaccggctccgcgaatgtggagccattcctcgatggcatctggggttatgggacactgccatataagcttatttgaacttggcagagatggggcatagccataggtatctatcatttagttcgtattactatgctaagagtatggcccagggaggaatgcatatatcttgaatccctaatcgacagcaagaacatcttccaccattctcgtcgacgcacccaagtaattgacagggtcatacagctggctcagacgctcttcgctcatttttgaggtcacttcagtctttttcatcaagcactcaagcagtgactggttcgcctcgatgctctcccggcaagcctcgtagacggtgtcatgcgcctgttgccgtcccacatgtggtgccagccccatcatcactgcctctgccacaatcaatcccttagtggagtgaagattctctagcatcttctggctgtggacacacaagccagatagagcaaattgtgtctgggatagcgctccgaccgcaatgacaaagctttccgggatagctacccactctaggtgccaaggacctgaggcacgctcaaagtcagcgaccatgccgtcaagaaccagcccagcgtttgatcgaaggattttcgatgccgccaaaataacttcgctcgatatgggattgcgcttctggggcatggtagaggaggcaccgcggtgcggcacaaatggctcagatacctcgcccagctcgttggaggacatgatgatgatgtctagggctagtttgcccattgatccacccatcaacgccaggaaattagttatctccgctattccgtcccgagcaacatgccaggtgatgggaggatccgtaagacccaactcctctgccaaagctttgcgcactcgtagtccatcatccccagtccccaaggatgccattgatccagctgctccaccaaactgaaccaacaagcagcggtccttcagctgctctaggcgctccagatgacgctgaaaaccggatagccataccgcacacttgtacccaaaggtaacaggaagggcatgttgaaggtgcgtacggccagccattggtgtgtccttgtacttgacagatagtccacgcagcgtactgataacctttttgaggtggtgctcaacaatatctaaaccctctttcatttgcagcacactcgcaaggtccatgatatcctgggttgttgccccccaatgcacgtactttccagcctcgtctccgcatattgcagatagctgacgaaccaaaggaagaatagggtaaccgacaatttctgtctcatatcggagccgttccatgtccagcttcgattcgcggagcttccgagttaccatctcaccgatctgtgatgggatcacatcacagcgtgattgcgctcttgcgagggcggcttcagcgtccatacaccgcttgatgtacgcttcatcatcaaatactttgcgaatttcttcagttccgaataatgtccggaagattcccgagtcaattgcactgacggacccgatgtatcttcgagatacaataggggagatggagatccgcggacgagtgatacgacataactgcgcaaatgaggatgctgacatggtaaggggagatgtgaagtgtgtaaggtcacaagctaaagtcagttaatgctgtatatgatatccgcgttgagtactggagagcaagccgtttaagctcggcttcggaatgagccatgggtgtatgttaatagagcggaggtgcctggaattgccgacagatgcatgggggcagccccgcaagaaatgtggggttccgcgtatgccttcatcatgccttcaatccctcgacttctgtgaacgttacatgtggtacagcacaaggtctgataggaaaatcatctaaaattactatgcgtgatatggaaattcagtggttaccactcctcccaggatatcagaaacaggaccgtttgcgtgccatcccacaatggacaaaacacatagacacacgggtccgggaccaaccgtagtctatgacgatagaaatttagtgagcactgatgtagtacattgcttgcacagcttgataatagcaacgttatgtgtgccgtgaatctcacgctgctattataatgtgcaacagccaactgaatgcggcttcttatcaggatgtcatagattgtcgcgcgaaatcacatgtgcggggccataaacatttgacgacgaaacaacctggtccattattgtcttttctcgagctacgaagtcaactgaatcccaatttcaaccacgacgaaacctcagatataccaattgtcggtggcggccgcatttgacaggttgagcccacaggaaaagctctatgctcatcatatggcgaggtactacacgtctccattcgcgaacgcgcagcaatgatttctaacgtcttgtatttaaggactgcctaggatggcacgagaattatcctccgtcaagtctcaccagaagctaatggcattttcgacttcattatggacctctacaatacctgtgaagggaactgggaacaacttgctaccaaaactggagtcggcattctgttgttagacgagttcctagactatgctgctagatttttatccaatatcggcaattacttcgtgagaatctgcctgtttactggttgaattcttctcatttctctagggatccggtgaccagaaattcacacctgatatatctggagaagcccttaattttctagcatcagtatcttcatcggcgagtaagatacttgagcagatcaagcctgacgacagtaagtcacattgtcgaggtgacaggagctaagacagtgaattacagtcgcctacaacatgtatcttcagctgggtgttgatgggcttcggggcctcgagaattacgatcctacgaccaaagtaaaaaataagagtgtttgaaggtattgcttaccgatcgacagatattggaacaagcacatagtcgagtaagtctatagctgacttgtatctaggcacactatgccatctttcgacatctctttcgcgacagtggcgacctctatacagttacaaaggatgtggagaagaatagcttgacggtcaaagttgaccgatcgcgcgtaatctctcatggcaaaccatcactgggtcgcatgctcctaaaacttcatatctatcgttgcactgctgacgtctccaactgccgccgcttctatgagaatctatcaattgttgacgacgaagctctgaaatggagagatattcttgtctccaaaaaagaccctcctttggtgtttagccaagcaaacacctacctcgtcggtgatgacgtgaagataaaggagtatgaacccacagctcagggagttgtgcaaagctgggctgaaagaagcatcgaataacactttgcactcagcatacaacacaaccaaaaacaaatgcataagaaaaactcgaaacatggtaaattctactaataaacctagataatacgccctattgcataattattcagacagactgcgaaatagcagtggtccggctctctccttatagcaataatgcacaagagcgccaaaactgacaaggcataaaaccactattaatagtcattgcgcatattggcatgtctacaagagactatccgtaaccatcgtgttacttacagccactagttccgaacctaaacaaagattacccagatgtattgtagtacatgacttatcgtttcgcagattgcaaagaatgacaatccaaacatcttgcatcgttatactgatatctgtgggatattccgatccgctgcaaatgccctaggttccggcctacgcagcattggggacattccacaaagaccagatatttcagtatgcgcctacgcatataaaggagtataataatcctgtcgtctagtttgcaagatcataaatctaatcaagtcctttgttcgtttctatagagttagcttacctctctcagaattactgaagaggaactctatctactcataacggacaaaattgaatcctaaccaagtctaaatcatgccgtactacgttcaccttcaagagcacgtagtcgacgggatgctggaacccatcatgcgaaagtactacctgatgactgctgcaaatgccactgcggccgagaaatttcttgtcggactgcagaaatatgcccggacaccgaacacgcagatgtataatgctaaggcggtgaccttggagtggtggaactgtaaagtcagttcagccggtaccatccggtggatctacaacgaaatgattgccgaaaggcctgagaattacaactatgtgcaagaattgaccgactgctgtgatacaatccttatctccgatttggaagcagtgaattggccaattcttccagtcaatcaggaaacttcacaagtaaggacgatttttgatcaccactttaatcggttttgatggagtctttatcttggtggccaagaatggtttagggggatatggtcacgtggttgtcggtttcccgattctcttagcggtagcatgtatcgagaatgaccagaatgcgaaataattatgcttttgatcttgagtggccagagtagtccatctttaccctcataatgtagaacccaaaaaatattgttgtgaagcagggaatgtgctaccccagatcgagaccccacaagatctcccgagtcggagggaaagtcggcagagtcaaggctggccaggaacatcggcgagttcacccgatttgtcttgccgatgccagtcccgctgtcggaatcgtaaaatacgccgtcgttgtgacgggatctcccaattgggcgattatctaatcaatcatcgccgccgggggaccctgaattaactgactgacaagcagaaagtaactacgaaacaatccgtgcattgggggataccggtggattcggagcacgtttgacaaggccattccggtccgatcgcgtgccttgatagcgcttttgaggggaagacccggggtgagttcaacagggggcgcgcggacaccccgcaggcagaacgtttctcccccccacaggcgtacgaggcaatacgaccccagcggtgagacagtggggtcggcttcggaaggcggcaaagcgatgctggaagtcggcggcggataatcgcttttgtcggctgcgccatcatgctcactagccgaacggcgagctacgcgatgctgcagagccggtctggcctaggctgagcttctttttatcgctggccttgtccgtccttctctctttctcttctttctttctttccccaggttttgactccctccgcagatctcaattcttttgtcaaggctggtcgacaaccatgtcgcggcctgttcctgcggtgttccgccccatctggcggcggaatttctccgtctcaactgccaagcgcgcaatcgataaactatgcccgtccgctcaggaagcgatcaaggatatgaagggttcttcgacccttcttgtcggtggtttcggtttcgctggtgtccctactaccttgattgatgccgtgcgtgaccgcccggacatcaaggatctgactgtcgtctccaacaatgctggtatgcccggtgttggtctcggtaggtctactccattgcaattgaacgactactcagttcgtaatcggtctaacggataatgataataggccagctgctggaaagcaagcagatcagcaagatgattgcctcttttatcggtgaaaacaaggtcttcgagaaaatgtatctcactggtgacctctctctggaattgaccccccagggtaccattgcggaaaagtgtgccgctggtgccgctggtgtccctgccttctatacccctgctgcttacggaacaattggtatgcttacttcaatggctattattcaatccctgaagtcaactaacagttaacgctgaaaagtgcaatctggtgaactccccgtgcgttacaacaaggacggtagcgtcgctatcaagaacgcccccaaggaagaacgcgaattcaacggaaagaaatacatcctggaagaatcgattttcggtgactacgccctggttaaggtccacaaggccgacaagctgggtaactgccagttccgcaagtccatgaacaacttcaacgaggccatggccaagaacgccaagtacaccatcgtcgaggccgatcacatcgtcgaagttggcgagattgaccccgagagtatccacctccagggcatctacgtcaacaaggtcatccagagcaccggcgagaagaagatcgagaagctcactttcgccaaggaccccaacgagatgctccaggctggtcagtcaccaaagtcaagtcccaggttttatagcgcagatccgctaacaatgtcgatgttataggttccggtgatgccactgcccgtcgtgaacgtatcgtcaagcgtgccgccaaggaattcaaggacggcatgtacgtcaaccttggtatcggtatgcccctgattgctccttcctacgtagaggagggtgtggaggtcgtcctccaggccgagaacggtatcctgggtctgggtggctaccccaagcccggtgaggaggaccccgacttgatcaaccccggcaaggagaccgtcaccctgggtcgcggtgcttctgttttcggttcccacgagagtttcggtatgatccgctctggccgcattgacctgaccatgcttggtgctctccaggtcagccagtacggaggtaagctcatttcccttcacaccacaaagttataatgaacaatactaatatctaatcttcagatctcgccaacttcatgcttcccggtaaggtcaagggtatgggtggagccatggacctcgtttccaaccccgagaagaccaaggtcgtcgtcaccatggtaagtcacaatcctttacttacatccacaacgtcgaatgtccattaacaatgaaacaggaacacaccgacaagaagggcaaccccaagattctccccgagtgcagcttccccctgaccggcccccgctgcgtgtggaagatcatcactgatctggccgtctttgaagtcagccccaccgagggtctgactcttgccgagtacgccgagggcgtgaccgtcgaggagatccgcagcaagactgctgctcctttcaaggtttctgctgatctgaagcctatgctgtaaatttattataccacttttgtgcttcgtgcttcacacatcttgcatggttgtttatagattgtgattgttgtatataacgttgatgttgatgactggttggttggataaaggaaattcaaaactagattcatgatatacacactactcattccttaaacaaaaacctcatacacataatacacgtatacaccatcaatacaatagataattgatggagaaagagaaaagagaaagaagagagatcaatgtcccgtcttcgacctattaaccgaccccgtcgtccccttatgtgtcccctcagcaggattcggcgcagtaccggtattcatcctcctcgcggcagcgacattcggtgcgttgtaggcgatattaccacttctctctttttgttcttcgtcctcttcttcctcctgttgggcccatgcattctcgtagtcgtcgacggggaggtcgtcgcggacagcgccgtggactttctttggttggaggggtggggaggcgattggtttggagggcattttgttgatgcttctcgacggaagggggaattattgggtttgttgtttggtggttggttaatttgggggtgatgcttcgtttgtaaggtatggaaggcaagtgagataagattgaagatgggatggaatggaacgaggaagaaaaagagggtagtttaaataaccaagtacatcagtagtactgaataacgtaggttcgaagaagcgttatgatgagatcatgagctatagagtatcatgttgtatggtaagatcaaaattcaatttgtacggatccacaaatatgcagtcttgttaacatgattgagtgagtgatataatggttctttgtatgatcggaggcgaatatacttcatgctatatgatgggatggtgatggcgtcatggcgatgtaagatgtgcatggtttgaggtactctgtaggatccgggaattgagctaatatgtagagcataattctacaggttaacgatcaactctgaagtgtttggctggaagacttttgatggaaagaatgctgcggctggtatgggtttctgtttggtagacggagcggatgggtgcataccttcccgattagggaaacatagcacgaggttcttggctcacttttgtaatgcggtattataatcgaatgcttgtggcgcacagcttgaagatttggctcatgatatagtactcgtttggtcattgtagagaaatagcatacgattaggccattgtacatacagcatatagttcctcctttagcaaagtagactcaaggattcctccatgataaaataagcaattatttgtaagtaaaccacgcgggagatataacgttgcggcgtcccagcgaccgaccaagtttataatcaataaaatagtacttgcatgccccatatatcaattgtctaatggactaccaaagaaattgttgttgaaagctcacagaaggtgcacctcgccacaaactcggtttctgcataccagggaactcatggaccgcttctgctcgagcgcgctgatactgtattgcttcgaaaacaggatccatccgtggacgattctctctggcctcaccatcgaatccactgccatatgcaactttggccggcgatgaaccggcatctatcgggctgtttggtatctcgatctgatgtatccgtggtagcgtaggcatgtcgcgatagccttgaaactcaggcatctggtcttttggagatacagtctccggttggtattcagactgtgaggcagaaggacgcttaacggcttcaggtcccgaagagtgtcgtgtcgaaccatctccatcattgctcaaacaatcattctgccagtcacggatgtcctggacagtgtgtagaggaaatctcttccaatagtcggtgcctcgctttccgaggcgggaagatgatgatgagtacgtttgtggcggactgccgctattcctatgcctgcttgaacgatcttggcgtccctgaaccgaagcagagagctgagaatctgggatttgggcgagtagattcagaagcagactttctgtttcatggagacgatgctccaaggcttctatataaccttttgccgggccactaagaggtataaggttgatacacttcaaatttcagcagttggcgtagcttaccgtttcaactgttcgggccagtcgcacggccgattgtgctggtcgcattgagtacaaattggccttgcaaattggattgcatgagtaaaagtctgaagtaagaacgagggacctcctacttacttattcccactgcactagaaacacatagactgttagatgggaagaatcacgaggatcaggtataatctcaccttctgtttccgaaaccggcaggaattacaagccactgtaatgcgagacactttgttcggctttgcaggcgccattgttgaccggttaatagtttgaacgaggagtgacgcagtaaagtatgcagtagattgaccggctccgctcggggatcaacgtagtatcggccagagggcaggattaagagggcgctcgaggaaaagcgttatggagcagcggattgccgccatagaaaggctaagcaactcgggtcgatcgtggctgccgcttcgggataagcgcagggacggtggagacctcttacggctgaacgcttagccgacgcgtggcttcctctgtgagcagtgcctgtgcctgtccttgagggatcaacaatcaccctgctctgcacaccctattatctactcagcatctatacattatacgcgttggtggttgtggcatccatagtagccagtccatcgcagaacggcatatggagaccaggctaggaagccggcctgtgcggtagccactgattcggtatagtcttgattatataagcacatcagtatccatcactgcctccatatcatactagctccatttgcataagccaacgaaaataaactactcgctaatagtgtatatcaaaacgtgaaattacgaggcatgaatacagtcgcgtgcggcgaaactatggcgacatgctcaggacaaaccttcagcctgagtaatagccggagcggggaagtatatagagcatcaagatgcggggatcaaacgagtattgatagtcagagattcgttactcactccagctcctactatcgtgttttgggcttgcaaagacacaatgactacagagacaactacttatcgtatcgcatccatcccgggtgacggcattggcgaggaagtagtgcgagcgaccattgaagtgattaacaagctcgctcagacgttaaatacattcaacattgaattcacgcatctcccatggggcactgaatactacaagcaacatggtcggtatgtatctgaaggttacttggacactctgcgacaattcgacgcaggcttgtttggctctgtgggacatccaggtatgaatattcgatcctgacacgacaaacagtcacactaactaatcctagacgtacccgatcatgtctccttatggggcctgctattagcacttcgcagtccattgcaactatatgccaacgtccgtcctgtgcgcacttttcccggaaccaagtcacctctgaccacagctgtgaacggcattgattgggtccttgtgcgagagaattccgagggggagtattgtggccaaggcggacgcagccacacgggtcagccatgggaagctgcgacagaggtggcgatcttcacacgagttggtgtcgaaagaattatgcgctttgcatttgaaacagcgcgctccagaccgcgtcgccacctgaccgtcgtcaccaaaagtaacgccatgcgccatggaatggtcctttgggacgaggtcgctgaggaggttgcgaaagacttcccggacgtcacctgggacaagatgttggtggacgccatgaccctccgcatgatttcgaaaccggagtcgttggatactattgtgggaaccaatctgcatatggacattctgtctgacctggcagctggcttggctggttccatcggcgtggcaccatccagcaaccttgaccctacccgcaagaatccctcgctgttcgagccggtccatggaagcgcttttgatatcatgggaaagggcgtggccaacccggtggccaccttctggtccgctgcagagatgctagcttggttgggtgagaaagatgctgccaagaagttgatggattgtgtcgagaaggtgtgcgctgctgggattttgacaccggatctcgggggctcggcgaatactcagggagttgtggatgcagtttgcaaagaaattgaacagcagttggcttcatcgtaagcaaacatacggcaactggcgtttttggcttgacattttgcccgggtttcttgtcctgtgtgacgatactgggaaagacgtggtgtagatgcgattattttcctgtcaagcatagcatcgagaaggtttcatagtcagactgcaatgtcctctagtcttgcttcataagttctgataggaatcatatcctcgagaaacagccttgtttcataataagctacagctagataactcctgcctttccctgcttctagtgtgcggtcacctccagttagtagcaccaaggtcatgtcacagtcatatccaaacacgatacacaggtctatcttccaatctggtacatatcctctaggcatttatgccgtggaacagggtgctcacttcttgccaataatttcagcaagcagtataggctggtcagcattagacatccacatcataagagtcaactcaccctctgacggttgagagaccagaagtgggtcatacgcctttatgatagcaggccctcctagagaaaatcaatatccagggattgatattcatagcatcagaaatgttgatggtgtgtggtgccccatctgtgctccatccatgactaagcaggcacccggatttgcgtctcgcagttcaatccgagatccttgacttcaacgccaacttctcttccatgctctctccttatccgcgacggcagcatcatgatcccacgagaatggagcctccggaccttaccaatggcccatccgagattggttccctgactgcgcattccaaggatgagagccaatttgtcggtagctccagtggcgtctacttcatcaataccgtccgacgggctttctccgaaagtctagatccgagtggttcatcgcctgctcaagacttcccccagcccgaggataccttggtaggcagtgatgcctcgcataagacgtccccggttgcactgcaggatgaccagtttccgtgccgatgggcatatgattccgcagtggcagcggtcttggggaacgctcccccgcttgatacagctcgggaactcatgatggtgtacttcaaagtttggcatcctttgttccctttcctacatggccctacttttttacaggccatggagggactctattcagaagatcgccaggagccagcccgtaacgaagcgatggccgatcaccgacatgtttgctggacaacaatcttccagtgtatcttcaatttggccaattctgtccatccggagatcaatctcccgctggagtctcggattgaatcgcccagcagcatgcattctctccttgggacgctgactagtaaacatgatatgttgtccttgcaggcacttcttgcttgccaactatatctgcttgcaaggatgtccctccggacagcctccaccgtaggtggctgcatgctgcgttccatgctgcacgctggtctccatcgctgtccgtaccgatacaaggagctcacaacccacgacagacagttgcgcaagaggatcttttggtgtgcctacgctattgatcggtacctaagccaggcacttgggctgcccctcggtgtgcaagactcggatatcgacgtctgttcacccaatgcgcctgaaatccatataccaggaatgtgcaatagatcccatttcgtccggtctacgtcgtatgctgagcaaagggaacaccgctcccagctcacaagcaaccaacaccttgaaaacacctcaccgcatgccttctcagcccacagcagctcctcagccgaagaagcccagcaaaaccgccgcgaacttgcctttgcaagctacgtcgagtccggcaccctgacaggacgagccctcgagctcttccacaaatctattactgtgcgctccgtcccacgtagctccgttctattcctcatcacagacgtccataaatggtggaacaatctctccatcgagacacttcaaggccaacaacaacaaccacaaccacaacagtcatccaccgaccaacccccatcatcctccccagcagcaacaaccaccgccgcattcaacttcgcccccttcttcactgttctttaccaacatctcatcctcctcatcaaccgcccctccctctccctcagcccttctacccccgaattctgctccggacttcaaacttgcatcaatgccgcaagggagatcatctccgcgttaacgacgcaacaagaaagcggtcaatcattcttctggcccggtttcctctctgctgcctggatgtcaggtctcgtccttgcatttgcatgccaactccgccaatacgtcctgtccaagggagctcagtacgttaccctcccccgatcttcttcctgcacaattgtctcacaaaacccccctaacctgcatgcaccccacacccgcccaacctacctaccaacccaccccactaacaaccgtaaaccagagaaattaccaaatgtctcacaattctgcacaccatgtccacgcaatgggacgcagccaagcactgccacagggcgctttcccttctatctcggactatccatgaaaataccaccaccgcaggtgatccatcatcatcacctaacaaacgacgaaaagtagtagtagatcctcaccagactaccttcttcactcccattaactcgctatccacgaccaacttgaatgaagaatatgcaagaggacgggcaggaaggagaacccctgctactgctactgttgcaacaacatctggcctgcatgaacctactaacactagtagccatgtacacttgtctcacgaagatcgtttgttctctgcggagggggttagtactacgaatgataataatggagatgcggtgggagagtttgatttcgggattgtggatctgctggaagggagtaactttgatgatctggcggatatgtttgggcagcagtatccttctttttgaggggtcgttgagtatactacaacatgatgttttgagtatatatgggcaggggaggatgtatgatagtggatattatgaggtacaggaaccgtgtaaatacaaatagttacgtctacaaaatagaaacggaggtccacatattacgtagaatacgtgagaaagatcccgtgaggaagtcataagtctatattacactcgtgtcatatcgtaggatacgaggtaggtagtatggcggggataggaagagaaaagacgtcacaacttcctccctctcgtgacatgaaataagagaaccatggcatccgaacaacttttcatctccgttcccagaatcggcccgccttcctttgcccagcgccctcttgtatcacgtgcactataacattgacagggaaagaaccctcaaagcgcccttcaagaggaagtaggagaaaggaaaagagacgggaaatccggtcaaggtgatgtcgctcgctaatcatggaccgataacaccactaacaaagaacttttgggaaccgagggatatcaggaccaggagggaaagagaagagaggtgttaaaaaaaaaaaaaaaaaaaaaaagtggaaaggttagggggtgggtaaaatggaaaggaggtgtcggataggaggaaaataagaggtgaaatcgttaattcgagtaaaagaggtaaaagaggtcatcaaaaataggtgggagtcaaaaaggtccgacatggcagactgctgaaatcaaaccaccggtgcaggagatgagacgcggatttacgccttgttctcctcggtcgaggcctccttctccgcctcgggcttggcagcctcagcggcaggagcctcggactcggtgcccttgttcttcatgtactcatcgtaaacgctaagggcctcatcgaccttggcgcgcagggcttcctcgtcctcaagcctacaataatatattagcaacaagaactgacagtcaaatggagcagaagggaaaaaaactcacaggctgagcaactcggtgttgtccatctccagaagcataccagtgatcttaccagccagctcaggctgctgggcctggatcttggggtagagagcctcgccgagcatctgcttctgctgggccgggggagcggcacccagagtctgagcgttaacaccaccagcggcaccctcctgaggaccagcgggcgcagcagcgttctgtccgcgaccaccctggccagggcgcatctgaccctgctgaacaggagcaccacggccctgaccgtaaccgggaccgccacgcataccctgacccatgggcattccggggacctgaccacggccaccagcgccgcgtccgaactgcacctgagccatctgggggtatcccatgccgttagggatgccaccagggccctgcatgcccatggggataccctgagcaaagttggggggaatctgctggttggggcccatgccgcgaccaccctgctggccggggaagggaccggggtactggccggggcgtccaccggggatacccatcaccataccgggctgaggggggaaggccatgccgcgctgaccaccagggatgaagccctgctggccggggccgtagaagacagcgggctgcatgtaaggctggggcataccagcggcagcggcggcctgctgctgtctgatggtgttgcgagcctggatgctagcctcgagctggctgcggcggacatccttgcgctgggcaagggcaacgtagaggggcttgccgttgaccattctctggttcatctcggtaacggccttggaagcctcatcggggctgctgaagcagacgaaaccgaaacccttgctcttaccgaagggcttcttgtcagacttcttggcctccttgtccttctcctcggaggactcgctgggcttctcctcggccttctcagccttctcagcctcaggggtggcctccttgtcgttctccttgtcagcctccttctccttaccagcagagtcgggagactggtcgcgctcgacgttggtgtcgcgcataaccttggcagaggtgatggtgccgtaaggtccgaagagctcacggagcttctcatcatcaatgtcatcggtcaggttcttcacgtagaggttgacaccctggtacttggaagccttctccaggcgggcagcctcgtactgcttgcgcagctcctcctcacgctcgtgcttcttctgggcacgaccgacgtagagcttctggctgcggatctccttgtcgttcatctcctcgacggcggcctgcgcgctctcgtgggtagagaagttgacaaaaccgaagccacggctcttgccctcctggtcacggctgagggtggcggaggtgatctcaccgaacttctcgaacatcttgcggaactcatcgtcatcgatctcagagtcgaggttcttgatgtagacgttggtgaagttggccttcatctcctcgaacttgctctggcggtccttcttggagatgtggtggccgacgaagaccttcttgtcgttcaacagcatgccgttgacgtgcttgatggcgttgttggcagcctcagcagtctcgtagtggacgaaaccgtatcccttggagttgccgaactcatcctgagcgaccttgcagctgaggatgttgccgaaggcagcgaaggtgtcgtggagagccttgttgtcaatggcgctgtccaggttcttgatgaagacgttgccctggccagtcttgcggagagcggggtcacgctgggaccacatgatacggcagggcttgcccttgatcagagtgtagttgaggtcttccagagcacgctcaccatcggcggtgttgttgtagttaacgtaggcgtatccaagagagcgtctggtgacggcatcacggcagacacggatggaggcaacctggccgatggaagagaagagctcgtagagcatggcctcggtcaccgaggggtcgagttcaccgacatagagggaagccgagtgaggctggttggcagcgggagccggagtagagttctcaacggcagtgacctcgggggtggtggcactgggggcagcagcagcaggagcagggctggcctcagcggcgccgttgacgttctcggcggcgggggtggtagagacgtcggcagacatttttgtggtgttactgttggacaagaaggaaaaaaagatgtcagcacagtgttcgatgatgaagatacgagagagtgtgtgaggagggggagggggacaagctgtaacaggcgaccaactggaggattggaacaaagctctcaagcaacaatgaacgagaacaatcgcaagacaatgaagcagagacaaatgatgacagcgggagatgagcaaggggataagataaaacacagaggcagtgtgggcttgtctgatggagacggggatttccttcccaggcggtcacactatcaccgtgatagagccaggcaagggaaggtcgacagagagaggaggggatggtggaggagtaatgatgatccacgcaacaaaagtacaacctcaatttagacaccgagaaagaccgtcaagacaacggctgctgatatgaaaggaggatgggaaagtgaagcgaaaagacgatcacgaggaatgaagaatatgcggttgagggaaaacttccagatgcacgcacaaaacacgcgcgcccacacacacacacaccgcacaacttttcggaggcagtgggaaaaagtcacagtagggccccaacacggaacaacgaaattctgatggacgaaggggaggggataattactttggtttttttgttcttttttcccgtttttttaggaggtttttttcgaggagttttcgaaaaagggagatatgaaaaaggaggaagaagagaaaaggatgctggggatagacagcagagaagggttttatggatttttttggggaaggaagaaagaaggaagaagagcggatggaggaggaagagaagagacggcgaagaatgaaaatcgccccgaaaaagaccttcttttctgactgtgactgacggactgaaattctgcctgccttttttttttttttttatctgaaaaaaactcaaaacgataaaattttcttttgctgtctttgggtcggcaggtggcgctaaacctaaatagtctatggtcctcgccgcttgaacggtgcttcacggaaatggtgggttccttttcgggctttaaactcgagcggcaaaaaaaaaaaaaaggaaaaaaaccaaactaacacattgaaggatctttaagttacatgtgcctcaggcattaaaacgagactaggccaccatcaggcagtcaatcaataatatcgccatcatccatccatgtcattctttcaccatccattcatggtttcattgacacgggagcttggaacagcagccacagtgtgtctgcagaggtcgggccttcaatcaacaaagaatccctaacaaagcgaaccagtctcgaaacaagtattgatgaaagctatctatctggttggtcgaagctacccctcgcaatatgaacaaagccccgagacgaaagcaagtgtagtagataccaggactcgagctagaaatagcactcatcctcggaaaaatagacacacaatgaaacgcgtaatcaacaaccacagcaacgaccacagaaaaaacaggacacatggatcaccaggacgcctcagctatgctactcatgattattcactaaatgcgctgcatgtataattgcatcgaccgatccgggtcatgcaaaatctccaccctcttcagctcagatcaaatccagctccggaattgaccgcatacaaaagcttctcccggaggatattggcgttggtataccggggcagcttgagaagattcacgcaggtgcttgtactggggagtcgttcttgatcctcgctcgagtctcgaatgctgaatcgaggattgagatggctgaaacccaataaaggagcccgcggggtcgatgtcacaaatcgaagcactttctgtctttcttcgttggacatcttctccatcacttcccagaacagcttgacggtgggatgctcttctttgtcgtccccgatcgtgtatactcctccgtaaagcgtgttgcgtcgcaagtcggctacatcaatgtctcctgaatcgccactcacaagcgtctgcagctccgtctggttgaacatcgacagccacgacggctggatgatttgtcccaggccctggaggaaagcgttggtctgcagagcaggctggacttgaagccggtagcgagcaatgtaagagatataaaccaaccggttctgattcgtaacaggtatgtctgacccatggcttttcaagtctcgggtagtcgtacggttacccccgtcgggaagcggtatcgtgtcggtgacggtgaagttcaacgagaagtcctccacatcgcccggatagttcttcagttgcaactgcagcatcggttagcagctggcacacgatttcaagaacaccactgttcacttaccaatccttggtatagcccctggtccagatccttcagatcgttcaggttggcgcggtaggctgtctcgcgctgggccgaacccgtgccgcccgtcaaagcccacttcagcaggaagaacggggcaaagttgacatccaccaagatgccctcatatagacactttccaatgatacggcctaggaattcatagcgcctaagtagatcacggacgttctcgttccattctgcagtgttctcgacaaagccgagctgtctcagaagctctcgtcgctgctcaaccgcagccgggttcggatagagcaggtgctgatcgttctcttcaaatagatttagatcacttgtcgatttaaaggcttcactagtcacgctcgtgaggaactctttggtcacaccaccaccatctataccagcttcggttgtattaaacttgtcaatgaacgtgatctgaatgggctccttcaacccatcccccaactcgtagaactcatcgaatgcgtctttgaagatgctctcgcgcctgatattggcatggtgccggctcagtatatcttgcacagcaggacgcccatcgatcagacggcccattgaggcttgcgccacagacatgcgccaggcatctgggtcgatatacccctgtcttcgacgcatttgatcccgatagatgaattcgcggaagatctggactctcgtcgggaaaggtatgaagaaaggcatgttgcggagaatctccatcctcggggccacagcctccagctgcttccggcgagcagcctgttgttggcgacgtctcagtgcctcgatgcgacgtgtcagttgagcgcggccggtaccgatcaggcctggggaaggctcgaagtaggcatcgctcattagatcatcctgttcctcctcttcatcctcatcttgcagctggtgcctattctcctcttctgctacaacggcagggatgaagccttccatgtcgaagcggcttgtcatcaaccaatgcccgtctggaaggaatttccgccttgaatcacgctcatggatcatccgcaagaggccagtgactagacccttgaagtagtccagcggaattcccgtgacgccggggaggcctttctctttgttcttcatttcaatgtccctcacgcttgcaatagcgtccggtggcgctgcagatgagctaaagtagcttcgaatgcccccagtgtcttgagtcgcttctttttcgctcagatctgctgagttccaatacaatgtgaaacctaggttcttgagaaatattgtcatatctttgatgtctttcagtggaagggcgctctccttggtccaggaaactcttgtgttcgaggaggcggtgaaagaagactcgctggaaaagaactcctcgtcatccataactttcaaaacgaaagtatagagctcgaggaatagaagtatgatcgtccattcttcatccctttcgacttgggatatctccggggaccgagtaccctgcgattcctcggccggtttcagcagaggcaacactttcgtcgaatcttgactaatggcagcaaatattctgctagcctttgatgcttgccaaaagtatttgatcgcgggtattcttgagccttcctggcctgtcagctggtcactcgaagtcgccgatcccaaatacaaccacatccgaatgtcatcaccccggcgagggaatactctcagcagcgtcagagcgtatgttgcaagaatcttggcttctttagatgcatccgattgagcgtttgccagctcaccctgagagagatgtgtagtgtgtagctgagaaagaagccccgtaatattactctgattcacaaggctaactagctgctccttgatgaacgggtgcagtggcgtttgttcaggcgcctcgtcgtagtcattagactcttccgactctaagcgccgagatatatgcacggcggtagagttcagcagctccgataccaccttcacaaaacctggttctggagccggacgacctgtctggcctcccagagcgcaacggtgaaagaatataaaataagcaagcagccaaagacgggcatctacatcttctgcgctcttaggtcggtctccgaacaacgtttgcaacggccccaaggcggaggtcagcaatttataattgatattgtttgccaatccatccagacttccaatatactccgggaggttggggatggttagatagattttcgcaaaccactcgtaggccgtaagagtctcagatgtgataggtcgaagcaaagcaagcacactctcagtaaggctatccctggacagcttatacctcgtagatattgattcaaagtctgttgtgagaatcaccataaccgagtagtattctttggccagtcgtgccatgtgcttcggtatcagccccgtgagaaagacgagtagctgaaggagacgttgaaccgcgaaaaccggtaccgttggcgacgtcactgaccgcaagacacggagagtcaaactcgccagtttcttcagcggcgtggtccattccccctcggtcgcaatcgagggtacttcatgcaatgtcctctgaaatgcctcggagaagtataccagccgggcaatatccccactgtcccacggttccaggaactggaccagcaaacgaagctgcgataagcagtccgcagctgttccgtatcggagggatggttgcagaacaacatcaggctgttgggcgaggatctcaaaggagggaacatgatctttgccctgcttcttctccgtggtatcccactcgttgcgccacgtcctgcgcgttatcttccggctccgataacccctccatgtccgttggacgagtcggctcgccgtcaaccgctctctttcctgctgtctcgcaagccgttcctgttgggcaatcgcaagagtattctgagggcctgcgccgtgaggattttgtcgaccagaggggtatgcggcgaaagggttcgtattgcggcccccgaggttaacctgccgtggacggcgggagttccccgtaaatgactggaacatagcttcgtttagacgatcacgctgagattaaagtctgtcgacaagactcgggcggacaaatgtgatggtcactgtagagatgaacagcattagtcaagcgtctccatgccgcagcccacggatgaacagcctaaacacgcagtaaagcggaggtgtgtggaggatggattgagcatggcagctctctttgctgtctcgtcctgcaggcagtccgggatcgccgctgattgcttctacggccacgcaccgtttcgcaccgaatacccttattgccactcaccttgtcgccacgccgcccatatcacgcttaataatggtctgatggctctaattatctagacgatgctggaactcttcatctgcatgctgaggactgagagtaccttcctagaggctgtctattctcttgtcgctatatagaatgtgtctatgacctataagcgatagattttcattccatctcactgtagctgggtgccagctagtactactactagtacccgtcgcaacactttatatatatatagtaactactacagcccctcatcgactgtgccttggaattaagctacatactaatgatttgtatcatgtcattccgatactactacctacagtcatatagaggggttaactgctttacagattttaacaccagctcaaggactaatatacgagtagcaaagttgaggatgacaaaaacatgaagtataaagtaacaatggccatgaggcccgaaaactgaagactgcgtgatattagatctgcacctacaatgcccctttacagtatgtagtgtccttagtgatggatagtaagctgcatagcatatatttttatgctttaggtattcgaaaggtagcgttctactagtctagaaggcttctagtaatactagggctggatctcatgtatatcccagctcgtatcaccaactctaacttaaaagcgtctcttcacgatccaaactgcagggaaataaccttaaatcccaatgcagaccgcattgcaagactagatcggattataccaatattcccgaacctcatgaaatctgtaattggtgaaatctaaaccatttgctaatatgcaataaaaaacccagagatgcgccgcgaaccaatacatgtaccaagcaaggtaagacccaagctacacgccgtgtcttctgaaccgcttgataccaaggtagccctgtataaaactgtgccctcaacatcaaatcccacagctactgtacatagaatacagtccacacaagccagaccggcaaataaagcatgcagagccgatcaaattcagtgatcgctacccaaagagcaacactatcagaacagcatcgactcaactccggcgccgcgtcatttcatgcctgatgtaaccgccaaactgtgcatggacgaagggggtatgtatgatatgcctcatcatgtccgaaaaatccgaatgtctttccctctggaggactgcaacgactgcgatgccgattattgacgcgcaggctgagtagtcgatgactgttccgttgcggcctcagagtccagacgctcctgttccagaacttcctgaccgttgtccgaggcccacatatcgagatagtcctttccgctgaaagcccgttcaagggtaacgatccttccgcgcttctcgacttctttcgtgtacttggatttcgtgggaggcatacgcttggtcacgaagggggtcaactatatcatacatatccgtattagtctttcaatcccaaggtaaaagtcaattgaacatcatagaaggtataatcccaccttaaactgatccaaattctcaggcacaacgaaagtgcggacttttttccaatcgatcacatatgacccgttcttcgcaaagtaacccatcgatccggtccggttacccttgtagtagccaccaaggacctgtttggtggtcaggcgcaagcgcgccaacatgggctgcgagggcttgaacatggtgggcaggcagggaggcaattgacggtcggtgggttgcggaggtaacaagacggagcgttggacaagatgttcggggaagagtcgataggaaggctctttctgggcggcgctagagaggagtagctccgccccgccaagaacatttttcgtggtccgcatcggaaaagtaaaaaaatcaacggctgcatcttgacaacttcttgcggtgcgtcgtcgccattcaagtcattctttcctttattttatttcctgggatttctctgaatagattatcatttacataaaatacagctcaggagctgcgacacacgcccatcatgcctcgcaggcaaacgcaaatgcgcggtcccaaagaccgggaccagtccttgcagaaatcgaagaagcccgcacccaagaacaagaagtccggaaactacctaaatgcatttgcgatcgcagagagcgaaaatcctggaaaactgggagtcaagcgcacccgtctaggcaaggaggacgaacctttcaaacgcaagcgacacaatgctcgagatgccgacgactcggacggcccggattacagcaagcgccgtcgcactggagacgatgaggcgtcggaaatggactcgaatgctggtagcgatggcgaaggacaccggtggaggattggtgaggtcggcagtgacgatgacagcgagttggacagtgacgaagccatgggttccagtgatgaggagaggttcgagggcttcacgttccgcggcagttctacgatgaaaaacaaaccgaagcagaaggccccggaacgcaaaaagcgcactcgcgaaattaacttgtccgaggacgctgaagtatcagaggacgaggacgatctcgaagacgactcggacgacctcggagaggatgcgatagacctgactacggcttgggatatgaacatggcagaggaagaagaggaaaaggctaagaaggccaagtctaagtctaagcaatcggctgagagcgatgaatcggaagaatacgactccgaaagcgaggacagcgactcggacgacaatgacgatgaactgccattatcgggagacgacatggacgaagatgaggtggatgagcatggtctttccaagctacagagctttgtcaacgctatgaacaccgagggtactacgaagacagcacgaaagaccggtggaaagcaggaacaaggggcccctacggagttcggtctgacttctacgcgaaaactcactattgccgatcttttgccatcaattacagattctcgcctcaagagttccctcaagcatgtcgacgctactacgacctcaaacacgaagacgtccggtgttcctggaaagctggatgcgcctcttgcaaaacgccaacaggatcggctggaccgagcggccgcatatgagaagagcaaagagactcttgaccgctggctggagactgtcaaggcgaaccgccgagccgagcatcttgtgttccctttgcctgatcccgaagcaaaccagacgcaccggatgggtgctgctgaaccgcgcacggatcttgaaagcactatccaaaatattcttcaggagagcgggcttattgaaaataatggaaagtcagcggaagaacaggtgcaagagtttgaagaactccaggcgcggaaattgcctattgaggagatcagggctcgcagggcggaactacggaagcgtcgtgatctgctcttccgggaggaagtacgcgccaagcgcatcaagaagattaagagcaagtcgtaccgtcgtgtgcatcgcaaggagagagagaggcttgagcaacaggaacgacaggctctcttagaagccggcgtggacctggatgaagaggagagggagaagaacgatcgcctgagagcagaggccagaatgggttcgaagcacaaggagagcaagtgggcgaagagcctgaagcagactggtcggaccgcttgggatgaggacgctcgacgtggcacgcaggatctggccttgcgggaggaagaactacggaagaggatcgaaggaaagcgcgtcaccaacggcgatgaagactatcttggctcatccagttctgagtccgaagacgaggacccatgggatgaagaggctgggtcggatgctgagaagcgcaagatccgccagaagcttagccagctggaaggtgacgatgatgctgacacagagttgaaggggccccacgccaagctcctttcgatgaagttcatgcagaatgcggatgctgcgcgtaaagcagaaaatgatgctgaagttcgccgtctcaatcgggagctccacggtgaagagtcgcagtctgaggcggaatccgaagtcggtcgccggaagtttggccgcaagaaggaggaggcgaagacagcaaaggaatccaaagcgaagctggctcggaatgaattcgaagaagcaccgggttctgatgatgaggctcagcaagaggcggatcaagaggtcgacattgttgttgaccgtcccgcaaagaagggaccggcagccccccagaataagcctcgtggtcgtcctcagaaggaaatcgcagaagaagaagatgctgctgctgtggaggagaacccgtggctcgtgcagacgaaccgcaataaccgtcgcgccatagtgaacgactcacagcaaaccgttgacatcacgctagatgacgcgaatgccagcagcggtaaatcgaagagtgcacccaaagcccaaaaggcatcagcacctagcaaaaagaaggttgatgccgaggtgtacggtagcgacgatgaggagagcgtgccggtgcttctcaagaaccatgatctggtgaagagggcctttgcgggcgatgaagtcgtgcaggactttgagcaagagaaattcgacaccatcaaggaggaagacgatcaagtgatcgacaacaccctccccggctggggtagctgggctggtgatggcatcagcaagaaacagcaaaagcgccagaaacggttcctcactaaggtcgagggagtgaagccggaagaccggaaggatgccaagctctcccgggtcatcatcaacgagaaacgggtcaagaaggtaagaacgacgatcagtcgggctctagcgcgtgtgatccttattcttattctgtgcatgataaactaacgtctgctgtttcgtctagaacaccaagtacatggccacgcagctcccccaccccttcgaaacgaagcagcagtacgagagatcgctccgtctgccaatcggtcctgaatggtctactaaggagactttccaaaatgcaaccaagccacgcgtgatgatcaagcaaggtgtcatcaagccgatggaaaagcccatggcttaatgtatgtggtggtctggctactacgagttggcagtcatggtgggtaactgaatagacgagagcaaggcatcttgcgagtctggggtcttttggtggcgttattgtagaattaagtttggtcatgataccaagtcattttaagatttctccgaacgatggggttattggttcagaggctgaggctagaggggttgttgtcaaggtgatgatttttgtgtcatccccgcatcaaccggattgttcgtagcatccgatctgcagaccagcactggtttcaagttgttttagtgctggaccctttttgcaaggcattagtctccggggttggtcacccccctttaaggttgtcgaataagcagtgttttggacccaagatgatcaggtctggtgagtccctgcgccgtgatactctctttccccgatgcggtgcggtttccttagattgcaggccacatggacatcgagattcggtccgacttggatccatggatatgagcaagccactcagagagctattcgcgtcccttgcaacgacgagtgacagggtggaatgccacgacgggcgttggccgggaaaaaatcagagatggagcattcaataataaaacttactacattgactttaaccttggcgtataggtacattccttgatgcctggggagcatacgcctcccagaccaggtctgggaaaggcagccgtgagatggagaaagccacagagaatcagatcgtggagcatgagacacttgaaaccggtcgcaaggctggtcggacagttttcaattttgttcctttggtcagaaggtgaaagatgagaaagtactttcgttcttaggaaagtatatgagccttgggagatgctccacttgttctggtttacccgcaccttcaaacagcgacaagcaagttcatccatcacccgttccctccctcctcttctcttctcccccccttcaaaaccactactattagtttatctgttcacactagcaattcatccaagacactatcaacaatcatttgcccctccatcggttatgccgattaagtacgattaatctgcccccttcatcagctgtctcaatcatccggctgcagtaagcttcctctcccctgcacatacccgcccgacttcaggcagatggtgctctgcatgcgcccccggctggcagagcccgaggatggtgcattccgcccccctcaaccctgcattccccgtgctatgttttcgttatgcctcgaggcctgggatcagacaccacaacattgaccattgtgcagatcgacgcctcgtaatacctcgttggcacttgttccagcccgccagtgtccgtctggtatccctctgcaccggggccggagttttgcccgggcctgagattcctactggctgagaccggaatctatactcaacctaggtgagctatttcactgctatttgaaaatgtcttccgccgctcgatctgcttctgttgtttactatcctttcctgtccctccctcatatactggagcctgtctctggggtgttccgtacactcagttatcagtccaccaaaggagacctagagatccatcgttggccccttcatatagtatcattcttgtggatgactccgttgcgatcattcttgctgttttctttcatgttttgatccacctcctcaaccaaccctactggctggccactttcatacatactagccctttggccttgggacgtgtggagggatttaatccgtctactacacttttcaatcttgatctttcattctagaaagacggcacagaccttcacaatggagaggaaacacagatggggctcatcgttcttgctaatgtggcttctagctgcagaaggagtatactcagccccgagacgctcatcttcaactgcgtctccaaagacgcaatttccaccaggtgctgaaactgaaagaatactccctggtacaaacggtgtaagtgcaacgtgacttaaccatcatggagtcggattctaattaccattcagctctatccgactagccttgagcgcgagggtcatccggtgctcccaaccccgacatcgacggggaacacgaaagatccttggggacttgatgggctgcttgaatccttgggcgataccgcagacctcccaaacgaattattgagcgagtttctaccaggctggggcaagaattatccagtgaccgtgccggtatcagcgtataaaccggccagcgcggaaacgactagctcagctacggaaccacaaacgcagccggagacttctgatacctccacgccgcaggctcctagccaaaacgtgccagaggcgacaaccgactcttcccaggtcagcagtcaagcttcgagtacaacaagcctcacccagccttcgagtacaacaagcaccacccagctttcgagtacaacaagtcccacccagcctacgagctcagcgagttcagcccagccttcgagctcagcaagtctgaccacgactgcaagccaaacaacgcaagcggataattctatcacttcaagtgttgtccaaggtaagttttttcaaataatatatgccatataatatctgacatgccttggcgttagcctcagttacaccaatgtctggtcaggacgtatttgtgccattggcgacaaccccattcccgcaaaccatcacagcgcggaacgatcatccggtgcctaagaaaggaattgtatgtatacccgaacaagacctgtcaagacttgcctaacgaccataggaaaatgtcactacgccaattgagacaaacaagttctacgctggactcttcctcgggtcgcagagcaatactacctttacccatccgtatggtctctcatgggcgaagggaagcgggaatgccaaaagttacggaatggccatttcccacaacgaggttaatgtcgttgcaaatggccccaccaacgccaacattcctggcaatcccatttcgtactacatcaatcccattggcatccagcatatgatcctttcagccacagaactcaacacctcaactgtgctgactgcagagaacctcttgccattctccgctgatgctgttctgagtcctactcccgggtcaagccaaaggataactattcctcttgtgcaggggatgggtttcgtcacaggcatgtacaacaacctacagcccctgattcaaagtggtgtatttttcagcaaagtcgtcactgcttcctcgccccggattggcatctacaaatataaggtctctctggcggatggaacagagtggcttgtttatgccatccctcaagatggaaaggatccggatttccgcttggaatctaacaccgacttccgtggcccaagtggatggtctgggaccgttcagatcacgaagaacccagcaggtgattctggtgagaagcttttggacggatctagcggtgtcttcgctctggaggctgctgtatccgggtcggttcaggacaattctggtacatacaatctggcattcgcgaagtcagggaagcagctgcaacagactccactgcttatgtatgctctgccgcatcacgtcgaatcgtttgataacaccaccaagggccgcatgaccagcatcacgcttcggacaacgacaaagggtaatgcaactgctgtagtaggagaaacttggacgatgctggagccgaaccttccaactcaaatgggtttcgacccgtggtcggtatcggccggtaacgtgaacaatctgagcgctgctgccaaacaagtcatcctatctgtggcgcccactgagctcaaccaaagcattgaccagcagtcagacctgaatagcatgtactacagtggcaaggccttgagcaaatttgcaactcttgtttacacagtgaacaagctagggggtaaccctgacctggcagcttcggctttgcagaatctgaagaccgccttttctcgctttgtcgacaataagcaacaatttccgttggtgtatgacagcgtttggaagggtgtggtgtcctctgccagctacggaggcgattctggcgctgactttggaaacacctactacaatgaccaccacttccactatgggtattttatccatgccgctgccattattggctcgctcgactcgacctggctcacggattccaacaaagcctgggtgaatatgcttgtccgtgacgccggaaactcggccgcaaacgacccatacttcccattctcgcgctctttcgattggtaccatgggcattcgtgggcgaagggtctgttcgagtcgtttgacggcaaggacgaggaatcaacctcggaagataccatgttcgcgtacgcactgaagatgtggggaaagacgattggcgatgccagcatggaagcccgcggcaacctgatgctgggcatcctccgacgaagcttgcacaactacttcctcatggagagtgataacaagaatcagcctgcgaactttatcgccaacaaggtgactggaattgtaagtttctggcccgaccccaagtccgtttacacgcaactgacaaggttcgaagctgtttgagaacaaggtggatcacactacctactttggtaacaacctggaatacatccaagggtatgcatgtccttcgtacgtttctctgtttcgcatgctaatatagtcaaaagtatccacatgttgcccctcttgccttcgtctccatatgtacggagccaaaacttcgttcgagaggagtggaatgcactcttctcggccaatgccaccgatccagcattgaacgtcactggcggatggaagggtgttttgtacgccaacttggcactgatcgaccctgcgtcttcgtggaacttcttcgcacagtccaatttcgattatagctggattgatggaggagcgtcacgcacgtggtatcttgcatttgcagcgggtcagtatatccctccaacttctcaatcaatgatgttgctaaccacgtacgcaggcttgggcggaggtcccgcttaaggacacatcatagcgaccaagcatttgatatatttagtctgccattttggagtatccagcgttccttcacaggaagatatgcagtctgtgctgttgatacgtttttgttggcgccgtcttatatacctgttcatatatccgactaccctgtgaacgtagtgatatagatgtttattaatgattttacctacattggcattgatagcaaagaagaatatcatccacgattatcagatttgtcggcagtactacgtcctagcgcagacggcaacagtaaacctggccatttcctcaacaccgccactccgccgcaactgcgacgaggtaaatgcactagcatagccccgatgttccccaatcgtaaacctgggcttcatttaagataagaagaaaaacgccgccgcctatagccttgtaacaaggctgtgtagcctcctgataagcttatttattgcgaacacaaagtgggatgtgccccaatcactcgggattcatgtgtcctgcaggtggggggctgcgtgactccgtttaaccagtacacacgtagtagttcttatgctaggctgactgatttggggggctctgatgtgatctgataactgagatgcgaaatactactagtgattactgtggctcatggacctgctaagacccttgactcaccctctcatccctgtaggtagcttaggtaattctgctgagttgaaaaatgccacaaacaagccacagtatctccatctctctgttatctatatctaagcaaatctaatttttttagactagctagctaactaaataactaactcaccaactagtaacttgttcaacacctccgatccagcttaacgatagagagaatgcaacaaatactatgattggtggctgcaaagcaaccggtgaatgggagtgggtcaaccagcaagggacgggctggacgggaaaaagtgtgcacggatcaagttgggtctgctctaagcaagttccgtgatccatctggcaacaacatatttcttcgaggcttgaagttaaaattcttttagtttgttgatagtcttgatggcttgactattcaattaacgtggctggatgtctcagccgctttttgattgtgaatcataccactgtatgtatgtatgtatatactgtatgtactgattgtgtatgtgactgtatccaatccgaggggtgtgccgttagtcagagatacattgtaactagttaacctacaacttagcactggttgtatacgagcatcacagttactgaataagggaactgattactagtcagctggtgctgtggtaatatcattaggtagttggtaattcattgttggtgtctcgttcgttgctgtcatcttctcaatatctccggttttccaatattagcattgaaatcgggcgggttgtactctgtctagcaacgtgttgcgactatgcgggagactgaacttagactctgcaagtctcccagtttcaaagcccgataaccagctcaccatcttaaatgcggtcaaacccaaccagttgaacttacaagtggttccagaactttgtgtgcactgtgaagccagtaagccgaacgaatgagcatcttacgtcaaaggggggccattcccctgaaggtgggcctgatcgtggcagtgcaaatgcatagtgagtgggttttccaccatcatccggtgtcacggcagtccaggaacctgggaatttagaattatcagtattttactgtgagaaggaactctggcacggtgggggtttgtttgattcaggacggatgctagttagctatgtagaattatcattgctgacctcttcttcatttcaattaaaactgcatcaggagtcgagttgagattcagattcagattcaagtgattgaaggtggctggagctggaagcatcagagcatcagccccacccggattagtccgggactctcgtcacaaacagccgattcctgctgctggtgggaagctcaggctctatcgatctatcctctgcattagtctacatcaccattacccagcatggagaagctggtccgcacacttgtgcctatcactcttcacacccagtaaatccccccatatcccatatcccaacttttcagtccttcttttccacaaactttccttttccatcaagtacggaatacttccccaatcccattccccggtcggcttcgggcagtatcctctggtcccaattgtctcccgcaaagtggtcaacgtcatcgtcatccaattcctccattctctcgtttaaaagtacccttcctgcccagagtgttaagttaaaaagattttctaacccgtcccaggtagcattacgaccatcactacgagtaactactttactcttcctccaacttagcccccccacccctgcttccatcacactggcagctttccactcttccccctccatcaatccctggaacgttggatgatctggattgaggctgtgctgctgcctcctccttttggtccaaatccctcagtccttggtccaccagaattccctcaccaaccaattaccgtggccagtggaacgtccggaatcgtgatcactgcttagcgactctttcgactaccactagaatctgtacggtttggagtacgtagccaccatctcttggcccctgtaccttgcaaaaactccctttctttggttgatccttcaccctggggtaaaaatctcaacgtgtgcacgcgtcgcacggttctagccattccttatccgccgtgtccaagcctgcaaggtggcttgtgctgtgataatcctttgctaaacgcaagcaaagttcagagaaagcctacccacgcgacaagccacaccatcagacttgctcctccatccgatcacgggggtgctacattgccaatcgactgttcatttcgattaagccccgttttccaagagtcgactggaaaagtttagatcagaagacccagtcgttcatatcgcttatatctctcaacccccgtttgttgtggttccagattgtcgccacaggacttgacatttcccaatgggtaagtgttagagagagaaccatcgttccttagcactcctcatccatgtttcgagtcctgctcctacctaattcttaattcccgtttccccacctccagtttcttcacagctacgttcctcttattcaggtatcacagtccttccattcgttcgcttttctatctcgctttttgaccctcttgcttgctatgatcggcacggcttgttgtctcttcacgcacacttagatcactatactctttggcagtatatccggtcgtttataagcttttcactttccccactcctttgttcgtttaaactgctttgtcgtgtcaactcgccttcctttcctatttgtttttctgacagcaccgtccgcggcgaatgacaaccgttgccagcctttgtctcatcttttcacatctacccgcctggtcctattaggtgccacgctctgtagactgggctaacaaaattcccaacctgcctttacagcgaccaacaatatcttcaagtcatttagacgctactcctggggccccaaacggagaatgacgggcttatcatcagagaatggttccacggagcctgatgagagagcagcattgctcggtgacattgctcgcagtaactccggcctccgtccgcgacagcagaagcttcactggtctcactggcctagacgggtggctcatttgacttggtcgactctcgttcgcgattatgtcaatgtcctgctcatttttgtgccactcggtatcatctccggtgctctccattgggacagtactgtcatcttcaccttgaactttctcgcaatcatccctttggcctctcttttgagcttcgcgactgaagagctggcagctactatgggtcaagccctgggaggcttgatgaatgccactttcggcaatgcggttgagttgatcgtatgtacatctctgacttttgtctgaagtctaatgtgttacaatgacccggcgctgacaagaatcgctacggataggtcagtatcattgctctgaaagacaaccaaatccgcgtcgtccaagccagtatgcttggtagcatcctgtccaacattctgctggtcctcggctgctgcttcttcgtcggtggtctcaagtactcgcagcaatctttcaacagcacggtagcgtcgacaatgtcatccctgatgactgtttcatctgcttcgctgatcattcccgccaccctgtacgcctctttgagtggctctaaagataaggagcaaagacgtgacaacattctgatcctctcgcatggaactgctattattcttttggttctctatgtgatgtacctttactttcagctcaagtcgcatgcagagctcttcgaagcagccaacgatgagctcaacgatacagagaaccagggtggcgaagttgaagaagccgaggaggaggagcatttgctcagtccgtgggcggccactgttgcattgattgtcatcacggtcttggttgctatctgcgccgactatctggttggaagtattgacagtattgtgacgaagactggaatgagtcgcacgttcatcggtcttgttcttattcccattgttggaaatgccgcagagcatgtgaccgctgttgttgttgcttggaaaggaaaaatggaccttgccattggcgttgccatcggaagcagtcttcagatcgctctttttgtgacgccattccttgtcattcttggatggatcatgaatgtggatatgacgctacacttccatatcttcgagacaatggcctttttcatctctggactggttgtgacattcctgattcaggacggaaagtcgaattacctcgagggtggactatgcttgggaatgtatgttgctcctataccgctatattgtctcactcacctttgagcttttatactgacccatcccaggtatctaattctggcaattgccttctacatttacccagacgatgtcaacgaggatgccctattcaaccactaatatgttgttcaatgggttgggcaccttattgagctgctgcctatcagccgtctccgctcactattctcattttccatctgtactccttcgtcgtctctccttaatcctgtttaactcgaaaatgccgttgtaaaaagcgagctagcttcctcagtgggtttttgtacagacatgcccagttgacgttttgggcatttttcacgttctactatgggaggtgctttctttgtttcagtcaagctgcgggccagtaccaacgtatgccgaataggctacaatcctgtatttcaataggctaagagccaggttttcaaatgtcaccttaacaacttgagtctctgctgcggaccgaaaaacgaattattaggaatcacgcctttgtcagtagcaccaacctcagctaggatggtttgtctgctgtatgattcaactcttagtaaaactcgtaaataattgtgtagaaatcgtcacttcgtcatcattgcagtggaggcatcgcatcaaattccttgatccaatgaaactcttggcagcggctgactcagccgcggatgtggagaggaaaatcgttcgccggccatccaaggcgagagagccagattcgggtcgatgtgactacctcttcccatcctccttgacattgattgttcattgagggcccattatcacacaccatgccgccgcgtctcaacctttttaccgcacgggcggttcccgttcttcgccagtccgccaacagctcggcggcttcccgacgcagttttgcgaccatcctcaacaccaaccggccttgcgcggcctcgaccggccatggcctgaaatccggcctgtcagcttccgtccggggacagaggaggtgcaactcctcgggctctgatggtcaggatagacccaagggcccgaccgaggaccctttgccccatgttagcgaagaggccgcggaggtcagcaagatcatggataagaagtgcgatggtactcctgctagtcctgagttggaacagggatcgcctatttctgaggtgcgtttctttcttggatgtcgtgttgtggctgttgctgctgcggctgcggctgcttccctgttttgacgctctccccgcggtatctgggtccttattgactattgtctctgcatagatcctgcaacgtgataaagaggccctaaagcatatgcccaaggtcatgcaagaccagatgaagcgtccatccggtagccgttcattctcgacgtccgctcgccgcctgcagccagaacttcagggaaaggaattggacgatgcctcggcgtcggtcgttgccaatatgatctcccaggttaaccagcaggccacggagctgcaccctggactcaagttcgaagcgccccagaatcttcccaagaccgagaacttccgcaagagatatgagacgatagtggagcagttcactaagctgctgatgcaagatggcaagctgagcaaggctcagaacgtacgttctactatgcagagtgaccttcttttctttgacaggatcaggactgattttgactttctgggttagaccatggcattcattctggatcacttgcgcactgctcctccccctaacatcaacccccggcgccgcttgctcccgggtcctcccgctcctcagctccctcttaaccccgtcctctatctcaccttgattgtcgactccgtcgcgcctttgctcaagctccgtcaacagaagggtatcgttggtggtggtgtgtctgtgcaggtcccttctcctctcgcgctgagacagcgccggaggaccgcgatcaagtggattattgatgcctctgacaagcgtagggatgctatttttggccagcgcgtggctaatgagctggttgccgttgctgagggccgcagtggagtgtgggataagagagagcaagtgcacaagctgggtgtggctggccgttctaaccttggattggttgcgcgccggaggtaatgtacttattttaagtctattggagtgagagatgggaaaaagagccatttctactgatgatatcagagggcgttcggctacattgtacctatgatggtatgcagtaggggagctagagagatgggatagttggatgggtgttgtatattatctgaaacctgtacctcattttctttgaccgtttttgaaagcatttggattagaaaatttacgcataattgattcaagatggaaggatcggatgatatattggattgtatctgaaattactgctagtacataacagaagatagtgtgaagttgatgcgactaatgaagtcctcgactccggccacgagccaatgacacgggcgatgactaacagcgctagtcgcggctgggtccctctccaatcccggccaattctggccccccgtaaagcagcttatctgtagcttcaccgatcagcattgcctgcctactcgcgatctgtaggatgcacttcatctcctacaggtatctttccattggcgtgttaagcggcatgctacattgacagctggatcgggtgcaatccctgttctagacgcgtggggagggaaagtctaacgccgatcgggtatactattcctgctggcgtcccgtgcttcataattcgttctccccgataacgaccaacgcactgcagataactaccaggctagtatatacgaccatcaactagctagcgttagcggcacgacttgagaacgtggaacgtcgcccatccaacaccctcgcacaaatacgctggacatcctccggccgctgtctctgctgccccgctcttccctgcctctttcctcctgtccaacaccgtgtcgtcgaatgccggcgatcgaacctgggcacgcatcgcttctgcgaggggtgcctctcccgacgataacgacgtaaccccaagcggccagtctattgaactcggccagtatcctgacacacctgccacaacttcccgccagtctcacgcgactcttcctcctacccagctgactgacccggggtctgaatccccttcctaccatcgtacagaccaccgggaaggtcatcctcagaagcctacactgcgggagaaaccggttatcatcaaatattggatagaagctcttcgtcgtcaccctcaccgccaccagactagcggttccgccgacaagatgaagttctctcacagcatccagttcaatgctgtgccggactggagtgcttattatctggcttacagcaacctcaagaaactgtacgtctgctctctcacacactctctcttttctgtcctccgccgggggaatactcttcttatatcgcgaatgtcacattacactccgaaagtgcatgttacattggcggaaattgtctctgttgaatgggtccctctaactgttgtccactgttcaggatttattctttagaacaggaagtgcatcatcgatcggccggacatgaacatgcagatgttgaacaagccccattgctagatggcggcagtctaaacactgatgcgatattccgtcgggctctagatgcagaactcgaaaagatttgctcattttatcaatccaaggaggcggagatattcactgaggttgaggacgtcctcagagatgccgaggaatatgcgcacagggccgatactatgaatgtcgatcccatgagtgacgccatgatcaagggtcgcacagccagttcaagctctaggcagcggccggggagcattgttcgtcgggtgccatcgaaccaggaacggcgtcatagcgcattcagtgaaactttggccgatgatgatgatgacgatgcagacagtgacgacgaacctgggacgctgtcgaatcaatatcgaccgcagtcgcatggcgccgagtctagcaacccggatggtagtcgtacggacgacatgagggattctgtgctctggggggctgattcccggcttctgggctacagcggtccgtccgcgcaccgcgggggtgcacccgacgagcatttttcggacccaatcgtcgtagacctctacaatgccgggctctcgctgaagaagcgggctgttgcggcttatgtttccatctgtggactcaagtcgtacatccagcttaacaagactgggttctccaaagcactgaagaagtacgataagatccttgaccgcaatttgcgtcgagagtacgtgaattcggtcgtgtctttgacgtatcccttcaaggattctaccatggaaaaggtggatgacaacattcgcaaagtcgaggaggtctacgcgaatgtcgtcaccaccggtaacattcccctcgccaaacgtgaactccgtctgcacctcagggaacatgtggtgtgggagcgaaacacggtctggagggaaatgattggcatcgaaaggaaggctcaggctgcgaacgtcggtattcgcaggacgcttcttggtggagatgaggatccttccaaagcacgacgccaaggagacgagcaggaagtcatgcccaagatgatccggacgccttttggaaccatccgaatcccgcagtggctctgtagtctgagtcttgtcaccctcgttctcatcctgcttgtgtttggcattttactttcggtcccgataatggagaagcctgaacagcagaattgtctggccatgcttgtttttgtcagtttgctgtgggctacagaggtcggttttatgccctgcgtctctgttcatcgactgacccaagctaatttcactgcaggttattcctctattcgtcacatcgctactcattcctttcctcgtcgtgatgctccgtatcatgttgtccgacaacaagcctcacgaacgcttaggccccaaggaagccaccgccgctgctttcagcgccatgtggacgccagtcatcatgctgttgctcggtggcttcaccatcgctgcggcgctttccaagtacgatatcgctcgtcgtatggccatgttcgtcctgagtaaagccgggtccaatcccaacatcttgcttctcaccaacatgtttgtgagcatgtttctgagtatgtggatcagcaacgtcgcctcgccagtgctctgctactcaatcatccaacctctgttgcgaaacctggagcccgactccagctttgccaagtcccttgttctaggtattgctttggccgccaatgtgggcggtgccgcgtcgcctatcgcgtctcctcaaaacatcatcgctttgcagaatatttatccgagcatgagctgggggacctggttcttcatctcactcccggtgtgcattctgtccattgtcgccatctggatgcttctggtgctcaccttcaaacccggtcgtgagacggccgtcgccatccgtcccttgaaagacaagttcactggagttcagtggttcatcagtattgtcacactgtcaaccattgcgttgtggtgtggcagtcaccaactcgagcatattttcggagacatgggcgtaatcgccattattccgatggtcctgttctttggcacgggtatcctcaacaaagaagatttcaacaacttcctctggacgatcatcattctggccgctggtgggctctgccttggaaaggcggtcacgtcttctggtctccttcacacccttgcgaatgcgatccgcatgcgggtggaacatctcagtctttatggtgtgctgcttgtattctccgccctcatcctggtcattgccacgtttatctcccacaccgtggcagccctgatcatgctcccgctggtacgacagatcggactcggcatggacgacccgcaccccaacctgctcgtgatggcgagcgcattgatgtgttcggtggccatggctctaccgaccagtggcttccctaacatgagtaagtcgccctccactgacaagtaataccaagaaaaagtatgcatgtactgacaagctacagcggccatcatgaccgaggtaccccagacgggccagcggtatctgcaagtccgtcacttcttcacacgcggtatccccgccagcttgatgtcctttgccgtgatagtaacggtgggatacgggttgatgtacattgctggactgtgagctacgttgtcacctgacaagatgtcaacgcagacttacattaattgctttgctttgctattgcttttgatttacgttgtatgtggtggaactgtgaaagataatggggcttgatctgatgctgatttagccacgcggcgcgatctggtccgggcatgcttctttagatcgtgcgttttcatggtggatgttgcttaaggttatatttgatggatggtggtaccgattttacttttttctctcttttcgtttggctagatggtgaacgatagaaatataccagattgatgctatagaattgaaatgtgtagggctatagagactcaattcattatcctgtactagttatgatactgaccattcaatgaatatggtagcatggtagaaaggtacaggtctgtacagcacacaacacagaaagcagctcttgcacctgctcatgcataacacaagtagaagagaagaaaacgggaaagaagcaatatcatcattcatcaatcgcgtaagtaaaaaaacaaccacaaccacaagaaaacagatctagaccgtatcgtgcaacagtcaagtaatgacataaacatatgtatgatgatgaaaccaaaaagtcacagatcaaagagtagtaagagtagtagtagtagtagtagtagtagtagtagtagtagtagtagtagtagtagtagtagtagtagtagtagtagtaagacgaaggtatcgtatcaaagcatcatcaagacaaacataagagagaagagagactgcggacccgacaacacaagcggatagtaacttgaaacgagactgactttttttttcccaaaaaaagaaaatcccagtactcttctcctcacagtacacactcgctcactcagttcctatccgcatgaattagccagctgtcccaagatgtagattgcgctcgctcgatgtcacgaactggggtatatcagataaatcataataggagggggagtattttgtgcagttgggggatcaaggggaaaggaaaggaaagggtaaacatacaacaacccaagcgtaagatcaccatgaatcttggccttcaactgcacctcaatatccagattcagatcgagtctcaaccgcaactgctcatccttgccttccttctcttccccgccgccgcctccaccgaggatcccgcccacagctttgccggcactgcccgttactccgttcagggcgttacctgctgtgttctggacgagatcgccggcctggccgacgccggggaggccacccaggggaccgccgtcttgaccctgttgttgctgttgggggcgctggcggcgctggcgacggggtcggtctacttgctggttgttgtccatgtcggagtagtcgtctctttggcggagtttctggggaggtcgggagcggcgtttacggtcttgagagggttgaggggcgcgttgttctggttcgggttcgggttcttcgtcggacgattggggttcttgtttgggtgctttgtcttcttgctcttggggttcttgtttaggttgaggttctttttctggttctggttcttgttcttgttcttcttgtttgggttgagggtcttcgtcctcttgtttgtcttcttctttttcttcttctttgggcttgtcttctgtggtgtcgttggtgtcctcgggcttctgttcttgtccttcctgatcaccagtaggagggttctcttgttgaggggaggaaggggaagaggtagtgttgttgttgttgttctctccttcttgggaagggttgttggtagaagactcaggctgcttggactgatcagacatgatgaaagaaagagaaagagaagagggagcaggaaatcaacgagatctaatacttcagcggcggtctggggcacggggacgtacactatatagggctcggctggaccgtccaatggccgggcaatatttatagatgcaggctagaagttacccgcgaaatacgcaagggagagagattgaaagtaaagaagagggggggaggcgacgtcagtcgatgtgtgtaaatgtaagagaaaatgagtaaaaaaaatagggtaagatggggggaggatcaagccagtatgtcatttgtgccactcattctctcacgctcctccaccttgcaggcaagatgaatgaatggaatgatggatgacgatgatgatgatgacgtcgcgtggctgggatctttcatcttagtttgttctttacgtttagtacatcggagaattattggagagatcgtcgcacttcggccgggatcgcaagggcatcgtaatcttctggacttggatggttgactggagggtcattgtttcgctcctccaacgggggatccactgcacgacgtcagtgcactcactcactgggtttagttggtccacttgcaagcctgtcagactttacccgatccctctccctgtctctctctctctatctacaaagtacagtaacggttctggtctactggggattttctttgtcgcaattttgctttgagcgcatggcaaaaaatatccccggtatatggcaactcggatacggttgccgtgagacttcaagggataaccgtggatgctgtcgggaggtttcttggatcacacgcggcgggcggcaatgcagacgagggttccatggtccaaaagtatcacaatcagggaatgagtatccgaaagtcgcgatgaaggcacgttctacaatagagaaagaatagaaatcacaaaaaaagagggtccgggcaacgtggactcgatgacgatcactggctcgaccgtcatcggctgacttgaggatcctctgcgagacaatgccgttgactatgatgatgatgatgcagtcatcgtgatagtcgtcaaattaattaatttcaagcatcattggggagatggtgcagtcgctcagccgctccatccttgcgcccacaacgtcatcctcccatcctccagccctgcacgttgaatccccacacctccaaacaaacggccatacatcattgctggtcttctttttgccttttctttcttttctttttctagagtttaggttttcccttttcttttccctccggagtgtactcccttacttttccctttttttgcatgttcgattgactatcaacactgtctgtctgtctgttgtgtccgctctccggccgactgacgaattgccccatccagcaatcctaacgaagaccagtccttctgttcttcgcctcccgcattcggggtccttttgtatgtaaaccaagtcatgccgctctgtccgcgttttgccaatctaacagtcactccgggctggtaggaattatatcaatcccatccactacattttctctcacaccttaaccccgccatcccatctttatactccgttgactatcatcttcatccccccacaatccactattaaatcaacatggctaccgctcaggctgagaaaccagccaccaaaacctttgctaatgatcccgatgatgtctccgactacgattccgaggatgactattccgacgacgacacccaacaaaagcctcaacagcaacagcaacaacaacaacaacaacgccgccgtcgtcgtccccagcagcaaaatcccaacgatgaagacgacacctactattccgatgagtactcggatgactacgatgactacgacgatgaagatgatgactactacgacgacgaggaagaagaggtccaggccatggaacgctaccagcccaccaccatcagcagccgcgacaatgtgcccgcacaaccgatcgcaaacggcggcatgcaggaggcggaaggcaaaaccggcgatgactgggaggatcaagacggaatgaagttgaaattggaattgaacttggatatcgaagtcgaattaaaggctcatatccatggtgatttgacgttgtcgttgctgtaagtactcccctttcttctgcttctgatcgatcacattgattgcggcggcggggagaattggccctgcgtgcgggccaaatgcatgcaatcaaccaaatcacatcacttaatgtcgcttgctactagaacgtgatcgagatccgatggttgacatgataccctttctctttccagcgcataatttcgcctctttgccgcctccagtgcagcatttcgatcatgttcaccccgtcttttctccgtcgccgaatcccgagcgatgttcgtcggttaaccatttatctaccggccgaagtggttcgatggttcgttcgataaattcccgggggaagagaatggctttcttttcttttctttttttcgccacattgctggcgcgcgtgtggttgacggtcggtcgggttcctggcgatcgttgcacttttcgtccatttcggccggcgctcgcaaaatccatttcctttttccatccctccattccgttccgtttccgttatgacgtttacgaaaggactttcctcggtgctcttctgctctcaacaatagcggttgtttttgcaaatgaattgccttgtattctttttctcacattgccattgtccggatagaagtggcgactgcacttgattactgatgcatgcgatgtttctatctatggtgatgtcaaggcttatcttgacccatctactccatattcagtgtctgtgcgcacttataccattgttggtatggttttgcttgatcttcatctacttatagtaataagggtatctacctttggattttatctcatattgtaggtcaggcttcctccacttatagatggtgtcggcaacgccgaccgtagatattcgatattacaacaaaaaattagttcctatatccaacatcatcaatagccagttatctattacccttcaatgtactagacagaactcttgcagagcgaatgaactcatctgacatcataccagatccaagaatatgcatcgcatactttcttgcactcaacagtgacctatcaaatctaatcatgacaggatactacaataacaaagctaatccaaggaatctgattcacttgccgcacgaaaatagaacaacgataaaaacatattaatcaggtagttctatttcggttcccagaaatgcatgtgtcgttgccactatacccttgcgtagtggaacacggcagattaaagatccgtattattgatatgctgtgaaactatagaacatagttcatgccttgcttataagaaaagatatctctggacattaactaacagtgtacgtctatttccttggtatatccaccgttgaatccggcgtcaggataaaacttatatatatgattgtaaattatgttgcaattcatgattctcgataggtcttatgatgagcatagacgttgtctactacttctcctttgtttataagatagtaggtaatagtgtgatacatggtatttagcaatcctgttattggtcgtaattctcagatggtttcttggtattgtgaagtggtcgtgaaacgattctttgtaggtatgcttgaggggaaccatgagatagtgggtgctcttgttggtgatgtataatacttccattacttagtatcaccaccatgttttgaaactaagatatcgaggcaaccagcctgtttgcgtatttcgtcatgaaagataccgctgggggatagaatctaattatttcaatatgctgccagcggcaatatgttagtaccatatcagacatgatagttagttatctgtttcacgctgtagttgtttaagtcagtaaaaagcagtccgtttaaaattcacagctattgttctgtactgatatcaaaccaaatctgagttagtaattaattgtgctatactcaagtccgaagacctcaaatatatttggagagggtggatatagtctagctatacgatatactgtgagtttctaagaatagtaattcactttattctgctacatgttatagctcgtagcctgttcatctagtactcatatcagagaaccttgaagtagacaactagtaattgctcagagtgaagtctcaactactaacagactttaatgtctttaattatatagggatgccgatatcatttgttacttgactaaaaaaatgatgcgataaagccaatggaatgcacgattggttggtcgatattttgtggaaatcactgcgcatccaactaatttgtaagatcttcgccagcgtatacacatatcttgttatttggtgggcacacagtgtagtatcgcatgtatctacttgcattgagactttcaagaaccggaattcgccgttttagatatgctgttctggcaggggatgaccttatatttcagctaggtgtaattgactgtgtcttgtctgaattttcaacattctgttaacattgctgggtcgtagacgctacaggatactattcagttgggtaacatccccagcgtccaccgagtgccactgcagtgcagagaaaatgataaagtgatgatttcactagcagattgagctcagggtgctcagaatatatagtagctaaaattcaattccatgacatagcaatctgagtattgagataatcccaacattcgctgaaatccctcactaaatgatatacacaatgcagaatgataataatatagtagaaaccgaaggagcaggcaatttcacgtgtggcctcaatattggcggagcgccagttcctcgggaagggtgagcccatcgcgatgttgacgatcccgaggtactcttggcgggatcaaaaaggagtccgcaaactgccaccactcagtcgccgaaccccgcgcaaccagcagccagcatctgcgagtcaacatatatcaagcgcgaaatcccactcgacaagagaacaaggaaggaaaggcaagaaaagaagcaaaacgaagcgaaaatggcaccagaccgctccaacatctccttcaccatcacccacatgaacgccaaccaccaagactccctagcagcctatctccaagtctactgccacgtctccgcccgcgaagccaaatccgctcgtctcgaagacatcaccttatctgatctagtcatcagcgccaatggcacacgctacactgtccccatcgatccagcaatgggaagtttctccgagtcgcgatcccgtctggtagccatgcaccaggaatgtcttgcgcgattgggccggtccgacatcaccatcaaagagtatcgtcggccagagggaatcgagatcttcctctttttcgtgtttgcaactgcattggtggcgttctctcggcgcagtaacttcctgcctgggtcgttgttctacgaaacggttggactgggtgcggttccgccactggcgcaactgttctacaagacacagccgtttgtgcttacggttatggccgggtcgcatgtggtggaggcgagtttgttcacggtgaagaggttgaagcggcatggggtgccggtattgtcgttggtgtggtgcgcttgggtggtgtcgaatttgattgaggggtatacggtgtggaggaggtttgattgggtggtgaggcaggaaggggcgaagagggagcatgggaaatagtcatctagcataggtagataaaattctactataatatactacagagtacgaatcaaaccataaatgttgctctccattcgactgctccatattattgctgatagtggcttatcgcttatcggctagcggacaatcgactagcggcttactcatcaaatcacgggaccacgctaaaccaatcccagactagggtagtagggcaacttccacaagcgagccacagtgcgaaattcaacggaagccgacgacaagcactcaactccttacgaccaacccaacgacccttgcccgctgcgttcctggtgaagggctgcaggattagaggtgagtttgttgcaattaatccgtcgtgatttcgatccctctcgatttttcccgcgtcgtcgacggtcggtgtgcgcgtgcaatctacgatcggtctcgaacttgaattggaagatacacattccggggtatatcgaagaggaagagagaaaaagaagaaagattatcagagcagttgtttggtgcaagggaatataagcggcggcgacgacgacgattgaaaagaaagaacaactcaagaaagaatttttttcttcgctttctcgtccatacccgagttcgcacacatttccagcatcgagcatcgccacacacacacaacaccattcaattcaattcaaatcgactcgacaatcgcacgaacaaacctaagaccatcgacgcatcggggcaaaaatttctcgaagagggattgacaatcaccgacaacagtctactgcttattgctactgtcttttgtggcgagcaatccccgctaatacttctgccatctacagtcccctcgaacagcaaacatgggtatctcacgcgactctcgtcacaagcgctcggctaccggcgcgaagagggccacctaccgcaagaagaggtatgcatgagttcctattgtctttcttactcaaccaactacactacgaaagaaacaacgactgacgcacggcaattcaacagggcgttcgagaagggtcgccagccctccaacacccgtatcggaaccaagagaatccacctggtccgcacccgtggtggtaaccagaagttccgtgcccttcgtctcgaatccggcaacttctcgtggggttctgagggtatctcccgcaagacccgtgtcatcgttgtggcctaccacccctccaacaacgaactggtccgcaccaacaccctgaccaagtcggccgtcgttcagatcgatgctgctcctttccgtcaatggtacgaggcccactacggccagcctatcggccgccgtcgccagcagaagaccgagaccaccgaggagaagaagtccaacagcgttgtgaagaagcaggctgctcgctttgctgagcagggcaaggtcgagtctgccgtcgagcgtcagttcgagtccggacgtctgtacgctgttgtgtcgtcccgccccggccagagcggccgcgtggacggatacatcctggagggtgaggagctggctttctaccagcgtgctatccgcaagtaaagaaatcatacacacaaaagcgaatagttacgttgtgttgttaagttaaaagggctggatggatcggagttagcattttccagaaaattagctctgaattgatggatgaatcagatgttcacactttccagttccacgtctaagactattgaagtagtcaacttgtagttccaactgtatcccgtagtgtaaagttttcattataacttaactagttacttagtaggtaggtaccttgttatctccgatgacgaaacactcctaagtaacttagttaatttaaacccctcccctcatacctaccattgatgtaaccacactcttcctgcctatctatacctcacccccctccctactctactactactatctatcactaccccatacatacactcaccacttcacttcatcacaccccatcacaccagcaacaaccacccacctcataaaatggcacccccaacaacatcaccccccaaaaccatcaagacatccctcctcctcctaagcgacacccacacgctgacccccctcccccccatccaccccaacaccagcacacccttccgccatccgctccccgccacggacctcctaatccacgccggcgacctcaccaaagtcgggcacaagcacgaacacctcacgacgctctcattcctaaaatccgcccgggcgccaatcaaactcatcatcccaggcaaccacgacatcacgctcgacgaaccatactacaagaaaatcggacactaccgccaccgctaccgcaccgaccatacagcgccgtcggccacaagcgggagcgataatgtgtccgcggggaagggaacgcccggaatggcgttaagtgatgatgaactaagggagatcaaggaactatatacggggaaagaagcttgggatgcggggatacggtacctcgaggaagggacgcatgtgttcaggttacagaatggggccgtgctgagggtgtatgcgagtccgtggacgccggagttttgtcaatgggggtttgggtatccgcggcaggttgatcggtataatcctccggaggaggagggggagggggaagagggggcggagaatccagtgcctgattatccgggcgtggatgtgatgattacgcatggaccgccgtatggggtgctggaccaggtggtgccgaatcatatgagtgtggggtgtgagcatttgtatcgggctgtgaagagggcgaggccgcgggtgcatgtgtttgggcatattcatgaggggtatggggcgacgaggagggagtggagttcggggaatgagagtgtgattcagtgtgataaggagaggacgttggaggagaggtgtgcgagggtggatgttagtaaggaggggggcaatgggttgagggttggggaggagacgttgtttgtgaatgcgagtgtcgtgacggtgcagtatcaggctattaatgcgccgtgggtggtggaggtggatttgccagttgagtaggatattactacggtctgaggagttcggttccagtatatagttgatttattcttaatggttggtgtcactagatgttggtgacagtgtggtagttcacttaacgaactgttaatactaattgttatactatgctgctaattctgcaagctacctgtacagtgatcacccgggtatggcatcaaacaatatacatgtacagtccaacaaacgagatgtccaacagaagggagagaagtgaagtaggtatctcactaaaaatgtatatcatgcctggatatgtcaagaaatgaaagtgctttaaaaatgtaataatgttccaaccaaagaagagaagtataatgactgtgcaaccggccggattccaacgctgcaatgcaagacaatgccgatgtcgacgctgaatgaaatagaatgcaaaaaatgatgaatgtccagacattatcaagaagaaagaaagaagtccgcgaggtatcactcctcgcgcacgggcgtctccgtccggaaatctaggcggctgcctttgcgactgacgcctttgagcagactgaaccgcttgaagactgagtcgcgcatgccgctgctctggctaaccggactcatcaattcagggctgcgaacagaattgatactactccgcgtcaccggccgggggtagtcggtgattgaaggaatcgtcgaccacccgcccttatggctgctcacagatgggcgatcatcggcagatgtcccattggtttgagaggtagtctgactcacgctgtcgtgcgacttgcctgccgtgtcgcgagaagcacttcgtgtccgttgcttcttctggctctgggtctcttcagtggcactggcgcttatcgacaatgacgacgcgtgcttatgtagcacatcgcctaatcggctccgtcttttatgatgcgtgtctcgcgactgtgtagtcgtccggctgtgaatggtagctgcgtcatcctgatcgacctccccattgacgtgctcctctgtggttgtaccgttgaccttgctatccgactgtggctttgggtcttcttgcaccgtagacaccgaattgctcgccacgtgattgccgcgcttgaaagggttcatgacgctgattcggtggctgacagactgcttggctgagtgcttgcgactgtggttcttccgcgacgagcgaatcagttcttgctcgggactgagcgcccgcgacgcaggcggcttctggcgttccttgacggactctggagtgctacgccgaggccattgaggcgcctgttcagtctctgctggacgaagcgaagagatctccggcccgaaagcctcctcgaaacggcgcgtcagctctgcttgcgtagctagatgcgccggtcggtggtacaaggccagcgcctgcttgatacccagggcatggtcgatgagggccactgccagcgcattcttcattgggtccgccggcttcggtgtcaccaggccaccctcctcctcttcatgcgcatcagacaagaattggcggtaagcagcaacgcagttgggagtggctgcgtccaagtcgagcaactgttgcaaagcctcgctgaggttgttcaaccccgtatcctccccggaggccgcccgacgctgcaacattgacagctcatgcgtcttgcgccacgtccgttcgagcgccgtatgcaaaggcgacagtgcaacttccttgacctcaaccacctcacttctgcgaaggatgttcgggaaaggctctgcagtggtgtaaaccgttttctcaacccactgctccttgacatccacgtcacgaacgtgtttccgtaacgttgagctgaagtggcagggctccgacaccaggagatggtctcgaacggactgcggaatcttcgaccgctggtagaccggatgatccacgtcgcgatgaacactgacaggattgatgtgcaggtactggccctcataatcatgaacttctccggaagacacgacctgcgcagccgggtgctcccgctgcatacggtcaatgaaagagaccatacgctccgtcggtgcacactcaatgatgaattgcttgtcgcgaagagtggtagggaacccgagtcccttgtattgcacacggaagtaccgcgggaactgcttgctttcctttgaaatgaggtcgtaaatcttggccatggaggcgtgtgcccgtgagagtttggcaaaatccaccacgatgtcttcatattgctgcgcgagttccttatagcacaccagggcatgcgcccaggctttgccatcctcgaagtgttgaatgattgtaaagtaaagggcttccttcctctcgaaagaagtctgctccgggaaagccgggttaagcagctcaggcaaagtccgcttcggatcccaatcatatagatcggcatggaattgaagggccagcccagcctcggtgaagtttcctgcttcggcctgcacctgagcgagctcgtggacgtagcggatgaagatatcctcacgacccatgtctttcatgtacttcatcagccgaagagtgtgcaggctttcggccatagagcctccttgagaggccacgaagaggtcgagcagctcatccaccgtcgcgatcagtgccttgaccgcactggacaggtcttcgtcgtaatcagcagagtcttcaaagtgatctgacagttccgcgataaacagtttctgcacgacactttcgctcatgttcttcctcttgaagaggttatccaagctggatataacctccgtttcgataatagagagatcctggttcagaccccattcgctcagaatcatcgtccgtaaaatgtcgacggccacgtgccgtaatccttcgtggacactgaggcaaagctcaatgatgggtgctaccaggccaggaacatactgtacctggtaaccgcccaatttactcagcccgtagtgctctctctcctcatcagtggtctcccagccgattgattcccagctggaatgcagcaggtctgcaccctgttcccgaacatcgcccgcgatcttccagatggcgcgtcgtttctgctcggggtaggtctcaagagcaagagcatcactcgagacaaccttgagcaaagtcatgaagaaagtttcccatagtctcgtatcgaacgtttccgcatcatccggggagggaaggaatttattggtcaagatggttgccagatactccaaactcttgacggtggcccggtggttgtagacatgaacgctgaaccagctttcggggtacgcttcgcagttgagaatcgagttgtgtacttcgaaagcctgtgtcaggaaactggagagctccaggcccttcagccggggtcgcttggggttgggtatcgtcgccgctccagccagaacggcggacagctccaccagcgcttcgtcaaatttctgagagtgctttgaagacttcacctggaacgggaatgatttgctgaagagcaaagaaaggtaggtcgtctcctctacaccgtcagggatgatggaatagtatgaggacacaatcttcggcacaaactcgtacagatacgggtctggttgtttcaacagctccgccacgatcgcgcaacacagccggacctggtcacggtagaggtccgatacggatcctgtcgcaccccagtaaggtgccaaccagctgatacagctggagacgagactctttcgctccgatccggagccaaagatctctaagcgagtgtagtgttggatgagaaccagcttatagagaatcagcattcccgtgacatctttgcatgaatcgatgaagctgagcgcaatcatgatcgtctcatcacggctgagtactttcgagagctccgggagccaggtgtggaaatgctgaaccacaagggttttgtttcccaccattgcaggcgaggggttcttcatcagggcctcgagcgacttgaatatcgtatgtaaatcccggttgaatgtcgattgtactctagtgattccgataccctcctctttcgctttctgctgcagtcgagcattgatgatgaacttaaggacatggcgtcctaccttgaacgttgcacggagatttcgcgactgctgagcatcggaactagcctgaagaagacgtagatagcttctgacgagacatggcgtagcgaaagggaagttgaattggttgtcggcgtagtgatcaactaatgggcccaggttgaaccgtcggtcgtgaacaataccaagaactgtcactagatcgttgaaaatcaagtcttcatactcttcgttacctgcgttttccaccagaattccgaagagcgagtccaagacgctgctgagctgcttcacaatctcgatctccggcacaaaaaggacacgcttgagggtatctaatacttcgttcacaggcctttccctccagttcaaaaggctgagtattacctgatcctgcgaatattccgtgctgcatagatgtgtgtccaatcgcagggtagccaaaggaccggtgattgcctcgtctttcgctgattcatttttgcccagcgaactccatggtagagagagataggctcccttgccgttctcaatattcgacgtacacttgtcgtaggcatgcaacaggagcgaatgagggccgtctcgcatgaaagcctggttgtcccacagtggcatccacgcaagtgcaaagggaaactcgggcgcatctgcaatactcatgatcaagtgcgacccagggatctggtcggtggggatgttgagacgaatggtttggttccaaggtgcaccccgatcggctacggtggtgcgccatgctgtctgtgcggcatggttggacgcggagaaaacgcaccgatcaacgcgcgcgcccgacgatgtgcggacctcaagagttagctggaggttatgaagtccagtatgccctggaaccggaacttgaccagattgcggatgtgaaagcagtgcttctggagggaaggtcgcgtgacagattgtcacgtaaatatcagaccgaggttttgttggggcctgggagaagcccatcctcttcgtctgaacgacattgtgcaaggatgtgggatttttccgaaccagactatctgcgtcggggtccacataggggtagaggtggaaatgcagacgagcagctcgttgagaacgcacatacttgccagtaggactcggaagtaatgtgcgaacaacaccatcaaagccatcatcccgaccctctttgtcctcgctgtcctcagacggagaccagatattgatcacctgctccgcgtccttctcctgacgcagaatctgcgagatttcgaggaaaccaactcccacggtccgaagctgagtcgattctttaaccggttggctgctagccttttccttggcacttgcgttgcttcccgacgatggaggcgcagctttactcggctcctttccttgttcgggactttgaataccgcgtggcttcgaggtccacatcatgctgcggcgagtcctgagactccccttgactgattgattaatcccattttgctgcttggtaccagacgagctgtcccgcgagatggaagtcctcggctgggcggcggcgctgacgactgatgtagtttctggggcgcgaaccatgacgaccatgtagagtctcgggccgtttgcagcgttgtcgccaatatccgtgctgcttaagtcggtgaacagcgttttcaatttggcgctctgtcccatacttgcaaacttctctggcgaaggaatgtccagcacgtatgtctcggaaaggggtgtgagagccccagtctctgactgggagcacaggtagacagccaatgttactggcccgggcgcatgtccagagacggcattgacttcgagcatcagatgatggagcgcagcggcatctgattgctgcatggggctgctgtcgagcatgctcatctcggactgtagcctagcaagttctacggctgagtcctctccagtgagcagacgccctctttgctgaggatctctcacaatgatctcgccacccagcgctttgttgccgcgaacgagcttccagaccacttcctgtcgcagcgcatccttctcttgtgcggtgagcacattatacaaaagctggcgccttgcgaaatcaagttcttcgacaatcttcgtcatctcctctaccgtgacatattggcgggagagtaatagctgatgtaggttggtcgaatgccattcgcgtagacaggaagcgatttcatcgacgagtggctcggagagtgaggtgggtgtttcatcgccaatcttgagcattggcacaggcgcggctggtttgggtgcatctgggtctcgaggggccacgttgatgggggcgagcggcgtcgaattcgtccgtaggaagttctgaggagagcgcgggctggccgggcttccgcgcccatcttcgtccagcctctggataaagatctgagacggctttccttttttcgcgattacgacgctggatacttccccgaacgcgtggtcatcatcttggaaggaggccatgctgtgacgcacatctccctccggaaccgccgtgaaagcgacactcgatcggtcgccattggtaatcgtcttctctccatcacctagcacttcgcggatctcgacacaattccggggaaagattccggaaaataccctcgcctcaagggtttggcccttggagctcgtcaggcccgccagcaaggacggcggcgcgacgaggtaaccacggcaccattccccattggcaccaccttgttcaattatatacagctcatcaccaagctccagaggcagatcggccggggtagtcggctgaaaagggtagatagcgacagcgaaagcgattcgaggcagaggccgccagggcatatctgcgatcgaggcggcgctccagagcacaccccgccgcggcgttcgtcacaatgggcgttccgaggaatgaaggagtaccgatgaagcggggccgaagggggtgaggggttcagatctgacagttccttctgttgattgatcggccgggggggggcgctacatgcaggtatggtatgagtagaaaagggaggaatgtagacggagtttcgagatgcggaagcgcgaattcgaggtgtgccttgcgaaattggtgtcgtgctaattaagatcaagggggggtttatggagggacgactagatggccatcaccaaatgtgcggttagcgagagaaagatcccagtaagcgaaacgtaggcgtgctttgttggcgtgtcaaagtcaaagggagggtcatgataagcggaggagtaaaagccatccaggaggagcgggtgtcgcaaagggtctcagtgaccggaaacaccgtagcaattggggccagcggattcttagtgaagtactagtgaccgtagctaaagcaagaaccgtgacgaggagtacaccagcaaattgatttcctccagcttcagtcctccgacaattttgtcggcaggcccccctagcagtggaatgggagtggagccgagggagttgttcacttggcaggaactgtggagaaggcacacagatgaaacgaagggaggggggtttaaaggaggaggggagggaggaagagcttacccaaagctaaagggaatataagagaggaagggaagaaggggagggggaaggagagatgaaaatgaatgaatgggagaagagggatgatagtaagagccacaaaaaagaaggagaaggagagaggaagaagaagaggaagaggaggtatgatgatcgcagaccaaatgatgcttccattgaacaggagagcctgaggatcggggcgggaggcggagagagagagacagagagagagaggcgaggacggcctgaggctagaacactgctggagggaaactcgactagcgattccccgagcaggttgattaactttaattgatcgttatattggcttcgtcattactgatctcatgcttcaaacatcggtaggttcataggaaaattgaattgagcttgtctaccactaactatctctatactatcccacatatcccacgccctccttttttggggttgtgtccaaagagttgcttgtgcctggtccatccagcaaacggatctggcacactattccagctcatccatgggtccaatcccgaccgatcgagtacaagccagtgaaagtggagagaatgctgcgtgtatccaagtttcaccggcacgtttccttcgttcgatttattttctttttcctaggatcatccatcccgtcagaaccgagaacagtaaaaagcaaggggacagtcctcccttccttccattgcggtccgtgaacttacaatagctgtgggatatagatagtagtaggacttaacttgggacctgtccatgtgtccagaccgggccctgacccccaatagattgtcataacgctcctcccattatctactatcttataattagatgatcaactcactgattactcgttacaaagtagatactaggcacggaaccaggctgacatgttacttccacccagcacagacccagcgcgtggcccccctgaatccagggctataaaacccaactaaactaagtgagcgctactaaaaaaggttcgagatggagttggagcagctgcccgctgactggtccatcctgatgggccgctaaattggtctccctcgcttttcttttttgagaggcgtttctctgtccctcttcggtgatgatctgcctgttgccagtatcggttcctttgatcgttcatcattactctcgacaattgatgtagagcagactaactagctactccacgctccggttatcccccaatattatagatgtcaatcttataggccatcccttcatattcgatggagttcgctttccattctttcgcctcacttgagagatctggtacagcgcccgcgctggatcgaaatcttcctaaagctgcttcccgtttctctcaacgtcgtttactctttcgtcccaccagaaccaatgtaatgcgaccttagcagtcaggttatcaattacattcctcccttccattgatcacaggctatagatacatcaactggtataagtacttaagacagaaagcaagaagtgaagaacacagggaacaatgcaaagatccaacccatgcgcccgtttgatgatgcgcaaaaagaacaaacgtcctatcacatccacttcatccaaaaacccttgccattgacaggtggtcgtcatgatgtgggaatagaccctgaaagggattctggccacacgagtcagacaagaataagagacaccgctcttcacctctggaacatggcgatggcgtcctccttacgccactcaagctccaactggccttcgtacaccgcatcaataactcgccgggtccgattgtacgcttccccataccgaccctcgcactctcggagcaccttcaacaccaagctccgactcaggccagggtcgtctgcgtcaccgaaatgcttctcgacccgcttcttcagcatctcaatccctcgccgaatttccttggcatcgtacgtcgccaacaccttctttgccactgatcgggagtggctaggtcggctggcaatgtcggcggggttgatgcccgtcgccactagattctccaccgactcaataaactctagcagcttgcccagtggtcggtgaatgatggagtcgaggtaaagtttcagatgctcctgcatgtcttgatgcgcccgatcgcgccaccgctccagcacggggaggctccggacatcgacctcctcgatgtagtggttcatgttttcaatgagaagaatgtggtaatttaagatttccttatcttccgggtctccagaagtcgctgccgcccccgtgggttggcccggcgcctccttggcgatgaacttgagcgattcccacatggcgcggttgatgcgatcgtaggcttcgttcacattgacacggatgtcgtagaattcttgcgaaagcatgttctccacggccgtggagaagtgggggaagacacgcataaacgaaatcactcctttgcgcttatttaccttgaccttggtctcctcgattccgcgaatctggtcatcgacaaatcgattgaagaggccaagcaaccgggaatggagtttctgaagggagtggataataaagtcctgattggtgtcgtcatactccgaaatggccttctcaatggccagcaatattccaattccttgtctacatgataagagtcagtccgtagtctcgttagaaagcacatgggagtttcagcttacagcggatcagctctgatggcccagtccacaaggttttgcatatcagtcggccaaaatgcgaaaagttcgtccatgatctgctcaactttcttggccatcgctcggtcaggatcatgcagctgtttggagccgaaactgggtatcctgcgttcatcgggagcacctgacataactaggtcggggaagtcgacggtagaaagcgagttgagatggaagaagtagacgatgaaattctgctcttccgagatcatatgcagggtctcttgaagcgtccccccaaatgcttcgcacggttccagcttgccatgctgcttgtcccctgagggaagccggagacctgctgcagctctaatggtcttgcctcgtcgcactgtgagtttgcgcgccgccatggtaataccttcagattccttctccttctcctggtgagtaaagaggagttcctgctcctctccactaggcttcctcgccgccttcttccacgccaggttgttgtctcggaaatcattttggtaaggatgtttggcctgttgctcatacaggttgatgagcgcgtgccactccccggaactaacttcccgagcgaagaggatcacagcattatactgccacaattcgcgacggcagtagccacgggcttcgctgtcgagcttcaggggatccttctgaccattggcagccgcatcaattctcttctgttccgccaccttgtacgcaatagccatgaattgcttaagtctttgtaagaacacgcgagcatgtgtgcgatattcttccttcttttcttttatcgcacgcatttggccgatctctgtgtcggcatacacgcccaggctgccatggtctccggccgcatcggcaagccgcctcttgttgtgccagatgtcagaatcaatcatcaacatcgctttgtacaatgtagatagggcgagttcggtgtctcggaggccatcgggattgctcaatgacgactccttcagagcacgaacgtcgtccgaagaaatggaaagagtccggagcagattttgtagctcgttctgaagcaacttttggttggccgtttgcacctgtagaccctgggattgcgtttcgatataagccacgtcatcgtgcagagtctgttacctttgttagcatatcactgaaatggtggacgatgaaaccagcgctcagggatgcacgggcaacctacgttgagctcatgggaatacaaagtaagaagattgtccagctcttcacactccacgactgtcttgtcgatgagtttcgcaagttgatcaattttgccctcctgctgttcaaggttaccaagccagctggtagtctccacgcgaccaatctctcgacggatatctgcctccaaatcttcgatcttcttttcgtctcctagtcgtccgttccagccgaggtcagtcaaaatatcgtcaaagtcaatgccacgcccttcaagaacggtagggttgagtccgagtgcttgacaatacttgattgtgttgtcctcatgccgcctgcggcgacgatcatgcggtgaaggagatacggatctcgacctttctgtatcaactttgacagaagcccttgacgtgtctctcggctctgcgagtacctcagtcgaaccaatcgtaggctcaacaggagcagcttgtgtcacttcaactgcgggcggctcgattctcgggggctcgggaggaggctgcactgctggcggtgctggcggcgctggcggctgcacctccttctcaggggatgacgatactactggaggagtctctgcttccggagtctccggcgaggtcaccgtattttcactgttcgtccgaagcaggaatggagcaggcaccacgctggtgattccatccggttcatcagcagcagccttctgctttttcgcagctgctagaagcctctcaccagcaccaccaggcctcggcttgaaggccccgtgagcagtggcagctttgcgaaatgcgcctgcaacatccttgacttgcttcttcttgatcatcgggccaagcccaggacggtgtgcatcgggatcgttttcttccacaggctcagtggcctccaaatcgctaggaggcggtggtactgcagcagcagcagtttctgctatcggctcaatcggttccggatccttcgtcaaaattgacagtgtcggagctgtgggcaccggcgcctcagcagactcgacggctggtggggctttgctaaatgctgaagagcctggcgtgagtgctgctggaacctcgacagcgggagtattgatggggttgctcgggggctcaggctcctgtcgcgctgctcgtgcgggcgaaccaatgggcttttcggctgcttccctcaagggcgatctgggacccacgctgcttcccggactatgcataaaggtatggttttccccagaaaccgacccaggagtagtaggacgaagaccgtctgtactgcggctgggatgaagatcatgggtacgaagtgtaggcctggactcaggacctttccgcccatcgcgtgaggatggtggacgggagtcagggaggggactccccgacctggcttcttcaaagctgccatttggccgttcccgctgaccagcaacaggagcggcctgcaaactagagggatagtccctatttctcggttccggtggagagattatgggcaccttgggcaccctgggttccgtggcaagacgttcggctgcacgtggaggtggttgttcgcgctggtcgggaggcaatggcggggggtgttgaggggggctaaacggaggagtaccgcttttaccagactggccagtagacggtctccccatctggtcacgacttctttgcgctcgtaggacatgttcctcagatggtgctggtggtggtcgtcttggtccatcgcgactgggcgcacggctagaatacggtgactgaggccggctgccctgtgaagaggaaggccgcgggggaggcagggccacttcgggacgcggaggacctgaaggaggagggcctttgggggctggaggacctgcagctgatccaccagcaagcagctgtcgttcacggtcatcgaagccgatcagagtcggcaccttgccgccagtgtactttctgtagatcttgacgaggctgcctatgaaaaaatccttctctttggaggtccgtgcatgccagtagtagggctttccaacggtaacgataaatccaacattggcagcccactgcttgtgttgttgttctaacggcgtgctcgggaccaaggcgttgtaagactggatgcaggagagatcatccaacatccacgtcttgccaatagagaatgagccatcattgttctcgcgcgccttgtgcatgcgcactctgcctgaccgtctgacggcgacaataatcactcgaggtttcttgttctcgggcggcgaattgggtggagcgggggtggacggatatgccgcatcttccaaaatgcggacatgtgttatgtaggactcgaccactagaagagagaggggaacaagtcaacctgacacccttttaggagaggagcgtgggagaaatgtacgtacacgagccatcgctgtctttcttgccaaaacagctatgaatgatccgccgcttctcatcctcgaatttctcggccctcgacatcgaggcatccccggggccggcgttaccgccattgcgactatcaccagctcgacgagggtctctctggggcggcatctcgccaggcgggggacctcgcatgcgatcacgactactcatggttgctaatcgatctccgaaagcctggatcactcaggaggtgttcggggatcaagtggacatggtcgggaagacgggggcagggatcacacggagcgcgcgccgtgggcgaggactgggatggtcagtcaatcggtaagctccaacaagcaagaccgtaattcattcaaagagcagggagattagtgaaaggcgacgccatacacgagttggcgcagaaccgagttccaaaatcgacggaaggtggaggaggagaagggagccagagaggtgggattaggtcattccttagccactaagctaccgttaacttgggagggtgtgagagcatgggctggcggctgcggatacggcaccgaacttagtctcggcggaggtggcagctgttactatgcagttataaacacacccctcgccagaattgatgaagcggcaagtatctatgctatatctatgccagaatatatatatatatatatcttttactgcagttttcgcatttaggagagtcacagtacctgctcctgagtagacccctataaaccacccgacacattcgagctcgtacagcataattatgtaatccgatagaggcgtatgcataaagcgggcacggcccacttcggttgcctgtgcataagcaactaactgtcatgcaggatggcccgattccaattttggattcagtgtaacctcacttcttgtctcaaggaatctactacgagaattgcccagccgcagtactaactctggaatgcttcatatatcggtatctaacatactcatgcctaaactcctgttacggtaggctgatccagcttattggtaccactgagcttactatatactacgttgtgcaattggaggtgagggccaaactgagagctacaactgagagcagcaagtaaaatagatccaccaccactgcggttttgccatatcgattggcttcccaagaacagcctgctagtatgcagcctcccttgtataacccatttcacacaatctcacttaccatgcactcgtgccgtcccggtctgtccgctgtgaggggattcaatgtcctgtagctgagcaacaacgagtattgtcagcggaccttaatccactactggtataggggagggataatggcgcacctaccgggccggtgaacgtcttcctcttccctccccaccacccaataccaatcagagcaacaaaccctgcgagtactacactcgcataattcatgtcgtgtaccgtggtcggtatctttagaggcaaacaaaagaataccaatatgactgccacccagacaacagcaacagtattacagaagagtccaaaatactttcccattgcgaaggctcttctcccaaggacggcgtcacgcccacgaagcagcacgattgcttgcgggactacatagcagatgttgagggcaattatgactatcgatatgaaactgtcaaaggctgttgctgagccaatgtatatcagcccgtacagacagatgaacacacaacaacccaatgtggcgttcagcggcatctcgtttgtgatcttaacgaagaatgacgaataaggaagaccaccagctcgagcgaacgtgtatgcaagtcgtcccgcagtgagtagacaggacaactcggctgcgcaatagaagaatataacccatgcagtgaaaagcgtggccacgactgggctggatgttgcttgtaagtatgccgtataaatggggattggggaagatgcaacagccttaagatcggttgtgcagaaaagaatggctatcgcgtatggaatacaggttaccatgccagtcagcacggtagccatcattgcgcgggggatattgcgaccagggtttgggacttccttttcgatgataaaccgttaacagcgagctgaagaacgaagccatatggcagcagaggaacttacatctgctatatgggtaacactatcgaccgttatgtatgcgtacatgcatgtcccagcgcctatcatgaaggctgtcccgtcactccagcctgtatggttttcataggccaagaacaaagtgtgcgcagactgtttttgatcttgcattgctaacaccgttatcaaactggtgccgaaggtgagcaagctgaagatgatgatacaatcctctataagtggaataacacgaggcaggtagcatacgaccacagtcgagaggagaacgatcggaagatagataagatagattcgccaggcagttaccgtgacgctcggacggtggacagtcaccagcccattaatcatttgcgcttctcaacagattattcccagatcatacctagaagaactcatgtgatagaatgaggaaagtcttaccacagactattccgttggatgtagacactgtgcaccaggagatcatagtcaaccagccaacaacgaaagaaactgcggcacggtgcttgggcgctgaaacgatgaaagcaaaatgatatggccctccgctagtgggaaatgcagatgccaactctgcaagacccgcagctatgggcaaatggatagctaacgacatctgctagaatgaggtaggacgtgcttactgataaaacaacacgctatcgaagcaagaaaaaggccaaagaaagccgtcgggccccctcccatcaccaaaggtatcgataggataccagcgtaaccagcccatgaattggtgatgctgtatcccaaggccaatgtcgacagaaatgagaattgacgagggagttcagcacgggcagtgccagggctttcgttatcagacatctcggcagctgccttctggacccgagggggaagactcagcaaagacatctttcgtctcatcatatgaaaagcaccttgaaaatgccacatgattatatagatcgtaagtactggtataaggttcaggttgagttctactaacaacaaattacaggtaataaaattgacatgtggtacgcaacgcgaactacattgggtgttaaccatccgcgaacgaataagatgatgtttatgatgttcaggtctttagacatgcccgcaaagcacgatagagatctatcaactaaagtggggatgattgacttgtttagaaggtagttgcattacgtccaggcttgttgcacggatagtcatgcaggttactttgcctgcgcattaccctactgggaaatgtagacggcacaatgattagtctatcctcgttactgataacgcagactttccaaagatcttgggttatgtcttcacgcaggcattgaaaatctccgaagtcgcaccacggagcttaccgtctagggcacgtgtactttgtggcgagattaactttgcaatgtcgtacaatacctagggatatgtcataattgatcaaatggagtccagctatacaatgttcgcgataaaggcaagatagggcgaaagatcaattgggtggatactaatagtaaaccaaagatattgagaactaaggagagagtatcaagttataaacaccacatcgatagtgaaagtggaagacatatcaaccccaacactcatatagactaaccaatcaacgaaaaccgcgcggcttcatctgccgtagaggcgacattccgcacagtccaatcccacaagtcgtcctgcttgttcacatcataactctcctcgctggagcggatctgcttccttccctcataataaactccactactcgacgaagcctccttgccactcgccagccaagccagattagccccagacgcctgcggcagcctgatattcggtgtccccagcatcacacgcaaaagcggaataacacgagggaaaatcacatgccagagaaagcgcaagacggggttcgcttcacggacgagcccagtcccaggcatgagaccaggatcaaacgcaacaacagtccacgacttaagcctcgcatctttcgactcactgagacgccgatgtagcgcgtacacccaaataacgtttgcaagcttgctggttgagtaacgctggcgaccgggattctgggctgagctctttgtcgggtgagcgagatcctccgcactggtgtactttgcgtcggggaggccggtctcttgtgccggatcatgtgtgccgctggaggttaccactatccttgctgtgttggcgaggtgaggaaccaggagtgaaaatagaagggcgtggccgatgtgattgatggcgaaggttttttcgtatccgtctactgtgtactcaactggaccgggaaactgtaggcctgcattgaggagtaggtattggatgggagggtatttgttggtttcccattgctggacgaaggatcggaccttggataagtcggaaaggtcgagtcggaggtagctgacgttgctttggcccagaagtttgtttatagatccggcagcatctcgagagtcagatcgagatgcaattataacttgataatcggggaactggcgggcaagttctatggtgcagtaatagcccagaccggcggtacctccggtgatgaggatgcttcgcgaataggacatggttgtcaaaaggaagaatgagtttgctctctttctctgaggcgagctgatgccatatttatgtttcaatatctcggcgttaggaacggagatatacaatccatgccatcaaaactatgaccctatctagggttggatgaggcagcaatgttccgcttcgggaatagcgggaacggcaccgtcgatatctcgaggcgcccatctggaccggccagtcatctataagaccggccttgacttgaaaaatccgaagcaaatcgacgctgccgttccatgctagttgatcataacagctgtggccgagatgggctgggctgcaaatatcgcatctccgtctcagccggatgacccggccccatcccagttgctgcactatcttccggattaccaggtcgtcatctgcagtgcctgccgatatgctgtccagcctcatgggattttacgtcatctgaaagagattcatcgcatacttcgtggccgccggcggaagtactctcattacgttgccagcctttcccttagagagccaaacgatgtcataccccccagtggcgctgatcagttcccggtcccatacttaccggtcgagcccggtcttcaatgccagtcagctggttgcaagtacctatgtgcttctaataagcgcatgcagtcccactggagaactgtgcatgggcgaaaggccgattgcaccacagactggcgtacagttcccctgcagactttcttccgcggcaatcacctgcggtacttcacttctgagggtgcaaagaccaatcatgctttatcagactctgtgtttgggggccacacacaagagttatcagagaaccagctccacgcaggcctggactccatggactctgctcttctggaccactacctccgacacacataccaaagtttcacaaccaaccaagagacagacaaaatatggcgcctggttgttccggaactagcatataagaatgtgttccttttgcatggcctactagcctgcacaagcttgcacagagcgcacatgagctctgggcacaccaaccaggaaaaggtattcctcctaagagcctaccaccaccaggagattgctctcccgcagtttcggtacgctattgagcatcctacggaggataattgccatgccattctggcatttgcacatctgttagtggtatactcttttgccgccgatcagcctaggtgctcaaattcaaatatgggcacggactcattgttcctagtggatcggaacagtggcgaaggcagtcaaccggatagtattctctgcaaatggctatactttctccgcgccggctgctctatgctgtgtgaagtatgggagcagttgaaagaggggcccgtcaaagcactttcggaggcctgggacattgacctaggtgacgacccggatctcccatatctggagctttttatgtcaatgattccaaacgaatcagctaccacacatgaaaccggcgatgtcactgagaccagtctcgtttggcccgaagatgtgacggccatttaccgacaggctgccattgaactgagccgatcattttcgtacgtgcatgcccaccgcggattacttactacttgggatgttctccgcatatggcccatggaagtgtcgctagaatacatggctcttctccaccaacggcacccgggagcacttatattgctagcgtactattgtatcctgttgaagcagatggagagacactggtacttcgaagggcgcgcggcaatgctaatctgcgccattcagagacatttgaagcccgagtggcatgttttcatccgagagccattgcatacggttctaggagtacctgatggtggccatttccttggggagctttagccgcccctacaagcagttgggggagcattccgtgtcagacggcgtagatttgatattgcttccatcagcagattataccattcacgggattcgccgctaaaaagccgtatgaaaaagaaaaaattaatacgtcagggattaaccttccggatgcgtcaattacaaatttgacttggttttgacttcacccttaatgggagaaacaatccaccagccttcggtcgagtatctccagtgcctggcacgtgaccatattgtttcacggaaccagagtcacgtgggttccatgtaaaaagtcagctgagcaatcacggatcgcgcatgactgaccgcctttgatctcttctgctgttttttctttcttttttttctgcctcgccgataaagggaaacttgaaaacatcccaatcaacttcgtcaatttcacaatttgcagcgtttttgtcagacagtcatcatggccggtcagaagtctaagcaggcgaagcccgccaaggcgtccaagagcaaggagactgtaaggcaatccgaccgacctgtttgttgtatagataggcaatactgatcaagttcatgaattaaccagcctgctcctcccgctcaacttgtcgccgctctcagtgctttcttgagcgaatctggtttctccaagaccaaggaagctttcaccaaagaacttgccagcaagtcgatcgactctgatgcgaagaatgtgccgtccctgcttgaactgtaccaatcctgggaaaagtcctccgagaagtcctccggttctagctcttcggacagcgacagcgacagtgaaagtgagagtggaagcgagagcgatagcgaaagcagtgacagcagctccgacgaatccagcgattctgatgtcgagatgaacgacaagtccgagtccgacagcgatagcgactccgatgacgaggaggagaagaagaagcctgctgctcctgctgctaagtcccagggcaccaagcgcaaggccgagtccagctcctccgagtctgattccgaatctgaggccgatgaggctcccaagtcgaagaagaccaaggtgacttccgccaaggaagagtcttctgactcggactcctccgactctgagtccgattcttcctcttcctcttccgagtctgaagagtcctccgactcggactcctccagcgacgactcctccagctcctcttctgagtccgattccgactccgattctgattcggactctgactcttcctctgacgacgaggacgacaagaaggccgataagaaggccctgaaggctgctaccaagacccctctgcctccgtccgaatctagctccagcggctcttccccgtcttcttcgtccgactctgacaccaccggaaccgtcagcaactccgactctgcccccaaagagcagtccaagtctgcccagacatcctactccagcagcgccagccctgctcccggcaatggcccccagaagaagaagcacaccggtgctcgccccactcctctggctcagctgagtgagctccccaccgaccacctcctctcgaacgactacgttccctacgcctacgccgagaaggcctggcaggatctgtcggtcacccgcggcaagggcttcaccaaggagaagaacaagaagaagcgcggttcttaccgcggtggtcccatcgacatctcgggtggcaagtccttcaagttcgatgactaggtccgcgatactattttagagatggagaccagtttcgcatcctgatatagggggacaactaaaacatacctacagcttttacatgctcgaaaacatgggtattcaaaaagttttattcgcttatgattccatccatatagatctatatgcagcctagatgggtcactgaatcattttctacagcaaggcgctactggagcccggtcggattgctttctttcagcttttctttttgcttgttgcttcacgcttcttcacctgtatgtactatctacttacatcatctagatctttagaggtgttaaacatgtattcagatatccttgcattttcatgttaaccctagactttgaagtattcgtacatgtcgtactcgtggtggtagatcgtaggcatgagtctcttcctaggatcgattcagattcatccatgcatcctgtcatgaactacagtccccagtccagccaaaggactatacccagtcaacaatgcatggctcatgcgtttccaatggaacaagtctcctttaaaacctctctgcgcaacatagcacggaagagagcacccagtacacacagcatacacaagccccatgcccccttcctccaatataaaccaacatcctctcccgatcaacaactactctcctatcaatcagcccgtctccacgcccccggtttctccaacctctcccacctccgatcccaccccgtgatctcctccgcaagaccatcctccaccccgacaaacacaaacggctgctgcgtgcgcaaagtgatagaagcagtagtatcctcagggcgctcgtagcccgataaatccaggactttgtcggcagagcgggtgtgtgcaacagtgttctcgagacgcacatcgttagagagcagaagtggctcccggtaccaatcctgacaagggccgaggaggtcatccgtagaggcgaagtcaaggcgaacgacgccatccgcgacgccagtgtagatagttggtgaggaaggggagggcgaagtcatgctgtagattgcaccgcggtaggagcgggtgttgtggcggcgacggccttggggccggctagagggagggtgggcggagaggaagatggagatgtctttgcgggggaaggcgatgctattgttggttgcggtgagggagaggcttgagaggctgtctacgattggttcgttgtttttgagaagggttcgggaagggcgtgcatcacgatagctgtatgtgtcatgtttgggcatgcgtaaatcaaagatcttgactagggcgtcaccgccggcgccgacgacgaagcggtcgtggccgaaggggtggatgcagtagatggggttctggtccgtggtatcacggtaggtcttttcgtattcttcgtttgagcggaggtcgtgcagtctgagagtgttagcatagagcgtggaataatggcaaatggggtggttgtacctgatagctcgatcaccccaggctgcgaggaagacttgtccggtgggatcgagtggagcaatggcgttgacgttggatctgatggtcgtatcgagattaagtctttcgaaatctaccagctccacattgagctcacgacttggtgatagaccttgtggcgtgatggcggagatagtaattgcatcgtggatgcgtcctgtgccgactgcgaatagagagggcgaaaggaacttggaatacttgtggcgagagctgatggttgcattgttgctagaatcagcattgagacgagcaaatgggtagacttccgcctctccagaagtggtgctgaagaaagatatcgatccgtcgctcaagtgggcagataagatcgggtcctttccgtcactcatatctgttctctctatgccccctccggaagtcatgaaccgctgcttgtaaatatggcaggcgatattagggtcgatagagagatggaaaagctctccgcgcgctcttgcaacgactatatgttcagtctggggctccttggaagggtgtccaggacgtagaatatggacaccacagatgtcatcatggctgctgatgtgatcgagatcattgaagaccacccacttcccctttgaattggggccaggttcagcgatgcgcagaactagttcatctgccgcgccccaggcgagcacctccttccggtcgttccatgaagagccattccagacttcatacgagtccaaagcagggcgatatccatgagtaggattgtcacgtcgtgttgaactatgggatccgaccttgactgcttctgaggcaggtacgacaaatcttccgacgactgcgtgtttgtctaatgcccgagagcgagatgtgagtgcctgagcggcctctcgccagatttcgggcgtttccacaccaggaaacttggtctcgacgaaggatctgaagattcgccaatcttgagcagcgacaacgtggtgtaggcgccagcaggtccttgacagattcacaagcgcgctggcagatggcaaatagcttgtaataagctgtataatctctggaggaagctctgcaagcatattgcgggccaggataagactgtcttctgtgctaaagtagataaatcacaagaatgacgtaaaaatctctgccgtcacgtgtgtcagtcaaagtgagttgtcaagattcacgaaggtatagaggaagattcacacatttactgatctaagcaacaacaagggaatgctctaggaaaggccaggtggaggtggttgcatgaaggaatcgccatggcgattctagacattgtgcgccccgtcccatctatcgccgcggtaatctgcagaagtgcgtgaggccatcaacgtgatccgtgtatcaacattctttgctgtagatatgtttgctaagtgttagaataggctagtgactagtacgcaccctcaaaatgaattgtgaatgctatgctgtgagagatggcacagcctgtagatgtggatggtggaggaaagtggctggagaggccttatgtcatccggtatcttatcgctcctcggctcttcttggttcttatcggcaatccaaactttctgagtggtggaggccattcatgaggagttggagaagctggtgatagacgatgttaccccatcaatgctgtgactcaggctcttcggctatatatctgggcctatcccgggctttgatatgtctcctcacatctagcccgatgtttatttcccctctgcgtggagtaggcctctgccctagttccccggctcattcctagcactcttctttattcatcaaccactgggcttgcggagtcaagcgaaacttactcactgctcatatgacacctcgagagtcccaggttctttgagctgagtgacgataatacaactatactccactcgcgcattgactttaaaatttacatctccaagcaccggacaacatggcaatctcagccgttactcttgcggccaccagcttctgtatcctgctgctggcgtacaaactgatcatataccccgtcttcctgtccccgttgtctaagatacccaatgcacattggtcagccccaatctcgccagcatggattatctggaaacggtatagggcacagaacaataggaccattcaatccgcacatgtaaggctagggcctattgtccggcttgcaccatccgaagtctccgtcaactgcgtagatgggggcatcaagtctatctatacgggtggatatgagaagcacgagtggtacccccgtgtattcggctctttcgggtaagcatgacccccacagtgagtgcatgcgaggactatactgacagctctactctgcaccatggtagaaccgttagcatgttcaccatgacaaacaacaaagcccactctacccgcaaaaggatgctgtccaacatatacagcaagtcattcttgcaatcatcaccccatatccacctcatctccgagacaatcctgctcgaccgtctcctgcccatcatccaagatgctgcctcctcaggctcacccattgaaatgcatgatctcgatcagggcattacaatggactttgtctctgcctacctctacggcctagccaacgggaccaacttcctccaagacgaagctttccgccgcaagatcctccgcctctaccaaagcagaaagccattcgaattctaccaccaagaagtccccaacctcgtatcatggacaaaacggctcggcctccgcctaattcccaaatggtgcgacgaggccaacgaggtcctcgacgcctggggcctatccttctgcgacaaagcagacgaatgtctcagctcgacccagctcaacacagaaccaatggtctacaaacaacttaagcaaagcatatcgaagcagctcccgcccaaagaagcagcatcctacaacaaactcatcgagcaacaacgcctcgacattgcctgcgaactatacgaccacctcacagccggccacgaaaccagcgccgtagccctgacctacctcttttgggaactctccaagcacccggacctccagtccgccctccgcgaagagctccataccctagaacctaagatcctgtacccccgtccatcatcctcccgagacctccccacccccaagtccatcgactccttgcccctcctcgacgctatcgtaacagaaaccttacgcctgcatgccccgatccccgggatccagccccgagtcaccccgtcccctggatgcacgctagttgggtatagcgatatccccgggaacacgcgggtcagtgcgcaggcgtactcgcttcatcgcaatccagaggtctttcctgagcctgagacgtggcagccgaagcggtggctgaaggattgtaatccgtcggaggtgctggaggaaaggagacgctggttttgggcgtttgggagtggggggaggatgtgtgtggggagtaatctggctttgcagggtatgtataactctcataaagttggttgttgttatggtgagatgaagctgaccagtgattttagagatgaaattggtagtcgcggccatttacaccaattatacgacggctattattgatgatgaggatattgaggccattgatgcatataccgtcaagccgaggggggagaagctggtcttgaagtttgagtctgttgcgtagttcttctatgcgttctttcgggtagctattgtggtatataatgtgtgacttcctgtgcttctttactattctattgcaaatccagcagtactcaactctacagagcaatacaagaccagataagtcgaaaataattgatagcatacaacatccacataatattatacaaaaagaacccacccacctaccctcaacacagaatcaaaactgatgcggtaggtagtagctattacaaacccaaaactccatataaaaaatattttctctctccccttttcccccggggaagccctcacttcctccataccaccacaccacccaatcatcacatccggcagtgtataagtaggtagatcatatgcccgtatgcaaccgctcgaaaaggtattgaatcacacgcaaacaatgtagtgtatattggcttggcacttaacccaacacaccatccttcttcttgggaccgacgaccttggggaacattctcatgaggtggtagttgatggggttgcgtctctgggtcttgggtttctatatggtggaggagatatgattagcacggatccaagacaagcgcaatccaggtttgagagatatctccctctcctgaaagtttcaaaaacaagggaatggaaacgtacaggagcatccatgcaagatctcaattgttgttcgagaatcgcgcatccctcgtgggtgtagccctgggatgcccagcaacctgatcgattcattcgtattagccatattattcgagccacaccgaaactccttagagtagttgtagtactcactcagcatagacgacatcaccgcaacgcaggtattcggctcattggtgttcggacgccggacgcgcaggtgagggatggactgcagacggaccgggttgagacgggtagagactcctttcgggggcatgattgcgaatggtgactttgtagtttctcgaaaacaatggtacagggaggggggagataacgacaacgcagccgagtgacgatgcggacaaccaaaagttgactgaaggcttcggaggtgccaagactttttcggcgatttgcccgccgcggaagtgtctggctgatgtaatcaccgcggcgagttcaggctggtaactaagctgatttgctcctacttcttcagtttctactatatttgaagattggtttgcacgctgatcggagacagagatgagcagaaggcatgtgagcgctttttacactaatacggtcgcgccagtatgtgcgccgagacggcagagtatacccttatcgagatgcttctccgttgggagcgtgcggcgaactgcggcgagttcgaagccgggcgagcagcatgagaataccaagacacaagatgagacgaaggaggaggaacagggggctatggcgcggcgactttcggatatgacagagcaagccatgctggaaggaggccggtccgcgcagagaaacatgcaacaggcggggttctcggacgagttgaagcagcagctagaggagagggtggcggcggcggcttttaagaacgagtatgcgaccgcgcactcaattgttgatatgccggtatgctcactacatggacattacatgttcgataacacgaccaggtactaacaagtcccagtcaagcgcaggtcaaggaacacgagacatcgcaggcgctccggcatggaccggaacagaaaacacccacgacatcacgctacgcatgttagacgactccaagaagcgcatacgcacaccatacaagatcccccaaccaaatccggtcgacatgcgaataagcccgaagcccaaagagtccgccggattgcgtctagcgaaagcccgagagcgcagggcaacatactccttgagccagagcgagggtatatcagaggacgaacgtgaagctatgcgtcgagagatgcgggaacggttctcccccggggcacgaccgatgccggccacgctgcaggggttgtcagcgcttgcgaacgagcggatcgaggatgcgatggcgcgcggtcagtttaacaggataaggaggggtaagggtgtgaatacggagacggatcaccgagccaatagtccgttcatcgataccaccgagtacttcatgaacaaaatgatccagaagcaggagatcgtgccgccatggatcgagaaacaacaggacctagctagggaggttgatcggttccgatcacgtctgagggcagagtggcggcgacatgcggcccggctgattgccagcgagggagggtctctggatatacagatgagacgggctggtgcgtatgccgcggcggaggctcgactggctgaaagggccaagatagagcaagcgttccgcgagagcgatagtgcgagtagttctggagggctggactcttcagacggagctccgcagagctcggatagtacagtttcagggccgcaagaggataaagatcctttaccctatgttacgcccctgcgtgatccgcaatatatgaacacagagcgctcgtttcttgagctgacgatcaagaacctcaatgctcttactcggacttacaatcttcaggctcctccggtggcacagaagccgtatctcaatcttgagcgtgagctggctgcatgttatgcggaagtggctccaagcttggcggaggaaattaagcggcgtgcaactgaacgagctcgtccaaagaattcggggcctcaagctgcgaacatcctggagtctctgagcacatcgagtaaggtgcgtgtatatgaggaggatcaggccaagggctatgggttcaaagaattctggcgtgaccttttctcgaagaaggaataaacgttcagagaacttgtatataatgaagatgatgtgctgtgtatgatactctacctgaataatagatatgagtgacacccgtgagcaaaagacaaagacgaatatccatcttacacggcaatgcgcgcgacgttctccatttcatctaacaatatcccgctatctaaacccaactacctcaaccaatacctagcgtcgaagtcgtcgtctcgacacatactgccaaactattccttatttgtttgatcacggcatcagcgtcaacaaccctatctatctcacgtcttcaacggcggcgcctaaccattctgtacctgtaccccaagcgccacaccgcgtacaatccgcgaatccagacgactgccaacagcacattactcgctgtccccagaattctcaggaaaaacgcgattcgagcattcgaccacaaacccatcaagtgatgtctaagataaagtcccagtacccaggaagcaaagccgtatatgagcgcgactgatgagatcaggagagcatctctataccgatcctccctcgtcgagtgtgatatctctcctggtgtgcgaagtgcccgatgcaaaggtaccttcatcccatgccaagcgctagcgtagcagaacatgatgaatatcattatcactacggcgcccagctcatcgtatatgcctctccgctccgaattgaccagcgctcgtttggtgacagtgatgttggcctcgaaagctcgcttgagtattgatgtacatcgcttcaacggtgtcataaagtcggtccaggcggtcttggattggccttggggccatgctgcttgtgccatgtctggattggtgattgaggaggaataatcaggtttatgctgtgcggttagatctcggtagttgcgttgctgggtgaatggtaaggaactctctgatcagtgtgctaggacagtatgtccgtgaatattatgaatactggaattcaaaggattgtgtaactatgtctcaacggatgcacgtcaaacgatgacatgatggagaagaggatgttgtcgctgtcgcagacgtataagcatcggatgtacattactggccatcatgggaggtactagtcagcgatttgcgccttccttatacgagctgagcatgaagattgggtaaagtaggggaaagcttctgaagctaacctgctcatagctgtgcaattcctcgctgcattatttccaatattttctagatagtaaagtattatataggctatatgaatgtctattgccactgtagcttcagtaaattgatctctcctggtcctgatggaaataagcagctagagccagagtgtggtgagttctttcatcatgtgctcaacggttgaagctcagggctttagatagttaccgtgtaaatttcgcactattatccaagccatttttcgagaacagatagtgtccgcgagccttgaggatggtggtgagagaggggagggggagaaagagatgtgagagacaggaggtgagtcaatcagcctccccacttctttcttcaagttcacagtccacggctgctcaatcactctgttgcttcctaggcctgatacatgatggtgctcagtccgatacatccttttgttgggtctaattttgaacatggaatggcagttgtataccaaccaaacagcttgtcgtatccaacagacaagtcccccctcattcagcaagacgacactgtcaatgctggtatgaatagtcaaagacagattgtgcattgcagtcagcgacaataaagttcatacttaaccagatggctcttgtgctaaacaacagttcgtggatcttcgtcttcggagcccagttcctagatcactcggtagagtgattccatcgctttcatttctggtctatgagccctcgtgagtgtctctattaacttcttattagatgcatacttagaatgcaccccttaaagctcatctacacgctcttgaccccaaattatatacatttggttctgcctgactgaaacgtgctatcaaaatgtcgcaccacgagtagcccattcagcttcaatacaagcacacaaaagtaccaatcaattaccaatcacgacgatcttaagataaggtttagaaagcgaaacaacttcggaaattacctcagtggagaacatctcgtcagcaatatgaagctgccgttgcaattcgcacgtccacggctgatcagatcgacaaccaaccatcgagtggttattgttcgcatttgacagggagtttaggttttctagagcctactgttactgcagcctgtctggcgaggtagtcagcggaaatgacccggacttgatcgtgctgtgactcgacaacagtgatacctgcatacagcgggatgtgcttggaacagaccctgtagtttgccccgggcacagacaaaccctatccatgccgctacagtctgtcacaaagcgctaaattagcgggaattgattcgagcataactgccagtagtcaaccgcccgatgtgacggggtgtgccgtgcatgcaggcccggcgcgtaaattgaccaacggccgttgcgggacggccgtcgcagcagatcacctcttcacaccatcacatcgacttcccccaggcctctcaatataccgcttctcccctcttttcttccatcatgtttctctcattgcgcaaggatttacagccttcagaccagatccgatatgtctgcaggtgctacttaatcgtcaccttgtctgcaatcacaaagcttcatcccgaccccatataatgccctatctgctattctttgcgctccttccccgcctcattactgctggctcagtatccaaggagcagttagaccccgttcgtcggaatagttatcccatcactccagccgtggacgagtcgctcctggccatccagatcggaggcattgtcggtgcatacgtgatcttcgttgccctacttctttcgctgcttctcttcgtgggccgccgtctgcgacgagctgtcctctcctccaactactccctccacgtcgagatgatgaagcccatgaagccccctcccagcatggaccccagtcccgtcaccccgatctccatcaacctgcccagcccgggccctcgaagcttcagccggtcctggagcagcctcggcaagggccctcgctcccacgcctcagggaccaccaccagcgtcgccacgatcgacgaatccgtcgtagcaactgaccgccagcgagcccaagaggatctggaaatgctttacgccgccgtgatggagcacgacgcccagaaggaagctgccgccgcagcccggggtgccaacaaggactcctccgatggagacgaagcagcagagaaagagattccctctccagacagcatccccacgaatccgttcgcagatcgctcttcacacgcctcctccaacaactccccactgagccctcgatctagcggccgactatcccgcatctcctccctgtcgctcttcaacctcaagtcgcagaaccagcagcaatcatcaaacagcagcaatagcagcaaactgcgctctccacgacccttccctctccgcaaactctccatctcctcccctgtcgcctccccatcctaccaagccgaccaaccccccttaaccccaagacactacaaccccccaccccgacccccagcacctcctctcccagtagcaacaacaccaagacaaaaccaacaaccatcccttcctcaaatcaacacccaacctcctcctcccctcccaaccccgcgtcttgaaccaccccgcgccaaagaaagatctccccgcgggcccgttcccccacccctaaccctaaccactcctacgggcagcaacacagcccaccagcacggacgcagtccatcatcgtcactgcccttccgggacgcttacccgctacagagcgcgccggccacgaagctcacggttctggagaggcctttgaagcacatgaatgggccaaggacgggcgtgcccacgccgtacagtccgtacatgccgttcacgcccgtgacgccattgacgccgagctcgatgattacgaagaggcagagacggcgcgcggagaaggagagtgggttgaaggtgttaaatgaggatgatatggttagggatgatggggatatgtgggggtattagcttttctctaactcgtcgaatttcaaattcctgtctgacactctgctttatttcactaggtagtgtgcttggatgggttgatgtgaggcgagagtgtatggtgatgatatttccggggattatactgcttctggggttatgtgatatgtggttatgcttggttttatgaatatacgagtatttattcgaattattttgaatggtcatgtctttaacgtcatttcaatactagcacggagtagagtagaataatttgattcattttaatcatgtaactactccatcaaagtttctatgttgctcccgtgacagaagccattggaggccgaaaagagatgtcgagggttcggagaaaagtagcagaagtccatggggggccgtctgatgactttggatagaatactactacctacgcagtcgatctatgatctcaaggtgtggctgccaaatcaacggcaggcttgggatcggacacacatcgcatcctgttgacaatacagtacttatgaacaactaactgatttttcatccgactctcagtcaacttgactaattgacagtaacctagcaagtgtcgattcatttaggcttaagtttttcgacacctgcgacagcatattgtttacgctgcggaggttgcgggccatagatcgaaatgaactttttcaggacagtattataagttacttggtaggttcagtaagtgagtaaattggatttgttctggtttatttattatgatttactactctagaaaaaaaaaataatcttccaattttttataggcttctacagtacagaaagacaaggtcatttgacttctggagtccaccacagtagtagtaagatgagtagaggtcgacgatccgcaccgcaaccacaaccataaccctaattaaatgcagataccaaacaccgttggaaagaaaagaagagattctaaaaagaggtagtaaaatagtcctatatacagttccctgcgccgcaccccacctcgttttcgctatagtaatctcactctttaatgcttttcctctctctctctctctcttcgtatgcaacacaattcctgccatctgcattagtccgccaatgcaactaatccttaatgcttctgaaatatcttacctctatcggcatcaccaccatcaaccagcacgccttctagagaacaggaaagctaaatagcaggacactcccacgtatcccgcttaatcttcatcaaagccgattgcttatgcgggaaagtaacctcgccttctttatagaagcctgcttcttgaaggtacgtaatcaacctattcatctatcattagtatctgtacctgtatgctttattgattgcgagatggtagtgatagtgggggcatacttaaaattatccaccctcggctccaacatgaccgtctgagttctcgaatccgccaagaagcaataatgcaccagtgcactcaaccagatctgcacgcggtgtgggccacggtactcctgctcgccgattaacaggtgaatgccgcgatcgtagttgtcggctccgccgattaacggtcccagtcggtcttccttcacccagtacagctcgaagtagccgaatggcttgccgtcccagcagccgatgacggggaaactgtgtctgctgttaaggttcgtgcgcaggaatttctcctggtgctcgatgggcccggcttcaccccaggaggcgttgacgcgggggtcgttcatccatttgtgcagtaggtcgaggtctgacggccctgcggttaggggctggtcgagactgctagtggagtggctagcggagtggctgggggtggggttgttggatcctggggcgcgtttttggtgagatggggggatataggggatgcggaaggagaggtattgttgcacgctggggatgtaacggacgtagaagacgtcgccttggtgcggcggtttggggcggatggggtgtcggatgccgttggtgaaggtgtattgggtggggggaggggggaagtatgtgggcagatggctggtggaggcaaaggggccctcgttggggacatagtgtgcgacctcttggccggctgcgtgagcgagattgaagctctcgcgcgagggcgaggccacgcgctggacaaagggagagccggacactgatggggggatggtctgcgggctcatggtgaagacgaacagccgggggtcgatctgccagaagctgcgacggctgatgaacatgttggcccagcattgcgggtcatagggctctgcgccgacggacgagtcctcggaggcgatgaggcccatgcgctcgagcttctggagcagcgtgcgacccttgaagaagccttcgcgcttgatatttatgcgccagtcacctttgggctggccagaaggcggggtattggcggaggcgtccgtctgcagacgacggtcgggctggggttcgtggaagtaccaccacagcgtgacccagagcatcatggcgatctggcgagtgggggagctgaccggcttgtagtcactgctgggtgggtcgacaatgtaggagatgtagagggagtcatcgcgcaaggtgggggtagtgaagcgcgtaaggcgggcacgctgctcatcatcgccagtcccgcgagttcgaccacgctcttcatcgttggtgtccgtggtttcggggtctggacggtttgtggcgagcacgatgctccaaccaggaggcacgatggactggttggagttgacatcgttggatttgaaggtgaagccccgaagacgggggagacactgaagctcagcccgttgggtagatggcacacgtgatggcgcatagttgctgatttgacttgactttaagcaggggaagggggaaaagaagaagaagaaggaagggaaagcaagaggagggagggaagtaagagtaaatagtcaatagtaaatcgtagtatctagacagagtgggggggggcgcgcaaagaatgagcttgtgtgggatgatgcgcagttgcccctcactgggtttttgacgatcgcgcggcgcctgcaggaaactcgcttttggctttcaccggcgctgcagaaagagatcagcccagttcgggtgctgtccgactgggtggccacatgttcctggggtgccgatggatccccgcggcagcacgagagatgcagaagttgcagtgagctgaggcagcagaagcaaaagcagaacaagaaatgaagtctaaagaaaagaaaagagagacgatggttgatgtcatgttccgggcggtcagcaaaaagattgtaattggggcagttgattggctgggagtgcatgccttaccctatttactttgatttactttcgaaattacttgatagtctcacatttgttcaagaaaagggagacagatagaaagataaaagtagcatgaattgaatatggatatcatagtccagcaattacctccttcccagtgcccgcatcgtgatagttctccagtaattactacatgaaaagaaagaaagaaaagaaagaaagcaatcagaattcctccagcgtcgtgcccactcccttctcccgcgccaaccgcaccagatcgccgcccgtcaccagatccatcaagcccatccccacgctcttgaagatcacattcccgcgctccacccaatcccgaagactcttgccatcttcgctgttgtcgccctccccgcgcgacgcatcccgcacaatcagcagctcgcccaattccaccacctgatgcggccggatgcccgcctgcacaatctcgccggcttccttcagcgccgcatccaaactgtccaccaccactacgccactccgtcgcacatgcttgtggaaatgccgatgcgagctgtgcaccgtcacctcgtcgcgcagcaactcaggtggcagctcggtcatgtgtggccgatatgatccaatcgcgctgatcagacggccctttcggcgtccgtcgcgcgatgtgaggatctgtgcagggaagagcggttccgtcgagggcgtgcagcagaagatcgcatctgccttgagcagcgcatcgtgcaggatgcggtcgtactcgacaaagtccgtgctgacggcggagaatttcacatcgccgcgccagctggcgttctcggggctgtagatatcccgcagcagctgggccgcgcggtcaaaggatcggttgataatatacacccgtttgatgccctctccgcgcaggatcagcgccagccgaatgtgccagtatgcctgcttgcccgccccgaacaccaccacggttcgtacgcgcttgcgtttgttgagggtcatggtggcggtcaaggcggtgcgaaagggggtaagttcatgagcgttgatcaatccaaagggtaggctcgtctcgtcaatcaatgtcactgatccttgcggggaggtatcacgggagccggcggcgggccaggcacccatggtgttggacattccggtatcgatgggttgctggttcacgcagccgggggtgagcgatttgctgctggaggagggagaggaggaggtgtggtcgtcgtcttcttgggaggacatggattgctcgctgccttcggaggagatggaggacatggacttgcgctggttgactcggctggaggaggtggtggtggtggtccgggaggctgcggaggacaagtctaaggctgggtcgacggagcagccggcctgactgttatcttgtaaggagatcatcttcatgcccagggtgttgcccgtgctagcgggcatgaacaaggtggtgcagccattctgacgggtgatggccgtgcgcgtgggttggtaggcagccgcacagcccttttcttggctaccagtggagtagtcccgcagagcattggagaggttctgctggagctcaatgatctggtcgcgagagagcgacaggaggagggagcggagttgtgtttgagagaggatggtgagtggcatgataagcagtgtgataagagatatgagagaaaaagagggaggggaggagaggagagtagtaggagagaggatggagaagagggaggtggagaagaactggcagggcagagcaggggacagtccgggaacagcggagacgatgggggagagttaatatatttattagtatctggagtacctgcgataaagacacggacagagagagaaagaaagtcgcgaagacgcaagcgggcgggttcacttctctgggcgggcggaccggatgacgacaattctctcagcctcggcggggcgttggattaataccactgtttatctccataacaagagataataataatcttataataataataatgagaattctactgagagtatagcaagagacaagattcgatagtttctgccgttgtgttgcttgtctggcaataattcatctactagtccggtgggctcacttgtcattctgggtaatgaggatcctgtcatatcatcctcaactatctactaattgctaattgctaattgctaagtacatactgtaatgcgatgatgttggttggtttggtgtctgacgtataccagcatggaggactatgatctccgtggcatgggagtacgtacttgcatacttactattactcctacggactactagttaccaggtacccgtggtggatggagtgaaacatctcccaacaggcagatacatacacagagatagtaggactgcagtgtctgcctatctaatactatccgattacgcatcattcattccaattccacgtaagtcccatccccctcctctcctctaccccagataagcattgttgaaagtattcccacattcctatcttctccgcgcatacatgcagaaagtacattcctcgctgtcaatcatccatcccctctcgccacccttactccctcctcctccgccacggctactatcggcccttcactctgccatctcattgctcgcacggatacatgttcctctgtccagatgatcaagcccaataccttggtcaatactcataaaataaaatggaaaataaaaataacaatcatgatcataatcatagtaatgataatactttgctattataccataagtagggcgctaatctaccgtgcttgtacatacagatgcaggataatataaagtcactgatcaatgtcatcatcaaaaaggattgggcagtctgggatgcgtagaaaaataaagattcaccgacgcggaaatccagaaataattcgaaatgaacaaaagcaaaatacacatggaagggagtatcaaatcaatccaatatcaacgccgctgtgcaatgcatattcaatcaccgtcacgggattcgagtgtaagtactatcctcttgtagatcaccggaaagggagaggggtagagggtattgggtcaactgcttttatcatcacacggtaagacagagagaaaaagaaattcatcaactatcccaaaatatgggatgaaaaggacggagggtgaaatatgaatgcaggtattagaagacaaatgtccgaaactcctcgagaccagctcgatgaacccaccctaatgccggcggccacccatgtacgaccctgccgcggatgccaggaaacgcgccacaaaacccgggtgagtttgtccgggtccatgtgcgtgactcagggagtgtcgggctttcttattcggctgcgacagctcctccactttcgtgccggccagcgagacatagccgttgctcaccgacgggctgcgggtgccatccacaacatgcacctcgttcatactagtgatcgaactggacgtacgtagactggcgggcgtgtcgctccgcgagctgggtgcgatgctggaagcgcgcgagctcagcgagggaagcgtttcagcacgtgataggcctgggacctcctgcacagctggcggagaagagatggacgcatggctgcgggtcgaaggtcgtcggcggggtggatacggacggtaccgctccgattcggccacggaggctggtgaggcgcagtaggagctgcctgaggagacagaagaaagggaagccgacgatgctgggctggggggcaggcgtctccgcgtgggagactcgccgggcatgcggcgaccctcggccttctgacggtgaaggcgagcagcgaaaaggtcggcagaggcgtgaaagcgacgccattcacggggctgacgcagctgggcctcacgttgtcgctgctcctggatctggagacgccgacggatgggcatgaggaagggctccaggtgatgcaggaggtctgcctcgtcgacacggatgtcccagtctagcaggaagagcagctgacgctccatcaggttgacttcgggcagcgagaatccaaagccctcgtagccgcggacggaggtgtaccgggcccaatgcttgttctttggactggagtcattgaggttcttggctgccagaatcagggaagccaggaagatgcgatgcactgtgcagcgcatgcccttggcgacggggggcaggcgagcccgcagccgggccagatagaccagcgaggtcatcaacgtcggcacctgcacctgcgagcggagaactagcgaggtaataaaggtggtgacggatggtaagggaggcaggtctgcatccaagggcggcgtgctggggggcgtgggctggccatgcgcgtgatgcgctgtcacatgcggttcgcagcggatgacctgcatcgcttgttgagccagatgagagatcatgtctcgcgagacgggctgcatgatgaactcatgcagcgccgcccgatcgaaatccatgatgctggtggtgttggtggtgggggatgcaaagttggtgcaaggagagtagggatggacagccatggtactttgcaggatgcaggggaagagggatcaggaagacgagagagcgagagccagcagacaaaaaagaaagcgagcaagacgcaggatatagagaggcgtgggatagtctagtgaagaatgtgaatcccgccagcaggaaagggtaaggaatgtgttgtcgtgtcaacctccgtgatgaatgggcttgaaaatagcagtgagacagtcacttgagacaagtgataagatagatcggttgccacttggggagggaagatcgtttcaatattaaatagatagagccgacaagtcttgccaacgagataataatgataataaaaatagtatatgatataataataataagtagtagtggtggtggtggtggtgggaataaaaataaccacacgttgctatgatggcgggagttgttgtttatggtgtttgttggtatagttaaataacttccctcgtgaagaatgaatgaccaacaagaaaacaaaaaaaaacagcgagggaaaagacggatcatccaagcctgatataacaccaacagcgaaggctggacaggagctgcaaggacaggagggcacccgacgcgcattgcattacatgcattcaaatccatccatccatccatccatccatccattcaacccattcaggttggacctgacaagcaccctagacaagaacgaactaaccaccagtcctgcaggggccgatcaacggatgatcgctgggtgtgggtgcgggtttggcgcgcgcgagagcccgagaccagtggcagtggccaagcataacgggatgggatgattggactggattggattggattggaagaagggcaccaaaatggaactggaattatgtgtgagtgcctgcctgtgtgggtttgtaagtttgtgggcgcgcgccaaaagaatgcccgagacacgagatgcaggaatgaatcaaggagcgtggcgggaaatggaggagaaaaaaaggcaaaaggaaaaaaagagaggaggcccagctgagcgcgtcggcggcacgaatctccatcacgatcctagaacgcgtgagagatacttggctagcctgatgttatttctaattatactcaaggaggatttttacagcatgtgttgtttctccatgccaatctgattgattgattgattgattgattgattgaactggggatgttacccctctctttcttgctcttctcccctgtcagcactttagggctgctgcacttaagcgcccggatgcaagcgccgcgattgatgatcgtgcataatttggcaagctagctaaaatagctggatgtgattgtgcttgccgctcatgctgatgcttctattcttgttacttcacacagctgcttagctgctagctgctatacttgctacggctgcctgtcatgcattggctctgcttgacagccttctctgctccacctccgcggttaggtctcaacgtgggtgacgatggttatatttagcaacttatggaattcctccatgattatcaacccaacggagttccaggcctatgtacatatgatgattcgaccgtcgcctcgtcgccccggcgcgtcatcaaaccatcgacgcctgcttgccaccccgagcaaccccctccccctcccttcttcaaaaacaaaccccctcgtcctataactatgtccctccggtatcctgcccagggagctgaaacacggcgcctacattctcatcctccgctcctaacaatccctttttgaaatcattagtatgtatcctgccacactcggtgtttgtgatttcatttactcgatggaaacggagtactcggacaccttcagctcagcgtcgctaccggtgaagggctcggtacccgcctcaagggtggtcaggtacaggctgtcagagacaccctcgttgtccaccaggtaggtgaagaagtcgttcaggtcgccggagaagtcctcggtggtcgactgggcgacgaagctgtagacggtggtgtcgccgttggggccggtgtacaggtcccaggtcacgccgttgatcgtcggggtggcaatggtggagccggtcgacgagatggggccagcaccgcccagggcagcaagccagaccatgatctcgtactcatcggaggaggcgtcggcggtcgagcccaggaacatgtcgtaggccacgtcggccacgatgtcggagccagagtatctattcccaaaaagtcagcatgcgtcctgacggtcggtcggtcggaaggtctaggctgcaacatacgtccacttccaggtggaggggatgctggagatggagctcagctgagtaccagtgaactgcagagcagcgttggcgtagctcttgacgtcactgctgccaccctcccaggaccagctggtgtgccaggcgatctcgttgccgctggccgagtcgacgccggtgcactgggagccgctggaggcgttgtcttcaccccagaggtcgttgtacaggatgaagtcgccggcggtggcggtatcccattggccgcagaagtcgctacggcggctgatagaggcggccgaagccaaggaaagaagagcggaaagagcgagaaccttcatggtgatagtgattattggtcaaaggaaagacgattggtcgggtaaaagtattgatattggtgcaatgtgcgatcaacgtccactgacccagagaattatagtgaatgagctgctgagagggaactccatcttgctccggccgggctgccttcttatagccatgagtgtgccgtcgaggtctgctggaacaggataaaattaggcatagccctcatcaagcagaaacaaccggggcaatttagcctatggaccttccgagcttagtcctcatggccgttgagacatgtgcactcagaatcaacgaagcttcttggaaagtccgtcgccgaatggatcctgaccccgagtggaccaggagggagaaggccgatagggtgctggtggttctggtggtgcttgttcctggttttcgaaacggtcccacggaatgccccgtgcagaaatggaggtcaaccggactcacggacacggcgataatatccagaggagtttagatcaggggaaaatcagtggattcgtcatctcgagacggtataatgtccccgaatgagaggggggcagccacggagatggtccgtttcggattagataacaggatgccgtttaaatgaatgttcaggacgcccgagaggggcgtggctcgtccgcagggttccaagaggtggacagctttattaatcgatcggattaatcccacaacgggctccgtcgaggcacatggtgctgtcagaagaaactatttttgtggacggattaatttgatgttggagaggagtactctgtagagtaaagttagtaactacggagtaacttagtgagtttattcggaggaatgataattggcatgtttgacagccagacaaactcggccaaatgctgctggctgttgctgactcagccgggctttcctgagggccttcccggatcaggcaactcgaatatcctcaatccatcaatcagaaccataaagaataatcaccctatcatccttcctcaatcccctcttctctccttctccttcccacgcccttcccccccccttctccaccctccattagcttctctgcagctcctgtttttccggtcaattgctttccctcccggaacagttcgtcatcatgcgctgcgctagcttcgccgtggccctcctggcccttttcactggtctctacagctacctgaacgcgcgcctggagcagttctacatcttcgatccctcccacctgcacgacctgtcgcagcgcgccattgccgctcatggcaatgacactcgctcggtggtgaacttcatcgtctccgagctgggcgagaaggtcaccgacacgcacctgaacctggacgaggaatgggtcttcaacaacgccggtggtgcgatgggggcaatgtatattatccatgctagtgcgtcccctcttttgctccataccacctctataattatccatggtgcctgaactaagctttgattctcctataggtatcacggagtacttgatcattttcggtatggcttcccctgtctcccggatatttttatgccctcgattgcacgagctaactactctctccccgtccattaggcaccgctattggtactgagggccacactggccgtcacacggccgacgactacttcaacatccttcagggcacccagctcgcctacgtccctggatcctacgagcccgaggtttacccccagggtagcgtgcaccacctccgccgcggtgaggtcaagcagtacaagatggatgagtcgtgctttgctctggagtacgcccgtggctggattcccccgatgctcttcttcggatacgccgataccttctccagcactctcgacttcccgactctgtgggcgacgtccagaatcactggtcgcgagatgatctccaacctgctcaagggcaagatgtgaatgatagatggcgagatgatgggtatatgtataatactattactattctcactatgttagatagacgacgatgttgttctctagaatacactacatttaataaccctaccacaattcgtcctgtcatcccctttgcgcttttttttccgttgtgcctgtttatttttcccccttcccggggaaccacccaaacagtgcaaacacacccacaccctgactcatccaagtccttatcgataagccaacattccaggcccgcgaaatcagtttatcaaaaattgctcccctcatcgcctccaccaccacccactatacgaacccccctcaacccagaaccacacccacaagccaccaccatgcccccctccccctgcgcccgctgccacgaccaacgggcagttatcatacggcccaagaaccggcaaaagctctgccgcacctgcttcctgcacgtcttcgagaccgaagtccacgaaaccatcacctcgacctctctcttccaccccggcgaacgagtcgccatcggcgccagcggcggcaaagacagcaccgtcctggccgccgtcctcaagaccctcaacgaacgctacaactatggactcgacctatgcctcctctccatcgacgaaggcatcaagggttaccgcgacgacagtctcgagaccgtgaaacgcaacgcccaacaatacaacatgccgctcgtaatcgtcagctacggcgacctgtacggctggacaatggaccaggtggtggcgcaggtcggcaaaaagggcaactgcacatactgcggggtatttcggcggcaggcgctggatcgcggggccgcgaaactgggcattaagcatgtggtgacgggtcataatgcggatgatgtggcggagacagtgatgatgaatttgctgagaggggatttgccgcgcttgtcgcggggcacgagtattgtgacggggtccgccgccagtgatattaagaggagtaagccgttgaagtatgcttatgagaaggagatcgtgctgtatgcgcatcatcgccagttggattatttctctacggagtgtatctattcgcctgaggcgtttcggggtagtgcgaggacgttgattaaggatttggagaagattaggccgtcgtcgattttggatattgttaagtctggggaggatatggcgcttctggtgcccgctgaggttagggggaagggggctgaggatgaggaggccggtggtggtggtgggtgtgggagtcagaatgggcggacgaggggtggtgagatggcggagatggagaggaagttgaaggaggatgaggctgccaaagatagggagatggagattacttctgacagcttgtctaggaggcagcagcagcagttggagcagatgcagacgccggctcagaagaaggtcaagtcgcaggtactggggacgtgtgagcgctgcggttatatctccagtcagcgcgtgtgcaaggcatgtacgcttctggagggattgaataagaatcggcccaagacggcgattgagatggagattggtttggaagatgaggagagcagctcgacgttgcgcaggcagatggagaaggttgagctggggggtgtttgaagatatacagttatacccgttatacatatacccatcatgatcacagattcataccaattagaagaagttcaacaccaattatcataccgtcactatgctatatagtaaggtctttcctgttactgaaaatacacttcgaaagggcatcaacaataagtacttacctcttatacacatcacccatgtcacttctatatatcggctccacaggactactagtagtatgatcatgccagccacaatgtcgagtagtagtatgatgaactcaccagctcatccagatagagacgacatgttccttcatggtctaacaatcctccactccctcctaaatgaacaaactccaacgaaacctctaataaatcatcattgatctataatacaaccctcccccatcaaaataatcatacatacaaatatcatacacaaacccccaaatccatacaattccaaagcatacaaaacaaatcatcacaaataaaagaaagtacacccaaaaactccacccatggtttattttatccaccctccaccctccaccccatgcatccatgcatccatcgattcacccatcatccatccttcccaacatctccatctccgaacacccgtttgtacatatttattcatccttcttccccgcctcaacaggcaaatcccaacccacccgtctagccgtcaaccgaatcctctcctcctcatcgagcgtagtaccggggttatatctctcgacgagctccgcatacacgcgctgcgccttagcgtaaatagcgaactggtttgcctgatcaattcgatgttggcggagggcttcttgtgcgtctgcgtccgcgacacttgcttgttgctggttggtggtgtacatgtcgcggaggcggtgttggaggggagtgggtgtggagagcgtgcggcgggggagttcgcggaggagggcgcggtagcttgttttgatggcggtggacattttgatgtttttttttttttctttggggttttgttttaggagtttgtgggggttgtagatatgtgatttatgtaggtggtaggtttggttggatggtggatgggctacggataggtttggtttacgatggttgtatatcacgtgatttttacatttctctctaaggtttgtaacaagatatggacgggttgtagtagaaactacattatgtacatcatcatcaatcaaatgacgatcatcattcattgtactcgtcagcttggtgctggtgctgttgctgttgcagactctgctgcaactagtcataactctctctctctctccccttcgtctctcacgaccgtaaccagccgaacttcttgcgtccggtgtcgccgcctgccgagggttcgacttgcatactgcgcgaatacaagtcctgttggttgttagcatcaattaaatgaagtaattgatagtgggaagaactgggcgtacctcgtcatcccctgacagcttaatctctaataccaaccgctctacctcctcgtacttgggcatatgcggatacggtgtcttctggctgcgctggatccccagaaccacctctcccatcacctcgaacttgcgccagttgatgcggttcttgttgtcgcccacaaaagtcttgttgccctcctccgctgacaccaaatcgcgtcggtgcagcggcaggaacgggatacgctccgcaaaggaattgtcccatgcgagacgatatgcaaaatgactcttctgcgtccccatgaggatgaccagcctcataaagtccttttgcgtttgcaccgggaccagctcccgcgtctgggacagtcggtgcaccggggttccgttgatgccagcgatcacggccccaagagaattgtagttgtttagtcggcggagtttctgtggctgtcagataaatgtttccgctttgttcttctgagtccgacttaccaatgctatgttcatgaacttctccagcgccttggctcgatgcttgggcttgtcccggagtaggatcacgctggctacaaagaatgcgacatggttgaactgcttgatcatccggttgacgtgcttcaggctcaaaatcttatccttctctacgccggaaatgctgacatgccgcacgagatctcgcggtcggaaagaattgaacatgatccagtcgatgcgcgtcaattctcgtgcgaaatcctcatccggaatctccatcagctggcgccattgcactttcgttagcggaatgcgtggtgtgagatccaaattatgcgcctcccgttgcgcagcttcggtactcaaaaacgtgaacgactggctggcgatggtcccgggcttctcggaggtaaaggaattcgacatcgaccccgacagtctcgacgcaggctcggctgcaccctcgctaaggtccagagcgctcatattgtagatagggtcttcttcttcttcctcgccttcatcgccaagcggcggtgccccaaggaagattgacggtgagctgcgcccggaaaactggaaaggggggtcggccgtgtcgggttcttccatgtcgccatccctatacggccatccaatattatcgtcctccgcattcccctccagatacgacccaatctccttggcggcaaacatgtaaaaatgactcttctccagcgtcgtgacgaaatcggtgattcgcttgcgagtcttcggatatgccaagtcgcccggatattcagaaacccactgtgccatgactcctaacagcctcagctgaactgcgatgcggtcgagttggtccgtcatgtcattttcgttgcgttcgaatcggttaatcagggcattcagtaaggtgcacggcgcggcaaacttgcgatatagacacaaaaagattgaggcaaacttggaatcttgcttcgacatcggttgtgcaaccagacgatctacgagctcgtcaaaggtgagacctgcatcattagatgagctctcactaggcgtctggtccttgcttcccgggctcgacggagcactccggggcccatcgaagtcctcccccatctctaaaaagttgctgaacgcatctgacccgccgctgttgcgccaggccgtgtgaagacgatgttgtcggttgagatctttacttggtgacgactccccagacacagactgtttgcgcgaggccagccgggaccctgaaggaggcgtatgcggtcgcaccggatgcgagttgctccgggcgtaacggaaggcctggccattggaagccaggttggcagaggtggccggttcggtgggttgccggtctacaccgtacccatcgacagctggatcaagaggtcctgtgattgggccgcctgcggctccggataatacagcggtgggggtctctgagttggtgcggctgtgatgccagtctggggtggcggatgagttggggggaaaatcgatgaagtctaaaagaggagccgttagcatccacgtgtgatccagacttgcgggaaaataacggccacagaaattgggtagtccagctgtgctccagctgctcttgcgctgggccccttcgccccgagggatcggcgggtcctgaaaaccactgcaccatgagatacgcgaacgctaaacgcaggccgcgccgcgaactagcgcgaaacccagtgggccatcgctctaagggatgggctatagccgggggcgacgcaatgcgttgggtgatgcgagcaaacagatagccaccgaggcagtggatcgttccgccctgttctttgactttcctcgcctctcgcgtatccacatggcaatcgcataggtcagcttgtccacttaccatatttacggttgatcacagagcgcagaactaaggcaatgcacatcttctgcgaccgtggtgagtcaggtgaggtccggtggatttcatagcctcccaatattggctccacaggactgtcagggggttgtatgtcgcatttactggccaccagcgtaaagggtatgtcagaagcggttaaggagtctgcagaccatcagcccacatcctagggagaaattgcgcagcgaccgcggcgctgcagcaccggcaatgcgaccaacctagtagttcggtaaattcagggaaactggccggttgagtcatatcgagtagaaccagcaccccatccactgtaggaggcgagtcgttacccagtaagggccagttgacctcgccattgctcccaatcgagatctccaatgtatctatctccatcagacgaaccaagtacaccgtcccgtccagggacatcttcttcgtagtcgatcgggaactaagcggatgcttcatgtccagggcggtttcaatgaatgtcgattttccgacatggtcaggaccgaccacagcgatgctcacatggggaaaactcggcttcggcgttgtctgcggtacacgcacgggggtcagaaaaacattgcgctcgccaagggtccaatgacataaatttggattaaccatacctcctcacgggataacgatggcaccctatcccctccggccgaaggcgggttctcatcttcctccagaagtgtccgatccaccttattccccgattccattgccgttctagccgaatcaagccggtacaaacctccgactggagcagaaatcgttcggctgggaaggcccggtcgttgtggaaatggggcgacatcagctttgtcgctagatgctcgctctcttcgcaatggttgggaggccatagtgacgaggtgactttactttttttctgcgcgaacggataggcggtgctgtggcgcgagtaaggtccggtcgaacaaacaaggtgcgacagcgcagggtccaacagctacgtaagtgagtgaggcggacacgacagctcatccattgtcgcttgggggggaaacgtaaaaaaggtccaggcttcgtcgggtccgcaatcgaaagatttcagagaggctgctcgaatcagctcggggggatggccttccccttttaaattcggttgtttgtggtcttcgaatttcgatgatgattagctgagtgatttttttggtcgtctgcctctcttttctttttcggtttcctttcttttcctcgttcctcgttccttttcctgcttttcttgacttttgggggggggatctcgtcggctgaggcaggttaccggagctggacacaggtagaacccaagttagcaacagaatcaataatggtaccggcaagagggtagcacaagtcttacgagaaagcgtccgggttggcaaatcgaccagggggaagtaagagcaatgagtggaagcgaagaggcagagagtgtcagggagaacagcttgaggaaggccgccagttgcaggcgggaagatgtcactcgaccgaaaaattgagcccccaagagtcagtcagaagttggggcagttttggggggggcggcgggcggggagatttggaaagcaagtctggtttggcctctccaacggcaaggatgataactatgattatgattttattttggtttttagttcttattattattagaaacgccggggcactactctatgggtcaatctagcagaatccctagcggagcacaatggcaggacatcccagccaactgggaggattgtgatcttactaaaatcggtcgtgttcaacactggatgggaactggtgtgcccgccgcctcctctcctcactccctcctcaccaaactctccggccaacgatccagaaccccaatggctcatgctggtcagcaagggagtctgccgtccaagttaactcaactcgacagcgcaagttactttacatgcaacaataacagtacacattacattcaatgcacccggatggttgttccccagagtttctccaagcataagaacgtccaccggcaaacggtatctcctccccggaacttcccattgacatgagcgggcggagatgctcggaacgaataacatcgcagttcatcatgatttggccagtgtacccaagacggggagatcggtgactagctctagtagtctggaagcctttacgaatcacaacaaggcaaatcttaaggttgagaccagttgctcaaattcccgttgtccggacgtctcgttggtagacattgaatgtgatgaggcacagtgatgaacgattggcggcatttggaggaatccttccagacgggtcacatttccccgccattttcccctcatggggggtgagagatagtatggagtagacagataaaatgcattgcctaggttgaagggctgctctcatgaagatctgcgacgttgaggtcacttcaattcggctggggatgcagtgcgtggaactggatgaatcaacctaggccgttctcatgctccgccatggacgacaatctccaatcttaccatgctgaaagtcaaagtctgaaacatggcttgtccaggttttctatgcacatggcgactatctactacttgtttcaaggtttggtcaaggatggctgtgttctctcgcccctgggtttgtttaaactttagtcacatgtgggcaaagttacttcagacggttgcttgccaggcttcattaccagtagtaggtctgcctggatggagtttttgatggagtatactctaggatcttatgctacatgctgcacgatgacatccctgtctctccttgaagactttgaccagtcgtttgaattagatagttcggtgcctcaggccataacgtgaccggctccgtcaaattcaacatcgcacaatcttataaaatgtccctgtcagcatcgacttggatagtttagtctcccatgtctgcatccgtacattgtatcccgtcagaggtacacagcccagatgccatgacacggactgttctaagtatatgttagaatctttggcttatcacaggagggaaatccggttcatgcacctcatgcttacatggcgttgtgcagatggatggcatgcacactttcgggaacctggagacacgtcggagtctcagtgagacagttgaagcattgatggcggtgtatgttgtgatagctagtcgctgtgaagccatgccaaagtaccgagctttcagctagaccgcattctggtaaggtgaacgctattttggcctgccgcacctctgtccaggctcgaaaagtgcgggcagcggatacttggtattcgagagatttcaaatattctttattagtcgcttccgaatggtggaagatcaaccgcggtcggtgatagtcgtggttgcgcaagttgacggactactatatattttcatatgcatccgaggaatgtaactgagcatcggtctctaccaggccttaacaaccttccacgtcctcatgaaggcttgattgcactaccatgcaaatacacccaacctcggcagatctcatcgaggagtgcacagcctgggaagtaccccgacataaattcaggaagcgtagggtcctactccaatgaactcgcaactactttggagtccatcacatggtctcgcgtggaagctcattaccagtgaccaaggacatgaaacgcacgtatccctccgctttttttccagtctccaggccctcctcgcatctttcccgtagcctcctcacccttcccactccccggttgaagcccttctcacgggtccacggcccgttatgacggtgcggccctttgcctctcccgtggtgtcgaccccgacctccaaagcgttgtgtctccacccatgcatcttccaaagtagtcttgtagatatcgtacagctcctcacgaagcgaagggaaccgatcgagtaaatctttgagttcggttgagcttcctaaggctttaatatcgaggccattctgagctttaggtgttatctcgctggccgcatgctcattcgattcgccgggaggctgttggatgtcgaccgttggaccggtcggttttggcgatggtgctttaggtgcgcagtagattttatgggactgggtgcaagccagagagcaactaggagggtggcaattagcacgggtatgttcctcccttctcaaaagaaaaggcttagagcacaatcatacctcatgagcccacatgttgggcatcggtacttcgaaggctccgagacgcaaacctcgcaagtgccgggcattttatcgccagcgtcccatccaaaccttgtgccaactgcgcgacgatcaagctctgtagaacattgtcttgcttcggccggtcgcaagggtcgtatgaagcgagcgcgttggcgtgtggacaaggatagttaccttgtgtcctgcaaaattcaaggcttctgcgaaggaaaagtgacgataaaagaatgactgccgataaggaactgtcagggacgatcgtctagcggaccgaaaagaaacaaactcagcccaatgggggctcacgtgaagtggcgcggtccatgacgacaatcgatctccatcctctcagatatctactacgtattagtgcctggaatatttacaagtgcctcgctatttcccctcccgtcaataaattgtcatacgatttactgatgcgggcttgacaatgccacgaatgtccgaatgatagtcatctctctacagcggtccttcgagtgcagtgtgccgaccccaaatcttatcagctgtggcagacggcttgtgggacaacttgatcggctatgggaggtattcccttccgatcaaccggatgcaatacgtgccggcgacgaaaagtcaaggtaaggcctatcttacaaggcctgaacagccttggttgccctcggagacggagcatgaatagtcatctaaaatgtgccccttgtgtagtgcgatgaggcaaagccggaatgcaatcgatgcatcaagaacggccatgtctgcaccggctatgaacgaaaaagggtcttcatccacaaatcgtccgaggccatagaggagggagaactgaagctcgtccgtcgcccgcagtcgacttccgggaagattcccgaccgtcaattaacgcgagtggagccaggctttccccgattaaataacaatgcggaggtccgatcacagctgctcgcctcctttgtggggggctttctcccttcgtcacggcatttgcaagatggaaaagatacaaatatcctcaaaacgctccccgaactttgtgggaatagtcctttgctggacagagcgcttctatcgctgtcttccgcttttcttgcgaaacagcacaaggatgatcggttacttgggtatagtacgaagctctataacaattcgatggagatcatgcatggcaagatcaaatctggcaaaggcctaggccaagatgtcctatacacaacagttgtttttcaattatatgaagtcagtgtcaccattctcatcgcctctcgctttttctccgcggctggcctaacacttcacaaagttgatccactcttcccccccgggatttatggcttggatagcacatgtgcaaggcagtaacgcaatcattaagcagtgcagggttaataaaaaaggaactattgccgagaagttgtttcaccgtcaacttaaatttgtcactgtcagtctccttggcttcggattgatcaaccagctgatcctcgtaacgactgagtcttgctgacattgaaccgcccggttatgtgatgccgtggggagacgcaaggccgccaccctctatgaagttctgactacgcaagaacgcttatcgcagggctcaacggaacttgagccaattgatgaactgatggacctcttggccgagtgctccgctctcatagaacaagtagacactttcatcgagcaactgcctgccagccctgatggtgataagaataacggcgagaagttactgggttcttgcttatcgctagaagaaagactacaccagacatgcctcaagatgcaggagaaactgggggcgccgtcgactctcacccatgacgtgcccttgcgagaagacttgagagcacaccttgccacctctttattccccgatcccttccaattcgtctccctggcctgcgccgaatcgcacctcatttattgggccaccttgataatactgtacccgctagttgatgagcttctcgacgtccttggctatcgcagaaatgacgttacaccctcgcagtcctgtgccattcatcctcaggcgattgaacaaagacccttgggcgtggatgtggcaacagatttcacagcgctggcggagcattatgcagacgaggtctgccgatccgttatgtactgtacacagtctgacatgaataccctgggcgcacaacacctgcttgctcctttcagccaatgcgcgcaattctttcaggttcatgaactggcgcaaaaatacaggtggtgtcagggggtgtttgtgcttcttgactcgctaggtctgggaatagctccgttgctgaaggacatggtttggccacaataccgttccgctcgactacgtaggtctttgtcatccgtgggaaaagtcccatgatgagatttggcctgttcaacgtgcttcccgtgccaaggtggcaggtcgcatttgagcgtgtcggacgcacgcttggaagcacgggattaaactacccaccaagatatcatagacggctatcagccatctagcaacatggtcttaacctaggatcaccaaccgacttgttgggctggattataactaggaacagagcaagtcagtcgatgtgagtagcagcagtttattgtttgcgggatgagacaccgagccgctagcgacacatcaccacttgtcctgctctgcgccttgtactagatgcattgaagcatgtccaaggcctaatgctcccgagccaggaaatttcaggaaaggccgggctaaccgcgatactgggttcaccaggtagcaggcccaagctgtggcctcttgcacaacactggtataaccgaagcggaactcggctgagaggcaattatgttacacccataatatatagtgcttagtaccacgggcatgtatgcctaccagtcagatagtccacatttcactgtacgagtaacaagtagaccaattgagaagaattgaatgccgaacaattcctggggcagcgatgtcaaactgccggcagttaattggtggagcccgcccttcatttgtcagcactcacttttgggggcatcacgtgctttctcattgcgtcagagggaatcgagtttcccatcggcatttctggtcgcttttcttctgaccaggaacgagtctgatatctgccactcccctcccttatcatcacagcgccaatatgtctgtcagctcagcgtctggaaacatgcttaggcgcactctcttcagcgtcagattgacaacgcagcaactgaatgctgcggagtgctcctcccggatcgccaaacccgcggtgttcggatcatacaggaatgtccaccgttcggcacgtttgcctgctatcaccgcctcagaggctcgtcgccggccgaccttgaagcctcaccagcactcgctcgtgcaggctcgcgtgaacggaccatcgccgtccagcaagcgcacgatattcattcagacggaaaacacaccgaaccctgatgtaagactccccgtggcacaccagcacgaagattccaacgaacgaacaagcatctgacccttgtatgcggaacccaacaggcattgaagttcatccctaaccaccgtgtcctccccgaaaatttcccgaccaccttcctcgaatacctgtctccccgctctaccctcgctcctccgcacccctctcccttggcagcaagcctgctcaacgtcgacggtgttacctctgtattttacgggcctgacttcatcaccgtaactaaggcgaccgactccaactgggcgcacatcaagcccgaaatcttcagtctcatcactcaagccgtgacatcgggcgaggcgatcgtgaacaccgttgcaaagactggtgagagtggccaggaaggtggcgagtcggagtccctggcctacgaggaagaagaagatgaggtgatcggcatgatcaaggagcttttggacacaaggattcggcccgccatccaggaagacggtggcgacattgagttccgcggctttgagaacggcattgtcttgttgaagctgcgcggtgcttgccggacctgcgattcgagcaccgtgacgctgcgtaacggtattgagtctatgcttatgcattatgtgagtatcacactacctgcatgcatcttgacaataaagtttgactaattgtgtgctttttacctacagattgaagaagtccaaggagtcgagcaagtgctagaccaagaagaggagatttcgatgcacgagttcgccaagttcgaggaaaagctgcgccagcaaaagggcgctgccgctactgcctcgacgggcggcaagggaacattggattcggcaccttgaacaccctcctacttcgcctcttatacataattacttatatttcacgtgtattgtactttggacgtcagatatactaccatctggattacggtctatagaaagctttgccagacaatgctcaatctcctctctatcagtataaccacttaataatgcgcatccgtagtgctcccacatcagacacaatatggaccttagcatgcccggaatcgaggtattccagtattgcatacaatctactgaataaacccgccaactcgggcaccttcctcctaccctaaaacctccgagaaagcagggaaatgtgtcaaccgagccgaggatgtcacattcactcacacacacacacacacacacacacacacacacacacacacacacacacacacacacacacacacacacacacacacacacacacacacacacacacaaacaaacaacactaccaactaccgaaatccattctgtatctgtgcgtagcataatccacagtactaattcgtgtgtgcgagcgagcgacaaacctaactaaccaaccgaccaaccagactactgctaagctaagtacttaagtgcaacactaacagtggactggactggctcttagcagcggcagcgatcatcgggtcggggagatcgggaaatggagaacagaacattagcttcaacttgaatggttcgggcttgtttagtctatccaggcttattggtgcttcggtttcaatggtagactgcattgatgttggagtagatcaagctagtacctatctttgaataatattattgacatggagtagatactaggaatgaggtgtcgggctgctatgtagcatctctacttagaagtttcatgatgagaggttgagaaggttgactagtagtactgcgtatgtgctgtgtatctggtttggttggtaagggtaagggggtagtttagtatgaatgagacggtataatgtactttagaaggtgggaatatctaagtgatacaatacaatccagtagaacgaaagcttgacacttgataaagactcactaagctttcatatcaaggtacgtttggcaaattgtatacaagcacaggccgttatacccttgatatagtgtcaccaacggtggctaatttcgttctccggtcggctataacctgctcacattgaactcttcttgttatgctagagcagattgtctaagcttgattaatgcgtatatttcctccgagaatattgaagttgggctatatcccgaaatcatcgacttcggtccgaactgcgtcatagatgtataacatgtttgaaagcacgctttgacatctaggtataatgctggctaagcatagtaggctccaataatctcgggacggcttggtggagaggattgatggtctgacaggtcttgtggtaccgacaaactttctgaaacggatgaatgtattgcatatagggatcagtcaagtctcaatgtatgatattaagtgagaaaacatctgcaagaaagggccggaatcgcaggataacactactagtaactaccattgtgctcaactagaaaaagagcaggaagaaacagacaattagatggggctatatggaagctgtagtatgaggtgcggaatgtatgccatggtgagtgggattagagcgtcggcaagaaaatgaaaccaggagataacaaactcggacaaaaagagcagatcaacgctccccagaacgagatgaagtacagggaagatgatgtgctgaaaggcgatccctcagcggcaggggagcaaccgaatgaggggatacgaatcgatacaaatcacctgatactatgaacatgaataagccatgatgcttactgtctgtaccccagctatctatccccccctactaatcagcacaagatgtgtatgcaaggtggttcatctgcttcggatcctatagatgatgccacgcagtcaaccagacatctcatgacggctgcatccacagcccacgcaaacatagcactgcaggacgtacaaacatggaagaagattagatcggcactcatcggcgaaagacttcggacaatatgtccaccgggtcagcaaaccgcactggaatgggctggacttgctctaggctcttcgataaccctggatgagaagagctgtcagggtcagactctcgacacgatgcaaccttaatcaagacatcttcctagtacgttaagaataatatgacattcatgacaagtctggggtcagccagaggatccatccctctggggtaataaaccatagtaggaaacatgtccagcttgcacacaagaaaggcgaatatattattgtgttctgctcttcggaaccgagatacgaagagccacgcatcggtgccacacctagtggtggggtaatggggggttgttagtgaactccgctgtggctgtagcccaatcggacatgcagacaagtcagatgaggatatccccgagtcccgctaatcatgttggtccctgtagcgcaagtctagagtgatccgtgggcccggggttcaagcctcatcgcttacgagaagggccgagggaagggggcctatgattaatggagaccggacccggatctcgttccttgggagtgtcgtatcttgcgaggtccaagagtaatttacgattagacattccatgagcggaatcgcgcagattccgagtagtcttctgcatatcggtgtgtatgtgtgtgtgtatgtgtgtgtgtgggaagaaagttcagcaggcagggagggggggagagaattgacaataacaacaatagcagaaaatggcagggcagcagaagagacagacggggttggctggcaaccgaacgcgggaaagctctctccgcaatttccaacggagacgatcctgcaaaaggaatggactccatgcgaggatgaggcattgattggatcgccatcccttgcctcccagttagttcagttcttcccccgcagtcaggtgcatggcctcttattcccttctattgtaatggagggggaggaagaagaggaagaggaagaggaggggagaagacaagggaactgttcctattcgagtatctaggggaggagaaaaacgaagaaggaagaggataatcagactaggctactactagtcagggaaaagtaagacgagatgaaggtgcatttgctgcaagaccaatgtatagagggtcatcattacccttttgcccatcgatcaggttcaaggtacatgcagcatccgggaggggaagagagaaggagcagcgaactaaggttgagggtgaacgcgttgattcgcgttggtttggacccgcggccaggattgccgtgtaacctaacgccagtatgacgttgacgaattcccagtgcggaatgacacaaagaaagtaactgaaaaatccatccatgcatgaaagaaaagaaaaagatactttggcgtgagaaactgtgccaagggggaagagagaattattattatggaatggaaattaggtgtatgtggtatattctgtgtagtcagtgtctcttgaatacttttcggacaattttgcttttcattatatttattatttttctttcttttattttttttccccttttctcttctcagccttttcaatgccctcccccgcatggatatacacacagcagctaagaagtacaacccgtctgctcttccctgccattcgtggcggttcggctgttactttcgaccctgaataaccgtgtattgtcgactaaacatactatcagcatataaaccctgccaataatttcctcgttggcggtcgcatgatgaccacctaacccttggaaaatgagggttggatttcgggggtttcatggtgcaccgttgtttggaaccgctgcggccgtgaaatccctccaattccccttcgggattcaacagggctcaggatagcccaacagcctgatcctccccgttctttctgggttgcgcccaagctccttcagtgttccagtctttttctcctcctctccccagcctccacagccccatcgcgggttggatcgggcgattcctcaacaagattctccttcccccaggtcttgaacccgatagggtttcaacggcattatagctatctcgagtagttgatctgattgaaggagagcagaagtttagtcatctttgtacctgctctgtaatttaattaattcataagctcttataggctaacaatcatcagggtagtatctagtatttagtagcttcgtgggagaagaaaatagaaagccccgcttcagggtcaacggggaaagaggagaaaaaaaaagagaaaaagaaaaagaaatggaccaggccgccagtcgcaaatccggcgatgctcagagggcgaccggggcattctgtctaggccagtcagaaagcgcggaggatcttcgacttgacctcccagaggcccgcccggcccactcacgggcgttccatcaatggccgatggggttcttactctcctcttttgctgctggtcgcctgctgcctgtcatactcctcctgctgctgctgctgctgttgctgctgctgctacggacgttcattcactacagtaagaacccccttcctcttcttttccccccccgtccccatctttttctttactggatttatgatgtatttatgatttttcttttctttttctcctttctaaactcttcgggtatagtagtcagattggaagttgtgcagaagtgagcctgtttacccgtcaatcctccccggatctctctctctctctctctctcgtcttttttgtcctgaagcactggaggatcctttccccatcttgcggcctatggttccgtaccgtatctagactcacgtcgattttcttaccccgccttggagcgatacattgatcgtatgctccaggtacgtagtcgcccccttagccgtggttagtgtggatggaggtaaaaggtaccgggccacaatcgttcacttgtactttactcttcaccacgggctcgaaggttggcactgctggtaaggaccaggataaaaagaaccacaaccacgaccacttgctcctctttccctccaatcccccccaaaactaaaactagctcggtcatagctcacctttcacaaaccctcgactactccaaccttcaactcgcgccactgctgctcggtgctccgacccgtggctcgctgttttctcctcctggctcgtctggtccagtggcctgaggtcgactttgaactagtccagagctacctcccttagcttgcattaatattatcctcctacgcaacttacgactgtacaaccttgccttctcctcttcttcccttctcctactaccaccgtgctaatactcggtcctgatcatctcttcttctctctttccccttctcctcttccctttctcagtccacaaactacttctacttcttcccactactctcttccctgttactcgtttgccgcctttctgtctctctcccttggcccactctcgataaggcttgcgatcacaccacaccccatccccggctgaagatcgtcatcggtcaagcaacgttgcagaagccacactgccactcctgtctgtctctgcgacctgcgccgctctgcgatccgcacacacacacacgcacacacacatactctctcactctttcttcgcacgcccgcgtcccccccaattccccttcttgcgccgtgacaagctccgcatttaaaggggcctaactgtcaacctaattcgctttggtcgggtcgcagaataatttctggccttcgacgggctctctcgctccccttgctgctgtgatcgtcgctcgtcagtctcaagatgcgctgctcttgaggagatctgcccataattactggtgccatcttgtctgccaacgttatccgtctatggtcacgctaccgtctccccatcccgcgcacccattgatccctttcatcgcgactcgacatacagtgaggtcataggtcttttcgagcgacataccgcagataacccctccgaatcaccaccaccaccaccaccatcaccgaaaaacaaataaaaaaaagttataacagcaaacggaaagaacaaacatattttttctgttggtctggtggaattgccctctaggcccgccttgattccttcgcctttcgactggtcgcaaagcgccactttacacaataccttctttgattagacagaagcctggtcgcttcgcctggagaacaatctccagctacaactgggacggattttacgatcgggtcgattgcttgtgttttatgttgaatagatggtacaaaaagttgcgttttattctctgttagattggtaagtcaattgtcatgctacgtacctaatatcgctcgtccggggatattttgctgaccacatggggaggcgcaaacagacgcgaacacgattttctgcgaattttacttgtctgggacgatcggcgatacccaaatttctatactagttccgggtttgacctgaatttgtacttcttcacaaggtacgtatatttctcaagtgtctattgtgtggtttgcgttgtggtcgtggtccgtggcctagccttccccgcaatttccccggagagctatgctgtgtggtccctcgaacgttttattcgtcgccgctgcctttcagcagcaagcagacgacacgcagctcttggttcatccgaaatgagtacggacgagcgggcagttgtgtgctttttccagcctcaggtacagtggctcctctatgagatttgcccccggaaagtttctgaaccagggcagcccctggaatctgggcatgaaaatagtaagatctcgttgagcgcatgtgaaacgagattctactgggcttttctgggctttgatcatatgatccgcaggatgctcaagaggctggcgttttccaggcccatgggtggttgcccgtctcgccacccacagctgctcccccctccccccaaaattactcagcatacacgagctacagctgggcctgtcaggcttctttaataactcttatttccttttgctcggcgaatcccgttctccggttgaaatttcctcgtccctcttgcactttgactttgatatttctccctccagcgttggagtgtcccagctcttgtgtatctgcctcatcgagcatcagcctgggctaacttatcatgccgcaagcaatagcgtatatctccaggagctcttatttcaaacgaaataaattcctccagacacggtggtttctgaattacttttagagtgtttttacctcgttgctttttcgcccactcgattcgaatcgaaggtaaccactcctcttggctttgttaatttgccatgcggtacttaccggcttctagtgaataccccggactcttcattgtatctgaagaggccaagcgttcgttacacggatcgagtcattcacgatccggtatctgacgtcagtcgtatctgtaagtgagccccaacaaatgactatatcttcatcttatctctttcattccgctcttctctccgtcttgcgacgtccacttccccgctttcaaacacttcatcaacacattcatctcagctcagctcctgttaagtctttctcactcgagaattactgacactttcatggccagtctacttcgcgccttgctatacgccgtcttccaattcgtattacagacatcatggctgcgccagccggcaaatctactgcgcaggcgaccaagcctgtgacttcgtcgactccgaccagtaacgtgtccgccaggcttgagaaaactcaccctggcgttcgccggtccacccctgactctgaggctttggcttcctctgatgacgatggagaccattcacagcaggtggcaacctctacgaccatgccagcacccaagcctgctcgccgcacgtcatggctaaatgaagtgccagctaccgcgaccagaaaggcatcattgaccactagtggtcccttgtccacaggcgcctctaacccaagcagtcctgctaccgaccaatctggatggccgaacacgagccccggtattggtaactctattccctggaatcacgtagggaacagttcctttccctgggctgctggtatctggaataccgagtctcggaaggagcctccaccacggcttgcggagatcgtcccatccccgaccatgtccaatccttctactgcgagcaattactttacggaagaaatactgagccctacgactcgtacgaccgctggcgactcggccatcccgttctcaattcctctgcatccgactccaaaaacctatcggtcgcagtcatactcggtaggtcagttggatcctgagttcctgagcttcatggcgaacaagtcctcaaagccatactctggcggccgtcctcgtaacggcaaccaattctccgccttacagcatcggtcgtcgcggcctagccttctcggtgagctgggtcatgaccccgctactcttggacgtgtgcgcgaggacgatgacgatgacgctggcagcccggatggttcggacggtagctttagcaactatgcagccaaccaagcccgaaccatcgaacaactttcgagggaaaatgctctcctacgccaagcagcagggcagatggacaactcaatgagagatcgtaccatgtcgtctgcatccgcagctagcggatatgccatcggaagtggcatccataatttgcaccgtattcgcggcagtgtccccgaggagaccgacctggcggtagaagatcttgacgaggttggcgatatccctggttacaataacattcatagtagcggtcggagaagactctctgagcattcagcgaacctcgagaagcagctccctccttacacgtcgtaccagaatcgtaccctggaaaacgtccgcaaggctcattggcaaacctctcttgactttggtagcattgcggatatccctcagagtcggcgccactcctttgcggacattcctatgcgacacgcttctgtctcaggggaatcccaggcagccgccagtactagagctggaatgggtgatagagaagaggattatgcgaacattgttgacggccctctttcaaatgttcaaggccagaatcgtgagtatcctcgttttcatgtggcccctcgtcccgaggaacatgaaatggagacggagtatttacgagctcgtcgatttgcagaagcctattttgctcgcgacccagttctccgcgccgcagacggccccgcttcgatggccacgtccctccaccaagcatacacgatgccgaacgcctacggccgccaccagcctggcctcgcgcattcgcaccagaaccagctcctgtatatcgccacgttcaaatgccatcgggcggatgtcttctatatccaggaagataccggtcttcaggtgaaacccggtgatctcgtcatcgtcgaagcggaccgcggtacggatcttggcactatacagcacgctaacgtatctatgcaaagagcccgggagctgaaacagcagtatgctgaggaacattacaagtgcttgatgatgttctctagacagggccagaatggggccgcgaacgtggtcaatgctcctagtggtgtacccggcttgaataacagaagcgccattggtggcatgggtccacatggtccgcatgggatgcaggactctgctgccgacatcaagcctaaattgatcaagaggcttgcccaaaatcatgaaatcttaactctacgtgaaaaggaaggaaatgaagcgaaggcgaagcgagtttgccagcagaaggttaccgagcatcgactgaatatggaaattctcgatgccgaattccaaatgtgagttcaaatgtaacgttcggcgcactcattcacctgctaacaagacctttttaattagggactggaagaagctcaccttctactactttgcggattcctacatcaatttcaattcgcttgttactgatcttttcaagatctataagacccggatttggatgtctgctatcaatccagcttcgtttgtcacgcctcccagcgctggcttgtcggccccaaaccctctagcttataatcacgacgcacaagcggatcgcccacttgacggcagaatctacggtcatcctcgtgatgccatgggcacgggacgagacatcggcgccaaccagatgggaatgttgcgcaatgcctatgtcgactcgtatcagccgttcagccaagcctctcgccaaccagagctaggtggactcgcttctgtggatccctttactccctattcggcgaacaattatggctctctggattcgggatacgttgattacggcgcagggacgggcgcaagctccggaccatcccgtctacatgctgccccgagcgaatggataaacaaccgtttccaggggttgtccctgaattcctgaggaataccatgcggtttctctgtacaaattgatgcaataccgctgtacatcgaaagcagcttttatttctttttaccccctatcatcttcttccgccgcctatgcaaaacccattctcctgtcttcccaaccccaagaagggaccatccgctccgctttcatgtattcagatttcacatttcctactgttcttctcgttgacttcgctcttttacactatcactacatctctcttttctaatgtgtttcttacaagagattagaaatcatgtgcaacggatcaaaaggaaagactcatgacctgtcgttagtgctgataattaatcatagacttcagctttgatggtatgaaggcttaggcatgttcgtctcgggctatgctgcaagcaatcagatcattaccaattcaatggatcggtttttttttaaattgtctcctaattgctaattgtgtattatgttattgccgaatcggcccatatgttccatctgcgtgattttgaagtctccgtatataggcttgtcgacataggatcaaggcaccttgcactttcacgtggagcatgtctgtcaaactctcgttgatcgatacctgacgacagtatcactttccgtccggttttggacggcgcaagagccatatcttcatagcctacaatgattagaaaagatacattctttttttttcttttgctcttttcaatcattctctcctctacttctatggacgattagataagttgaatatggcccttggtctgattacgttgcttgggtttagcaaggatgagttttattagttgtcgccttgtagccttacggtcgcaaaaagcgtagtaaggtaattgctagtgctgaagaagaaggcggtgtatattaacacctcaggcattaatgagagacacagcggaagatttcattggttggggtgggggctcgcctaattctctagcgtcccacacacaaggtcgttgaagagactactatctttgctcctccaacttttcagctgtgacaaccgacgacaatcgacgacctgccacgccgacaaggtacgttttttcgcgcccctttcgtcgtgattcctgctgcgatacaacgaatcgctctgcagccatcgagaaacaagaaaattgagcaccagagactgatattccgatttccgtccagatgggtgccctcaagtacgtggaagagatccagaagaagaagcagtccgacgtgattcgcttcctgctgcgtgtccgttgctgggaggtgagaattcccccctatattgcgatcacttaacatcccgccgggtgctcgtgtagtttgccataggatgcccttcttgaaatgagaaatggtgttactgggcggctcgaaacgaactttttctttcgccggcggatggatgtggcacaaacagagagacttgagagaagcctcatgtgtcttgctatacactcgttgaactttgctgagagtgcatcaatatagctccgtcaactgaacgctatccaccgtgcttcccgcccttctcgccccgacaaggctcgtcgtctcggctacaaggccaagcagggctatgttgtctaccgtatccgtgtgagacgcggtggtcgtaagagacccgctcctaagggtgccacctacggtatgtacaattttcgtctttgagggattggaacccaatctaatttgtttgcgactacaggcaagcccaccaacatgggtatcaaccagctcaagtaccagcgcgctctccgtgctaccgctgaggagcgtgttggccgtcgctgcgccaacctgcgtgtcctgaactcctactggatcaaccaggactccacctacaagtacttcgaggtcatcctcgtcgacccccagcacaaggccatccgccgcgatgctcgcatcaactggatctgcaacgctgtccacaaggttcgttatgaatgccattggggattatatgttctcattgattacacgttactgaccgggaatgtgtttcatagcaccgcgaggcccgtggtcttaccgccaccggcaagaagtcccgtggtatcaacaagggccaccgctacaacaacacccgctctggccgccgccacacctggaagcgccagaacacccagagctactggcgttaccgttaaatgtagatggggtgtttatgggggtttgttggttatgggaaaaaattgatcctgtggatgtcactatttcgatcaaaactcgcatctacggtgccgttctggaactgctggggtgcgagcttaatgcaacagattgttttctgttaaaacgaactcgacttaagcaaacttccttgccacaatttctttagctttgcaacttgcctcgtgccactgaccgggatttacttatcgtccacgaccacgaagccctatctactacccctgcttatcgcagaccgtaccctgagatctatacaatttcttcgccttctaccacaacccctaattcgcgtctcataatcgtacgccactccagaaaaacaatccactcgatctaccgaaagctggggacagcaaatgtgcccatatgccgtcgcggaccccatataacccgtcctatcccccgacctccggctccccgtctagtcatatccgttcggctgcaattcctttcccggcagaagggaattcgcctcatcggataccgcaagatggttcaggtctatcgtccatgactggaaatccagcgacttcgccccctcatcgtaggggccattctcgttccgtcagccatccgttcccctcacccttcggcggcattacgaagcggcgcaatcggtcgatctcgaagaaagataacttgatgtttgattccgatgatgaagatgacgatgaggttacgtatttgccggacccgaactcgtctagccctcgtaaaggggccgcgcgtccgactccggctgaagagatgacttcgggaaagtgcatggtttgtaacagcacagtgcgttggccgcggaatctcaaggtttttcggtgcacggaatgtttgactgtaaatgacttggagccatttgtggactctggcaaggctggcggcaatggcctttcgggtagtgatggaaaggcacccacccccgcggtgccccgaaaaggtatggattatacccgctgggtctgcttacgggacaagtagtgaactgactgtgtttagctatgccgctttccatcgagcgaacgaaaacgattttagatgattgcctctccaggtatctccaacagctcctggcaccacagcagcaaaattcgaccccagagaattatagcggaaaatacttggatgtcgcgcaggacgaaaatctatcacagtctccaactcagtcttccgggtacttatctgaaccgcggcctttggtggatccccggggccgcagttcctctacatctagtaagcctgtgaaaacggagggagtaagcggcgtcccgaattactcgaaacctaacttgactccttcctatgcgcatggagagagaaagggctccgagatgaggagccgagatgctcaaaacgccccgagacgtgatcgctcacctcggaatgctgcccgatcaaacggtccagaggctagaggccctaccagtcgtccgtacatcttcaggtcgctcgaggaatatatcatcacgtcgttcaagggctgtgactgtctgaacagctccttcaccacagcacagccagccccgcgaaatgctggtaacagcagcccaccgaagcagaaagcggaaccaagctctgctcaggcccccagtcaggtaacatttgagccggatccgaagctgctacttcttggagacattgcagagaattcctcttggtggatgaacgaagtagaacagattagtagctctcatcggtcccgctcgagagagcgccgggagaagacctctagctcatctaggcctgtttcttctaggagccctcggatcaattgggcagaacttgcacagtggcaccacatgatcatgacggcgggaacgtcatgggtagagctgtggtcaacaatgaagcctaccgagatgaagaaggaagaagacgccgttatagcccagaagtggaatgccaccgacttagctatggttgacagagagatcacagagtcgcgtttacatttgcaccgaacgctcttgaaggcgaccgaaaatctgctaaaacggcccagacggccattgaagaggcccgaggataccaggtttctactgatgctactgacgaaccccttgatttattcgtccagttcatcgtttgcatcttacagtctggcgccttcggcggcccgcggtgaccggaggccttctcaccccaaagatggcactccaagaccggctcctcggaatccgaagcctcctccaaaaccccgaagcaatggtccagggcatcattatggcattgtcaagcggatattggggctcttggctaatttaccgaacgactgccatcactacttggtgtcctggttctcgcgtttctctgccgggcaattcgagaagatcgtggaccttgtcgggggatttgttactcatcgactaatgcgccaacatgggaggaagcgcagcgagtcggctcaacacgacgacgatttggtgcccagcttctctagcgccgcaggccacactccggccgagctgcatgcggcgatcaatggcaggagccccaacaaagcaaatgagcagcgcgaccagcccgtagtgtacacggatgactggcaggtgcgggctgcggcgcgagtgatgtacttgctctttacggcgaacaatgcgaacgtttcccggaaaccagacggcgtccttggtcaagatgcaggatctgtggctagaaatcaggccagtcggcgggggcatatgatcccgatcagttccttttacaatacactactggattattccgaccttgtcgccgattttgaggcctgggagtcaaagaccaccaagttctccttctgccagtaccctttcttcctaagcatctgggccaagatccacatcctagaacatgatgcacgccggcagatggaggtcaaggctcgcgaagcgttcttcaacagcatcatgagccggacggcaatcagccagtatctcgtgctgaaggtgcgccgcgactgcttggtggaagacagtctgcggggggtcagtgaagtcgtcggctcaagccaggaggagatcaagaagggactacgcatcgaattcctcggtgaagagggcgttgatgcgggaggtctccgcaaggaatggttcctgctccttgtccgggaagtctttgatcctcatcacggtaagtaaatgttcattgtcagccaaaacatgcaatgggccagttgactgattttcctatagggctattcatctatgatgacgactcgcgatactgttatttcaatccatattgcttcgagtcctcggagcaattcttcctggtcggcgttctcctgggactggccatctacaattcgaccatcctcgacattgcgctgccaccgtttgccttcaagaagctcctggctgccgcgccgctgtcgtcaattacgcggcctatgtacaagtgcagcctggatgatctggcggagctccgaccggcattggccaagggtctacgggcgctgcttgactacgaaggagacgttgcggagacgttctgctacgactttgtggcgcaagtagatcgctacggcgaaacagtgtcggtacccctctgcgctggaggggagaatcggccggtgacaaacgcgaaccgccgggagttcgtggacctatatgtgcactttctcctagacacggcggtcacgcggcagttcgagcccttcaaacgggggttcttcacggtatgcggcggcaatgcgctctctttgttccgtccggaggagatcgagctactggtgcgcggctcggacgaaccgctcgacgtggcgtccctgcgggcggttgccacgtatgacaactggtccaatgcacggccagagacggagccagtagtccggtggttctgggatttcttcgaacaaacgcagccgcaggcgcaacggaagatcctatcgtttgtgacgggaagcgaccgaatcccagccatgggggcgacgagcctgtcgatccggctggtgtgtctgggtgatgagacgagccgattcccgacggcgcggacgtgtttcaaccagctgggactgtatcgatatgagacgcgggagaagttggagcgcatgctttgggatgcggtgttgaatggcgaggggttcgggctgaagtagacacggggagcaggactccctccaatgcgagccttggcactggcgtctggggcatcttcgaggcatcgggcattaacagcattagcactagttccatttttgagtgttgggggcgttttcttattttcatttctcgtacgaggtttgggggtggtgagactcgtccgggggtgcatcttgtagacggggctggaccgagttgatagcgtgcgggggatgacgagatgcatccgcggtgtacggttgacaagggcactgatacgagctgtcggcggcagtcatgagacggcagccacgtaagtagcaagccagtcggaccgggacagacacggcggtggctgccgtgggagggggaacggtacggtgtcgggccatggcctggggatcggaccgagaggagagtgatgtacatagcagttgcccgaagattagagatgggtcccgatgtgaatgggtcgttgggcgaccaaatgaaagcggtaattactcgagtgatgcagtaggaggcagtaggtaatagacagtagacagtctagtgctagtgtctcctctcgaacttggtagagacagagagaggaggtgcatgcatgagaaacagcgctagtcgtgccgtagcgagtggggcagcggtgagtttgtttgtttcgcgttcgctggaagggaagcactcgagtagcgatcgtcggtgtcaaagtcgattcaatttccctcaatgaaatcattccttcatccataccctttctgaatactgaaccaggaacagcatcaggaaccaccatctatctctgtatgatgggatacagatccgtccctggttcctggccagatcttcatccagtcgagagtcggaaatcaaggccactcgggaagaccacgttcaagtggggggggaaatgaagtcatgcgggtcgcaagctgtgggggttaaactagacgcctttcttttttcttttggtttccttttcgcccttaactcgttgtagaatagagagattctggcgggttctgtgatgaagtcataggcttggggagttgctgttttggtttctgtttctcctgggttcgattctatgtgggatagtctggacccacttgtagctagctatacagggtaggctagtagtagctgctgttgttgtctaggtcctgtaagtccgtggttggtggtggtggtggtggtagtgtagatggtgattgcgggggattttggcttgtatcactgtgtgttctctccagggtaacttacctgctagtagtaagagtggtcagttataactggatagaaagtaagtttgttgggtttggggtcccgtacatggatagtgggtgctataccctatgagttgagtgattgtgcatgagtggtgtttcaaggacgggatggaaaggaatcgaattggtccatgtactgaagccttaggaggacagatccccggagacacaacaacaacaacatcaggccatccccactggggattagtccaatttcccttacgtatggtaaggaggttattcctgatcggatcctggtatagaataatagttagtcacttagtatttacccctcgaatggtcaccattcaaatagcctcgtctttccctctttttctttgtcttcatcttttatctttttttctccaacaactcactccctcatccttagtcactctcacttcgctattatctttaaccttctttgataacttgtatgtttcttgtctttctgaggtttttttcttgggtctgttgggtctttgctgacggtgtcgattcctgtagtaaagtatccatatcatcactatcatcatgggttccactcttcctcagactatgaaggctcttcggtatgttccttttccctaatcctagtcattagttgggatgtagttaaccatcggtaccagctatgagaagccagagtcgcacggcattgtcgacgtcccgctgcctgagctccgtgacaacgatgtcttggtatgctcttacctcctctcttatacatatacataccatgcattatgcacctctaacaacgccccccttcacagatcaaagtcaaagcctgcggtgtctgcggaaccgacctgcacatccacgagggtgaattcattgccaaggtaccgtagcccacctaccctcccacacccctctcgcaattcactaacaggagtgattgaatagttccctctagtccccggtcacgaaactgtcggtgttgtcgccgccgtcggccccaaggtcaagggcttcaacatcggtgaccgcgtcgtcgccgacaactccgagctctgcggcgagtgcttctactgccgtcgcggcgatgagctgttctgcgaacacttcgaagcccacggtgttaccatgaacggtggctttgctgaatactgcgcgtaccctgctggcagggtattcaagatcaagaacctttctgatgtggatgccacgttgttggagccggcgagctgtgcggcgcatggtttggataagattgcgccgaagatggggtcgtcggtgctgttgtttggggccgggccgactggtttggtatgttcccctaggtatgcagtggtgcgtttgtgctaacgggttaaatgtatagatcctggctcaattgctccgccaatgcggtggctgccgcgtggtggtcgtcgcgcccgagggattgaagatggatctggccaagtcgctggatgcaggtgatgagtatgttgcgctgtcgcgacaggatcctagcgcacagttccagaagctgaaggacgagaacccctacgggtttgacattgttgttgaggccacaggtagtgtcaagatcttggaggactcgatcaactatgtccgcagaggtggtaagctggtcgtgtatggagtttattccaacaaggaccgtgtgtcttggcctcctagcaagatctgtaagttcattcctatcttcctttggttgtgcggatatatactgatggtatgatagttggtgacgagattactatccttggcagcttctctgaggtgtacaagttccctgcggcgattgactacctcgactcgggcaaggtcaaggtcaagggcattgtcaacaagacgttcaagattgatcagtgggaggagtgtctggcggcgatgaagaacaagacggccattaaggcggcgattacttttgattagtgctggtcactagatgtatatattaatgagttatgtttggtatgaagctttgcttcttgactgagtccaatatcatgatgacattcagttgatttgaagtgtattgacgaaatgttactggtatatatatggggtgaggacccggggagtcagactgacgtagatctccaccagggcttgattttaaatcaaatcaagatcacgaggaccttgaggccacatagcatagatgcacgatcccataaaccaaataccatagctagttagtagctatagctatagctacagctaggttcaaccggagttgaaccagccgcagcgattaaacccgtaccaacacaaaacttatcgataagaaagattctccacacccagctctcctcacctctctcatccatcacctcacaacctacctccacagcccatctccattctctacacctacccaacccattttcaaaaccaattccagaccccaaagaataaccatggtaaagcctctaaccttcaaaggcgacaagcccaaaaaacgcaaacacacctccacatcaacctccaccgatccctcccatccagccaaaaaacaatccacatcaaccagcaccccaaccgccaatgaagccgaagacccctcaacccacgatgaacacaccctctccgatcaatcctgggtctccgccgacacaagcagcgacatctccggcccaatcctgctcatcctccgcaccacaccacccacctgcctcgcgaccgacgcgcacggcaccgtcttcgcctctgcgctcgagaacatgatcgagggggatccccggaccgcggaaccccatgatgtgcgacaggtttggattgcgagtaagattgctggcattgaggggtggagtttgaagggatcaaacgggcggtatgcatacactcatttctgaatgttgttgtggatgataaaagggctaatggggctattgtgcgacggttagatacttgactagcgacaagcacggcatcttgtccgccaatgcatcggctatttcgcagcacgagatatatacgattagtgagagtggggcggggggaggagggttctttgtctttgggaccgggacgggagcgtcttctgcttcgcaggggggtgatggcgtggatgataaggagaagaaggaaaagaagcagacgtatcttgttgcgcggactgttgcgtcgaagacgactgcttcggggacgaaggttgaaattcgtggggatgagactactcttgatgatggggaggaggatgggggagggacgaatattcgtgtgcgcatgcaggcgcgcttcaaaccgcgcatccaagcgagtaaggagatcaaggcgcgggagaagatcgggagaaaggagttggagggtattgtggggagacggttggatgatgatgaagtcaagaggttgaggaaggcgaggaaggagggcgattttcatgaggtcgtgttggatgttagagtgagagggaaacatgataagtttgcttgattaggattactttttctatagatgttttgttatgccatgtacagtctattctatcatgtgtgttatgtaagtctcgggtcgtggaatgtctatctagtgaggttgcagccatgggtcttctggtggaaatctgaaccagctgcttgggagcacgctcttcttgcatagcgggcagagactgctgctctgcgttagggatgtatcgatgcatggtgggtggtagatgtgtccgcacggcagctcacgcactgctgataaatccggctcgaaatcatccaggcagatcgcgcacgtcgtttgctgtcggctgagtcggtttttgtgccgtacataggcgtctgggtggcctgctattgtcgcctgcgagggtcgtctgatggactcgccgtctattgctttttccgcctcattgtccgcctcacgaattgcgacggtgggtgttttggggtctatgtcttcagcagagtgttcggtgatccgtggtagattcccaggtgttgaattctcatgggtcgattcgttgtcgtcaccatcgcccatgtagatgtagattggcatcgtctccaagaattctggcggaactttgatatgaagctgggctagctgctccaagtctgcttctccggcttccaggcggcgctgaagctcccgctgatgccgcctgtgcaccagttggtagaataaaagtaggataatagtaagtacgaggaccgtcccgagaatggcgagaatgaacccccatatactgggcatcttctttgcgccactatctgagccatatgtcagcttcttactggcaatgtcacgacaacacaagcctacctatatctatgaccgctatcaatctgctagcccctgacgacgacaatgcagttaggttgtcttggtcatcgggatcgggcacactcccgtcgcgtgacagttgttccatcaaggtagcacccgccgcgccggggattccgtacaccggaaagttgctctgcgattgccagctagcgcttcctcccagctgccaggccgggtcatttgccgctggcggctttttgtcatcgttggacggcagaaaaaagagcagcgcggccggcacggtcccctgcgagacattgagaaacgcctgcgaacattcgtcgcttatccaaggtgccagcccgatcacacggccgtcgaacggcgtgacgccttggaggcgggtgacgttgtccgggatatacggttcagtggtattgttgcatggattttggtttccgaggctgggaacaaagagaagtccctgaattgagccttggtccggggctttttgtttcgacagcgtttgaacggtatcgtcaagcttgagagaaaagatcgaactctcctaggggcacagtcagcttctcggacacggaatttcacgggcgtctgacgcacgttcagagcgatggtggtgtttgtcggatcagcaaagagcgtcgcaaccgtggtgagcgatttggcagctagataagaggcatatcagcgatcgctcaggtatggacagtgagacagccacggaaggatgaacaggcagtcacgatcgaaggaatgtgcagcattctctgaagcaaggggagcatactcatggtgtgacacggtcgtgcgaccagcacgagacccgtggacaagaggaatccagcagcttaaaatccaagtccagggagcatcgtcatccgcattccgatccgattgaaatgagagtcgacgtcagacgcacgatgcctactgcaatgggagagtgcgcgagcagagtcaatctattatcttgtctatgggacttgtgggaagaatgctgacaggtcaggttgattcgactgtccgttgcggataattgcggcggccagctgtaccaggccaagaccaagcagagaaatctgcagtttgctggggtactgcttctgcgctggctcttcccggatcaaatttgcttgtcccaaccatcctggatagcctgtatgctgtttgcagtgaatgcgacgtttgcggcatgaaccaagcagggttactcttgagggtctaaaaatagccaagatgaggatggatggtgatgcttagatgcaagcatcctaccctaacagccatggtattactattggttctgccaatggaaaaatgtcaaggaacggtccagctgtagcctgtactaccttgttgtgtcaagagtagaggcgatcactgcactgcgatggagtaaactacggttagcatgtatgccttgtagatcctccacttctccatgtcggtggagccgagttgggtttagcgtctcaactggtaagcctaccagttagtttgcttactatgcattatttgcaccctctgtatcaagtcatgtgatattgtctacacgtgagatcacatgtcctatcacgtggagacgggcatctcgagatcagcatctccaacatcaccatcaacaagatcaatcagactactactcaattgaaacggtgctgagcttgtctgcaaaggcaggaacgataactctgaatctgcgtgcttgactgagcgcggtgactgcaggccctcgatccgagcatgaacaccatgagctattagttcacgcgattccagaccacatcagactagcaactcctccgcgcatcgcataccgtcaacagcttcctgccagatccacacctcaaacatgccctccgcaaacaaaggcaaaggcaaaggccgcgaagctcgcccctcccgaagtcgcaacactaccccaaactccagcttcagcgccggcccgaccgcctccgccccgctccacagctacctcgacaatgatgtctccaagttgatgatgaccggctcgaccatccagtatggagaactacttgagcgcatgggcggagttggcccgatccccgattccaagtcactcgagttgttgatggaacacctcaagactttgagccagctagccgaaacgcgaggcgacgcatgcaatgccggcatcagagagctatcacagaagcgtaaggaggtcgtcgaagagcaggagtcagctgagcgggaaggggctgatcgagtgaagatgaagcgagaagccgatgacgaggaggaagagaaggtactgaagggaggcaagctgaagaggcgcaaggaacgcgggagcagttccaaggaggaacgcccgctgactcacggtgcccatgatgttgcgcgacaggacggtgctgagaccaaggttgaaggaggtgagtctatcattcgccgttttgcgatgaagcgttgctacttgagcctttacatcctgcccatccattcctgccatgctaattcatgcagccgcatcaccagcttccaaaaagtccaagaacgctgcttccgaagaggcatcatctttatcccccccattgcgaaagtccccccagccagctgccgatgaagacgccgaggatgcagggtcgcctgggtcggacgatagctctgattcacaccaacctgagcccgcgccggccgtgccacaggtgcaagtgttcggtcccaacccgctcaaatttgacgacccaaccatatatcacatccgggaagttactccagacatgaccgatgaggagaaaaaggccatctacagcgtcgcccgcttcccctggagtgatttgagccatctgatggcgggctcccctccggatcgagacttcagcagctccaagcccgcgagtcaagtcaacgccaatacgttcctagcctatatcgatccatacgtccgcccgttgacggaagaagacatagcgtttctcaaagagaaggtgagccttccggtcgatctcgctacgacctagcgctaacagacccagggcgatcgcacgaccccgttcatcatgcctcgacgcggaaagaaacactacaccgacgtatgggctgaggacgacggactcatgaatgttgaccagcccaacggcgataaagagcggctaccgctcaaccaaggcagaggaaacatcgaccaagtgaccgacgagacggtcgaaaccgacaaagtctccgtcggccctctagtcagccgactctactcactactccgctacgagcatcgagctctccccgatgaaaccgcccccaacgccaacggctccgtcaacggcgacatggcgaacgggcccatgaaccccgactccatggacatcgaccacccaaccggcgaagcctccaacgaaaccaaacccctcccctccgcaaccgccttccccgactcctccccgaacaacttcaaagtccccgccgcaaagctcgaccacgcccagctagacgagcgtctgaaagccgaactccgccacgtcggcttcctcggcccagacgacaacccagactacgacgcccactacgacgatgacatcgcccaacgcctgcgtctcctccaaagcgaactcaaaaagcaaatgatcatcaacagcgcccgcaaaacccgtctcctcgacatcgcccgcgaacgcatggcctaccaggagtacatgaccatccacgacgacttggactcccaggtccagcaggcctacctaaaacgcacccgcacccttggaaaaagcaaaaagggctcccaggccaaacaccgtcccggtggcgccggcggcggcagccatgtcgtcagtgctgcaggtgttggccgccccgcgattggtgatgttgcccggacgcttatggatcgacgtaagcggtggcgcgattgtatcggacttgtcttcaaggatagcaagactagtgtgcctgggaaaaatgagtcggtcttcgagccgtctttgatggctgagattgagaaggccgaggtggaagggtgggatgaggaacaggattgatcgatcgatcgaaacctgttaccattctgcccgattatcccggtttctgattcgatgtacatattgtggttctttttctggcttccttatttggctgatatcttagcgacggttgagtaggtgatctaccctttggtttaattttgggtttaaggcgttgaggaaggatgactggatggatggatggatatgatcgggacgttttccaagacgtaaatatagccagcatatcagctgggaagatctctggattcatatatacagaataggtattaacgaggactattagcactctacttcattactgtgattctcttcttcgtgactcgtattaaatactgatacaggcgtatttaatgtatattggttagtaataaatttagcaaatcgggtatctacatgaacaaagcaagctaggaaaggagcagaggtagtaatcatcgatgcagtatcagcacctcccctggaaacctcttcaaccgcgccgtcaactccctctcactaatttccaactccgtacagatctgatcgaaacaatgcatcccatcgagatacttcgacaacgtcttatcatcaatgtcatcttcctcttcctcaccctcgagggtcacgatcgtggccggccgacttccactatatactgaggttgagtgatggcttggcccaccatcgtgctgtgcaatcggggccgggtcgtctcccgcactagtggcgtaaggactgttggtgcctgtgccgggcccccgcgatgatgggccgctgggcggatgtaatgcgggcgagctgtggtgatgatagtgagaggatttcatgggtggtgctgggtttcctgttgctacggcatatttgtgcacacggtagatgaagcccttgatgacgccgaaggtgatgaagcggcggatgtcgatgtgggcgagttgtcggctgtgttggaggtaccattgtttgatgctttggccttgtttcaggctggcgtagagttcgacgatgccgaccccgtcgacgagttggggctcggtgggatgtatgtctgtagtagtggcggtgtcgtcgtcggtggctgttcctggggcgggagacgcggttctgctgctgctggcttggatggtgcccgcgctaggactcgggctgggggttcgactagggctgcgactggagatcgtgatctcgctggcgctgctggttgtgagagggtcaccgactgggggccagacagtgtcgggatcgtaatgcgggggatagcccggggttagggcggccgaagcagcggtgattggggaggcaaagacggtgttgacgtagcgggcgcactcctgctgcatttcttcgtctgtggcaattgtggagctgaattgggcggttggggcgtagatggccgagaaggagaagatgtcgaggaggaacaggcaaccgtagtagagcagatgacgaatggcgcggcaggtcagggagaagtcagtatcggcaaggatcgaaattatccgtacactattgacgccattgatgtgtgggacgatctggaggggaagttcagctggctggggtgtagtgagaggcgcaggtgcgaacgtacccgttgcatggtcagatcccagttctcgtccatgaaggtctggtagcggaccgtgaacagcggcacatgccatgccttgacaggcggaggggcaggatagatggggaagagcttgatgttgagggtgttcagctcgtctgggatatcccaattagcatcttgagtttgggtagacacgcagtggactgaaagggtaggcattaccgattgggatcatgcactcgcagtaattgttcagatcctccatcagcgtctcacacaggctgtataccttcccctcgccggatttggagtgatctcgcgataggaaaccattctgctcctccaatccatgcattaaatccgccagcttctgcacgacactcttgtaggtgctgaaatcctcctcctcagccagcaccacgcagaaattgaagatgaactcatttcggtcgtatcgcagggacttcatgcagatcggatatcccaggattcgatagccattggtgcagacctggatcagatttccacacagctcttgccggggaatgacgaagaaggagatgtcggagaaagtgaggaagaggggctgcgagggggcagttgcggaggggacgatcgcgccatcgggaacttggtggacgaccttgggcccttagagcagtcagcaaatgacattgagtgagattcccaactagcttgaggcggcgtaccttcctgcgtgtcgaatttactgtagaagatggctttgatcatggtggaatggaaggcatcgagagggaaggggggaaagactgacgagttcgcggggagctgcggggagcttccagcccaacgcggagtttccaccaaataaacatccacccgccgaccgctaactgtaatttccccctcattctccagggattatcacaacgcttttcaagatcatactataattattctccatcgtatgtgttactgcattcttctaatctgcaatttatttcgactctaagaaagacgatcaacgagggcgcatctatgtgcaaatggtgccgcatgtggctctcagggggtattacaactgtagaaagtgaaaggaggacgcgcagagtcacaggaaatctatacggtcgaaagataattcgggaatgtgggaagcagagcaatgagcaatatcgccaagatatccaccgaggaagcgccgcaaatgcataaatcagagtagccggacccgttcgctaaatgttgaagctggcagggaaggaaacctcaagtcgactgccgttctatcgggctgtccgtgacgacgaatgagcatagcgctggatgccccgactcgacagcatggacggggtgggcagaacgaatggctctgaaagtgaggcagatgatcgaccgccgacccttccgaggggcggcattggaggagacgtatcgtataggtaacccagtggctgacccatacggatcgcactgagcacatctgtgtagctccctcgctccccggcttccttcagccactgctcccaatcctcgtccagtgacacgtcggccccctgctcgcgggctgcggtcgctgctatgaggcgatgattcagctcgactccgcagctctccatttcgtcatcgcttgaatcttcctcctctttctcttccacaatgcaatcgatcccccggtcatcgatcaggctgctagtagagcgcacggtctcaaatgtcaccactgggtattccggttctggcaagagttcttcttcttcttcctcctccgtctcatcctcatagtggacttcaatcgatggaagaggagatggagaagcgggtcgaatattgtcggccgtagtatcgcggactttcacgccttcttccttctcgtaacgttcgcgagccgacttggtgccctcccagcggcatagggatgagatctcggtctccgtaagaccaagctcgtcaaaggcccggaacagtcttcggtgccatggaaaacgaccgagcctcatgcggtgcggaccataggaatagtcaagtcccggatactgagcctcggggcagtcaagcgatccatagaatgtggacgtttcgactcgaacttctgggaccaggttgcgggtgatatgtgcggagaatgtagccggatcacttgcgcgcgggcgaggaaataatgtgctgtgcactatttgggccagtgaaggcttatgcatggtgatggtgatggcggtgttgacagcgagagttggggaaggggagcggtgataagggacggaggtatgtagtagtataccaaagagaagtatagaaaacaactcgaaaagaaagggatgttgattaaaagatggagggtgaaacttggaatgtggaaaggaggggaagagaaaagtgaaggctagtaataatagaataaatgagagtttggtcgttcaatagcggaaaggcaaggaatgaatcgagggcaggagatgcaaaaaagggactgtgaatgcaaatagatctggttccggacgggggggcgccgttggggatcgtcgggcaatagtggaaaacggggacgggctagaaaaggagatatgccgcgatgcagtcgtcagatctcgccacggtttcagccgcggcccgcattcaaatattaattagtgaaacggtcgtaaggcgggttatgattgcttcaggggatggccgacgcagaaaggcatgcctccaccagattaacacatggaaacccggtccacacgtgggttaaaatggagatgaagatgagggtgggtatgggacgctgatgatgatgatggctcccagactttatttatttcttgttatcagttcgactttgggatcgttgggctcttcgtgagaggtgctgtaacacgccaaatgtcttgacttcaggtaccgttaggacccaaagcctaatacgtcaacttttgtcactcacaagacctaataagaagggcccatggtgatgacgatgttgatgatcgctgtcggtcgtagggctgttcccgacgcagggaaaagcaaaggaagaaagcgttagtgatgatttccaaaaaagaaaatcaagcccgggttgggaaaagcgaaggatagagatcatgtttatatatcaggccaggagtctttggtgccagtcgggtgacacacactgggacagaccggaccacgcaggcaaatgaccagcgcataggggacgaactgcgtggagtcgtgagttagccaacctaaatccgtgacaacaggagagatccatcgaaggacgagttgtccgcctctcccaatagactcgagccatgaatggcaccgaaacctgtgctggcgagcgggtcttgacgcccactcgcctcacactcattgcctgcaaggccacttggtcgctggcagggctctctctgcccgttggcttcacgccggcgccatgtaggtacttgccctggagagccccggattataccttgataggatcaaggacatttttctcactcgtgggtggaaggcctagacaagggggtgagcagctgcctgttgatccatcagtaacgggccgcggatgggctggtcagtgagtcttggtgcagaaatggaggaaatccatcttgtctggctatttagactagggtctgggcaagtggcggtaagattcagtagatcgggcaggcacagcaacctcatcatcgtcatccaatggtgccaatgagaaaacaaatcatcttctccgtcacacctcgagttgtttctactttgactatcgagttgttcaccgtctcgtaatatttgtcggtcacgtgtatacaggcccccccgattgggaaccacggccaccacaactgcctctcgccatccttctctgtccacttctcgtctcttcttccaactcatcatcgtccctcatgctgcgtttgacgttggtctacctccatcgactcaggatgaattaagttgtgttccgctccagccttggtccattgcgacgcaaccacgtcccatgtccaccttcgatgggtttgtccggggtaggtgtatacttccgatccttcgataagctaagtctgctctctaatgcagtgtagaatttccctccattcagagtaagaagttggtaaactcccgataggtgattatcaactctaaaattcatgcagttgactacttccgcaagaatccagagaggccgcctccgctcgcctgttttctcagccatgtccacagtgaccatcttcaagggctggagtcctttagaactcctttcatatactgctctgcggcgactcgagaggtgcttattgatccaaattttgctgtagcacaaactcatattctcctagatgctcttacgcatcgaaaagtatcctcatcgtatgaactttagcaaagggatcctagagtctcggaaactgcattacaaacatctgtctaagcttctggtatgtatcctctaccagtatcatgacagtaacctcattggcacagaggccgattccgttgaacacgccaacggagctggatctcaccccacggctgtcaatcagagccactctgttcgatgcaaaccactgcacgggcgcggtaatgtttctgatagagggcaatgggaaggctatactatataccggcgatattcgcggtatgctagctctacattagcttccacaagcttacttccttgctaatggtctgtagctgaaccctggtgggttaacagcattatcaggaatcccgtcctcattccctataccttggggaacaagcagctagataacatatacattgacaacaccttcgcccgcccgtcgcatgtatgccatacctttccatcaaaggcagagggcttgaaggagctgttgaacaaaatccaagcgtatccggaccgcactacattctatcttcgggcttggacctttggctacgaagaagtctggatggcactgtcggctgccctcaattcaaaggtgcgtattgtactctacaacagtacggcatctgtactgatgattccagatccacgtggaccggtatcaaatggatctatataggtcgctggcctctcgcagtgtgaacgatgctcctttcctctgtggctatgaactcggaaaccggttcgttccaggctgccttagcgaggatgagggttctcgcatccatagctgcgagccaggcgttcactgtcctgtagctgcgtctcgagataccgtttacattaggccgattgtgacccgcactgatgatggattagaaatgcccgagatcggggctggcgggggaggtggtgatctataccaagttcacgaactcgagctcccggaccagtcagcattggaacagttagaaaagctctgttccgagcgcattcatgatatacatgcgctctcacagacgagacaggctcttattgacgcgttccgatcaaaaaccaaagcactatctctcgataattacggaatgaaagatgcacacgacttgcccctagaagacctcgtgggcatactgagtcgtggccgtcctgacgacgattctgcatcaagcgaagccaatcagcacacacatctacgagacagacaaggcaatccccttcccagaatcatcgtgcgtatcaatcacaaaccccagtccctgaatattccctaacgttcatagcacttcccctactcccgccactcctcctactccgaactttgtcatcttgtttccgcattcaggcccaaagacgtctatccctgcacagtcgatcccgtgagctgggaagaagaggtctcaatgcaaaccctcttcgggcacctctgcagcgcgactggattcgcccacgatcagcagatgcgggacttgacagcaaaagatccagagatacgagcaaggaaaagagcccgctatgaaggttcctttacaacacagtcaagccaacaaacgtccagcatgatcgacagcagtataccggaaccgctccaattaagccatcctccacgcccagcagccaccatcgatccactgtcttcctcagaccggattcctcttccatcgtctctcgagccaatcgaagagtccgctccagtacccacggaccagcctcttattattcccgccctgtccccagaaactgcaaaggcacgccgtgatgagatccgccgtgcctggcacatgcttaacaacgccgagccttcccagcgtgcgctctaccagctcgactccctcccttcctcttggaccgatgaagaaacagaattacccaaatctgaaatcgctccgaccccgcaccctcctctagacaacccacctcatcccacctcaataacggcacccaaacacaccttaccaatcgaaacacaaacgtccaccattaccaacacctaccctggaacccagaatctaacaacagatacccagccctcagattcactcccacggccagatgaaaccgagaatcaaactcaaacgaacagccaatccagcgaaccgctgtccctagcatcatcaacattcgaatctcaggagctggaaccagacattgagcaacgacaagacgatgaaagtataattcccaactatgacggtacaactgaccataacaccacttctcatcatcgccgtcgccaccaacaacagcgacagcaaagtcttcgacgatcggtatcagcccaaatccgccgggacgcatatctagccgcgcgagcagatagcttcgaagcgtgggcggcggtctcgcttatatcaactggggataatcataccgaagaggagattgaactctgatcagaccactgcagtcagtcactcactgctcgcctgctggcgttatactacgcagtctaaatcctcattataacgcttcataaattataaaataagacaaataatgcaattcatatcatgcatggctcatcacgtaagtaagtcaggtcaggtcaggttactatatacaatcctccttccattccacggatatccccatccatctcatgcattaatcctaccaccttcaaccaaccaaccatccacctataagcctctcataaaatatcgtaaaagaaaaggaagagaagaaaaagtctatacaaagaatgcaaacaaaccgaaatcaatcaaggatatcttgctttaataaacgaagtaatcctgtgtcagcggcagacttcctgccggttcggcatcacagagcattccgtccgcctcgacacggtaactttcggggtcgacatgcatcttgggcatgatgtcgttgaacttcatgtcggctttgccgatgttgcggcagtttttgacggcttcgacgcgtttttgcaggttgtaggactggactatgcctgcgtcgagggaggcttgggagacgaaggtgatggaggtggaggggacgagggcctgggtattctggttagtggtgatggcttagacggggcaaagtggggatgacttacgccgaattggggacgcatgatgacgggttggacggtggggatggatgcgttggggtcaccctgtggttcattagcaattgtattcttaggggtttattaattagggggaagaacgtaccatcactgacacggcgatcatgccgctcttcactacttgcgttggcttcacgccaaacgcactgggcgtccataggacgagatcggcgatcttgccgacctcgatactgccaatcatatgggacataccctgcgcgatggctgggttaatggtgtatttactgacgtagcgcttcacgcggaagttgtcggcgccggtgccttcgtcctccggcagcgggccgcgctgctccttgttcttgtgtgcggtgttccatgtccgcaggatgacttcaccgcagcgacccatagcctgggagtcggaggacatcatgctaatagcgccaaggtcgtgaagaacgtcttcggccgcaatggtttccgcgcggatacgagactctgcgaaggcgacgtcctcggcaatgttcttggacaaatggtggcagaccatgagcatgtcgaggtgttcatcgagggtgttgagagtgaagggacgagttgggttggtactactggggaggacgttggggtgctccacgactgagatgatgtccggagcgtgacctccaccggcaccttcggtgtggtaggtgtggatagtgcggttcttgaatgcttcaatggtctgttcaacgaatccggattcgtttagcgtgtcggtgtgaatcatgcactggacgtcgaacttgtcgcacaggtcaaggcagctgtcgatggcggcgggcgtggaaccccaatcttcgtgcagcttcaacccggcggcaccggcgtagatctgctcctcaatgcttacgccaccgcagtcgttacccttaccggtgataccaacattgatgggcaggcggtcgcaagcttggagcatttggcgcatgtgaacgggaccaggcgtgcaagtcgtggcattggagccagtggagggaccggttcctcctcccaagaacgtcgtgataccagaagcgagcgcctcgtccacctgctgggggcagatgaaatggatgtgggtgtcgaaaccaccagctgtgacgatcttgttctcacctgcaataacatcggtcgaggagccgacagtcatgcccggggtaacaccgtccatgatatcggggtttccagctttaccaatgcccacgatgagcccatccttgattccaatatcggccttgaagataccagtccagtcgataatcagagcattcgtgatgacggtgtccagagcatgctgcgtggacttttccgaagactgacccatgccatctcgaatagtcttgccaccgccgaatgtacactcgtctccataagatgtgtagtccttctccacacgaacccagagattggtcagacccaggcgcacgagatcaccagtagtagggccaaacatacgcgcataggcctcacggtccatggagaacggtgtaggtaccagcgcgctgtcggcagtaggttcgggaacatgggcgaagttctgcacttgcagacgggccatgatctcctcggcacgggcaagatcgaccttgccggacgcgatacaattacctccacggataacccggtggcctccaatctccacaagcgtaactaccttggtgtctccgggctcgaaccgtaccgacgtaccagcgggaatgtcgagtcgatatccataggatcgaaggcggtcgaagtgcaactgcgggttggtttcgatgaaatggtagtgtgatccgacctggatgggccggtcacccctgctcatcaccttgagcttaatgcgcttccttccctcgttcaggatgatgcgttcgttcttcacaggtaatatcgctccgggcgtcttctcgggttcgtagtcctccggatcaggatcggggaaggcatctgccgggggaatgggaaggaaacttccgtagagggccttttcaaggtctccatcatcgctactgatagggttgtgtactgtcacgagataggtaccagtggtgaatgtaccttcgacctgtaattcgtaaagagtcgaaacgacggacgggagaacatgacggcgacccagcatgctcttcccgatagacatgagatcggctacagaatattgtccatcccggatcagctgtaacagcggacgagaattaacggagatggtcaagatgattttcagagagtggtgatgggctatttacctcctgcaggttggacgagattaacgcctaccgaagatcgtcagtcaagtctccaacgaatcaccatgcgcatggaatggagctaatatgcaacataccgcagcttcggcatggttgagacgaataccgcgagccagtcgacgctgggccaggaagcccagctgagagataacgagcttgtcaagctggagagaagagcagcaggtggtcagtcaatccgtctgattcgagcagtatgaagtacgtagtgccaaagatcgcagcgtacctccttgggacacaaatgcatgctgggctggcagtgagaatgcccttgacctcaaaatcagagacgtcctcgcgggaccaaggatgaagcagtggacccaacctccgacgcaaggcgggctttctgggagggtggaggaggggagcgggcaacgatatgagatgtcagatggtaaacgcggactttgttgttattttggagaagttgacaggccagaatggaccagggacgcaggctcgggagaggaatttaaacgccacggccgggggagaaaaggcgcgccggatcgggaggtaaaagtggaaaaggtggggatatccagacattccatctttggcatctcatactttggcgaaacgagcgaagccattgcccgataagcggtcggcagctgctgataagcagtgcatcgacctatggcagcccggcttggaccaggtgactaacggcttgcagtcaatcgggaaacttcgcttggaggtttggaactgaacatcggcactcgccggccactgccacctccacttcttgcctctctcggtttagtcgctatccgttcgcttcagcccaatatgtaccccggggaatggaaacaccaccgtagcaactattcgagctagtatctacattctacatgctgctactggactagccatagaataagcagcgatttaggttggaaacaagcttttcccttccttttttattcttcttttttctttttgtggttcttccattcaaattgaactaccaatgacccagtcccaactgaataacaccccgcaaagcgcaaaacagtcaagacgccaacaggtccgaggaaagtaaatgagataacacagcgaccccagcagcaatggtacccaacaaagcaatccgcaatatgctacacacacagagagagagtagtcatataatgggggcaaatttacatcacgtagcagctaccagttgtggcagtagacaggcgcccaattccaaatttgaactccataccttcttcaaatcaccaagtccctcatactcgtatcgtacttactcctcagcaccggcctcgctcttgcgcttcttcttggtggcgcgcttgttctcgccacccgcagccttgcgagcaggggtctcttcctgctccttctccttccgggcagcggccccacgcttcttcttctcgggggactccttcttcttctcgctgggggtcggtgcctccttagcagcaggcttaccctcgctacgacggcgcttggtgctgcgcgggggagtgggctccttgaccggctcgggagaggactcctcctcggactcttcctcggactcctgctcctcatcctcagacgcctcggtggcctcggcgccctcaataccctggtgcagctggctggcagccttggcatcgtccgagtaagggaggccagccttgtaggccttcaccttctccttgtagacagcaaggttgtccgcatacagcttcttccagacctgcgcgtgagttagcaacggcgctctttataatcaaatgggcatgtcaacgtacctccttctggacttcaggcatctcagcccaacggcgagtaccctcgtcagagacttccttaggcttagcattggggcccagctcctcagcaatacgggagcggttgtgctgcatgtagaggaagaagggggtcaaggcgcgcttgggagcgttggggtccgggggagcacgcttgcgcttcttcttctcgcccacttcggacttggcgccagggctggtggcacgcgcaccaagcaggccagactcatacagagagctggtgatgccggtgatgctgctgatgtccagagcagtgggggtgcggcccaggacagtatcggcatggttgagataggccttggtcagctcggagacagccgccgacagctgcactaggctagagacaacctgagaatgaattagtggggcttgttggggggcagcagtggcaatggtgcggatgccagtagtgatggtatggatggcaacggtagcacgggagatgggcgccaccagcgccggggcagacgctgctgaaggcgcccgctctggagatgagcgtccgcgccgggccattgggaaggggaatggcgttggcgcgaaaccaaggaaacgcgcggtgcgattacagaagcgaaggagagggcaaacaaagggaaatcagagccgaaaagccagctgaaagggaaataaagcgaagcaatccaaatgcgaagaccaaggggatagtacaatgctgggttgaggggaaatgaaagccaacggcgtcgcgctgagcccgtcggggcggccttttgtttacggacgcgtggtggtgaatttggggggtgggaggccagcgcagcgcccgtccaccgtagcttaagggagggaggcagtcggcaggccgcgcgcgcgcgccggagggcaaaacgacggaaacaaacgatacatcagaaaaagaaaaaggtaacttacactgtcgcgagtgcgggtaaagtcttcaacattaacggtgacagtgtcatccctagccttggaatcttcgcggcgagacatgatggaatgagcacacggcgggggggcggcaaccacaccggaacgattaatggatgagatatggggggtgggaacacaagtaatgttaggaagaagggaaagagagggaaggcgatgacgggaagaaaagaagatttttcgctcgctagcggggtccagcttagcgggacgaggcctcctaaatactggccccgtccaccgcgggcctcccctcgctgttttgggacttagggaagtctggtctctttctttcggggcaaactagcctacttgctgtaggtaccccgcgcacgccgcaccagcaccagcaccagcacctctttctcttctcttcccccgagcaacggaagaaatcttgcattaccttcatgcagcctaatgcttgttgttgtttatctaatatcatgatgacgatgacgcgcgcgcaattttatgatacatcatattataattgcgtagtatttacattaaaattagaataagatactaactactcagtctttccatgtactacttttggtccattcatggttttcgttagatccttagctgatctgattgttggaattttggagatatatttcagtgggttagcagtaggttgcgcaacaacttaagttatttagtacagcatttcaattgatcgctcattcgcatcaattaaccccccccctaacagttgcaactgtattctatctagaagccatggtatattgccagatatgctggctggttaatgtattcatcgtatactggggtgaagtaactgttggatttttacgagtggcgggaacgatgaagttcatagatttgtgtatttaaatatagtcaaacagaattgcctgagtcgagattttgatagtaatactaagtgaactgcaatgtgcagcgacaggttcagtaaacaatgaaattatcattattatgtatgtggtggtttgcaggtgctgattttctttcattgttcttgcggggcagcagggttctgtttacttttcctgcgtaagcgcttggggtgccttgatgctcgtgcttagtaggtcccctcaggcttatcgaggtaatgaggggctgcttacgcccgcacctctctagtactacccaatatgttagacatggcatcagtgtctctcagtttactgtacaatgtattgatcgcaagtaggtatacaattccactaatgagctctacacgctcgaaatggtctaagatgacatgacatggtctttctttcctatcagatatttcatcactcttcatgtacaccccgtctaaaacttgaagacctgctccttagagtagcccagctccttcaggataccggacagctcgccctggtcggtagggctgttcttggtgccactgatggccttgtacatgccgggaggtccgcagacgaagatcttgatgttctcctccttgggctcgggcaggacggtcttcaggagctccttgctgatgtagcccttgccgccggtccactccttgggagggttgtccaggacgtagaaggcacggaagcggcgggggtaggtgttctcgagctcctcgaattccttcttcaggaggatgtcctcctccttgacgttaccgaacaccagggtgaccttggtctggtcctcggggttcttgaagatctcacgcgcaagctggtacatgggggtgataccggtaccaccagcgatcaggcaaatgtggttgtgcttgttggtctcccaggggtacttgacgataggacccttgaagtccaggcgctggccgacgttcatgctgtgcaggtgctcggacatgggtccgttggggtagaccttgacgacaaggtcgatgtaaccgggggtttctgtgccaagtcagcgaatgtccaaaatgtgctcgagagtgagttgcgaggacataccctcatcgctggtaggggtgtaagggcgaatgacagccttggcgtcggcgggcttgaacttggtcaagagggcagctgcaggttcgtgagtaagaaatccgggtggttctttcagagcaagggcgacatacaggcaacctggaggccggagagagcctccttgtcctcgaactcgaagcgcagacgcttggtgttgtggttcaggacctcaatctcggacagcttcaggtcaaaccatccttggtcaccacccttgaagaccttggggcggtcaacagcagcgggggcctcagcggtggccgagttgtagcggtagagaccgacaccgacaccggtgataccaacggcggcgtagatgggagccagggaagacttgcccttgggcgcttccgtggagtacttgcggaagccctggggtaagccggcattagcacaaaattcggtcgtcggtagagatcgggaagggcgaaaagtgtcggaaaataacagcgctcaggtggaagagggatagagcatacctgtttgaggggctgagcgcagcggaaagcttgacgagcgaacattttgaatgaatgacagacaccaatgcgtgctcaatgggtggtgagacggagaggaaaggtcaagggagccagagcggagggaagaggaccttcggcaaaggtaattagtctaaagctcctcctccctctcggactccgagacgccgtttccgcacatgacgcaatggggccgctcgcgtacctggcggtttactaattaccaattagttaacatttgttgaacatctcatctttttatcgtgtattgcagataagtggatgataggaaatgctatatactggggttatacattgaacattataaaccgcacacccgccataacattctcctgggacaacccccgaggcagcccgatatcccggtcttatggcgtcccttacagaacgtatactacctgcaatatggccgagcgccagcggataaattcatacctggaatgaatccagtttttctaaatacttgaccgaatccctgccttgctggcatgaagagacggtagtttggaatggaaattagtcgatttcctgcgtatatactccaaatgccaagcaggatctgttgcccacaaacccgtcatgctacaggctaaagcccaataattgcttaaaaaggcacctgatcaagtggatagactaggcacaggtagtgccacccctattcggagcaagacgaagtaactgaggcaaaaagccatgatgtcaggcgtgttatgtgttttcccactgccatcctcaacatccgacggatatacatgactaaagccgagccagccaaatacgccactgcgactaggctctctcgacgtcccacaaatggcctataatttgggaacaagaagtaacgttccgacatgctaggctatttgtaggtatcaagaaaataatctggcaaatgatctggggaagctggaataggcgatagagcatacatagatcgaaaaatcctgatttgggtgtttcgaatttagtccagcagtatagaatcaaatccgtgtggatcagcaagtccccatgctacgcaaagcgttctacgatctctacagtacgctatgccccatccaagaataaacagaaacaataccccggtattttttgatataacttgaaagggtcgctgcagaggacttaaagagacataaaaaccatccgtcccattacctgggttgaggaaacacgccctgtccgcgtgctccgtgtccttcgtgcatgctatggccataacatagtcattcatccacacactccgatcacccaaacccaaaacgtcacatttacgcgaaagtagtgggacgagagtaagcgaacagcttcttgccgtgggcagcacggtggggcagggggaacttgaggttcttggagaggagctgcttgatgtaggggcggcggatgctgtcggcgttctcgatctcaacaaccttaaggatctgtaggaacgtagttagatcgcaatattcctcagcaaaagaggataggaatctcaacatacgtggatggagccgaagcgggcacggtggcgggcagccatgtcctggtagagagcctcaacagcctcggtgcggctcatctcacggaactccttgtacatgttgtgggtgccggagcgggagtcgtagcggagccagataccgaagttcttgaccttggtagggcgcttctcgctgatctattggatggggaaaaaagacaggcgtcagccaacactgccgagttgtcgcttgataacggccacacataccacattgatgctgacgatctcaccgttggccttcttgaccttgcggagctgggtcaggaagtaccagaaccgggacttagcgacaacagtgttgggcgcgaagatgcgcatgcggtacagcttgggcgtggggttagcctcggtgggcaggtgacgcccaatgacctggtactcggtgagacgccctaaggatcccagtcagccatgttctcccatccgatgagaactgcctcgtgcaatggcttcagtcgttgcgtatattccgtgcgaaacgttgttgactgttgtgcaagtcgtcggtcctttgcgatgatttcatttctgcgccacgatatcttcgaaaatttcgtcctcccccattagtcgtccagagttgaaaaatccttccaccattcttgttcccaaccgattccagtccaatttcaatcgagtcttatattatccgatgtcgctgagataaaatgatgccgtaaaaagtcgttcaacgatcgcagggggaatatcgcaatagccgatccaccattgagagacaataaaggtattttggaaaaattcactcacccatctggtaaattcagtcagtaacaatttcaatatgtcgatgagcagatcaaaagggtagggcttactttgattgttgacgctgtagtggttagtcgacgagaggtgtgccggctgctggactcgtcgcggaaaggaggatttttggaacagttgattgtgagctaggtttagccctgcttagggctaagcgaccgtgtggcttggttacccacctttcctatttgggaacactagccacactaatggtggcagcagtgattagataagacggcttccctgagcgccgcggcggcttccccaccttcctccgatcgcgtccgcggctggcttcatggacctggaactcctgtcagtgacgccgattgttggtctctgtcgctcggacgtacgatcgccgtgaatgcatgtctgctgctaaacccctccccttcttccccgcctcctacttctacacgcttttaatcaccagccatgtccaatatctttgatgatttcaaggaaggccagaagatcggctctggtgcccgcctggcggcatctctctcccccgtcgcgactgcggagtaccccgaccgattgaagtcgttctattacttttctaacgccgcacatgtctccgccgacctccgatactcgctcttccaggcgaatggcttgaggcttcccaagcaagagcagaactcctgggtcgatatctttaccgcttattggaaagctgtgggggagattgttcgatttgacgactccccaagacatgccagttgggtgaaggtgttcgatgcttggaaggatacggcaaatcaattaatcaggggatactcgacaggcagtttgcaagcctggacagtgccatgcttgtattctgtcgggagatatttgcgggcattcgcgatgaaggcagatgctgagctttctgcccaagactccgtcactttcgacgatcgcttccaagatgatgcgacggatgccaagaatccaaagttggaggaagctacacgagtgctcaacagaatgttcactttgtgtctaagtgaccggtaagctatgtccggaagcgtcgtggatataccatgctaatgttgtctagggcaccgatcgaggaatcgcggaaatggggcatttacgacactacgaacctgttgttcaagacatactttaagcttaacaccgttggcctctccaagaacttgctgcgggccctcaatgcctcgtctgccgaccttcctggcttggacgccttccccaagtcccatattgtcacctttgagtactatgtcggtgttatacactttctggatgagaattatgccgaagtatgtgcttcaatcatcaatgttagttgccggtgctaatagctggtttcaataggctgaagagcatttgtcgtacgcatggaggatgtgcaacaaacatgccacaaagaatagagagtcagtactccacatgccgccccatgctacattgctgactacttcaagattgattctcacctacctcgtcccctgccacctcgtcaccacacataccctgcccagcaaaaagctgcttgcaccgtttcctcgtctcgagaagctcttccgtcctttgtgcgactgcatcaaaaggggagacctgggcgggttcgatgccgcaatgacagccggggaagaggaatttgttaagagacgcatatacttgcccctggaaaggggacgcgatatcgctttacggaacctcttccgcaaggtctttattgccggtggatttgacgagcccaaggaaggacagcctcctatccgccgcacacgggttcccgttgccgagtttgcagcggcattaaggatcggtactcatgctgacgaccggtcccgcatagacattgatgaggttgaatgtctgttgtcgaaccttatctacaaggtgcgtgttgaggtgcccgaactctatcaaagcatttgactgaccaaaattgtaggggttgatgaaaggatacattgcccgtgagcgcggcatggtcgtattgagcaaaggtggaactgcattccctggaacgggggtttaatcctgctatcatctgtcatcgcatctttgatgacagcctccgttttctttacacctatcgaacagtatcgggccaccagtatgccatgcacaagggcataacccaagagccgtcaagatcacggctatggcagggaaatctgcgtcgcttgccagcctgtatgatatgcgctaccacaggtcattgagcagctcccatgcggcatgtatatcctagatggcggtctacaggatctatgcctccaacggcgctggtacattaacggacggtataccccgcagttatgcaagtcgtccagttagggctggtgacatgcctcaaatgcctgcttcaagctgaaacagctgtaatttataccatgatagaccagtttataaataccacataaaatatgaatacctcatgactgatacagtttcgcattcctctattagtccctataatagacacattactatacaacatcgcatcaagcaatacatagcatacaataaccatccatctcaaacaataagactatcccaaatccctccaaccctcaaaacaaaacataataacaagcccaaaccagccgggcttcagatatcactaacacgccccttcacccctcgccgcctcctcaagatcatcctatagtcaatcatctgaattagccaccccgcacacatcctccactttgacaaaggggaaagtttttaaaactcaccatatgattacacatcgccacaaacaaatcaaaaaacaacttccctccacgttccatctccatctgcatcgtcccactccgcttaaacgtcccccgactccgaataatcagcgccagataatgcgcccgcagtttactctccgtatcgggagtgtgcatgtatgcgtaccgcgcactgcttaggataatgtggcaggggatgttggagtggaggccttgtttcttcaaggcgaggcgcttgagatgctcgagggagtatttctcggctgcgcagctatgtagtacatttattgtgtcagaataggatgggattttggatgataatttggggaagaaagggttgacatactatactgctgtgtcgcggaggatctctgctcctaccgctgggtggaagatgatggcgttggggtcggtggtgtctttgttattagtggtcgttctggtattagtagacgatgagggggtggtttccaagtcccatgtgttggtggttttgtcgtggcgaagacgggggtagtagtcgccgcggtagaggtattcgaggacgcaggagaagatttcgggttgttcgtcgggaaggtcgatttgtctcatggattcggtagggcttggtgaggaggaaggggaagaagagggggaagaggaggagacatcattgttgggaggattgcagagggctgcgaagtagggtgagacgcagaggatgtctttgtgtgctgcgaagaggcgtttggttgggccaatggtgagggttattacgccttgcgagagggaggaattgctattttttgttgaattgggtcttctggttagtgggtgcctttcttttactgagggtttgatagggaaaggatgtagaaccttccatctgggggtgtgtcaggggtgtgtctgctgcgatggagacgtcgtgatgcgacgacagattgttcgcgagaccggggtttggcttttccggctcggtatctggaggagatgctgtctgggtggtgggaatgtaggcgttttgtggagagtactctggggctagggcgatggaggccctgctgttgctgtggttgttgctgttgggatagcattgtaagggagggaatttcgaaggagatggagatgtaactggggagaaagaatttgaccctgtagatggaaatcaggggttccttgcgattataaaactactagtactgtaggatactcggtggtagaaagagatggtaagaactggacagatacatgtatgtttgacctctcctatttggagtgccttctttgtctctggaaagggggttgctgaaccacaagcacaggccatcctttctcctcgcagaggaaggggaacgagggaggttcccctgcccttttatttccagatcctggtcgattttgacgcattatatatcaactcgaccaggatgcatgttcatctttgtgcaggaggggccatggagaggggaagagcagcgaacgcgtaacggcaggtactgctagtaatggacgcgtaaagtggttttttgtgcatcgccaaatcatcgcgcagtcacgggagagccattggccaatgatggcttcaaggagggaaattgggaggtggagacttaaaggcgccagagcgaatcagcccggcatgcttcgttccgtccacacccgcgatcggcgcagagactcgatgcatccaagtgagggtagctatggattgtatggccaggggaaacaaggttcttcctggtcattactcatggactaaacgcagaatccatggctcatcacgtccagttggtgtggatgggcggatttcaccatccgtgactcatgggtccgtctccgggatcattctgtctgtgtcataccgccgtgcctggttcgggtgtagacaggttgcatcaacagccgctgctttctggaattacacaaagacaccttcaagacacttagcttcgcatgcagtgatccgattgcatctcctggagacggccagtcactgtgagatgattagtctggtcctttctacgctggatggtgttcaacgtctccaaagttgatagctccgattcctaccccgccaacacactggacggtacaacgctggtagtattatatcctttcaaacatagtaaagaaacgttgccgctatgtacaaccatgtacagcccagttcccgtgcctgcccagcccgagtacgcccataccataacgcctgcttgcaaattgtgtaaccgacgcccattgcggtgtggagatgtgcctgcacttgtgatccgctatatccgctgaactgaccctgtcggttcaactagaggaatacctttcgcgcctcccgaggatgactctcactcgggcagtaagggcacttgaaccggctacccttgcacaaccgtttgagtgactcctccgcgataacatgcccacagggcatcatcatggggggattctcatccgtggtttgctcctttgacacgggacatacaaaaatagaatggaagagatatgacggcggtagcggaatctcaacctataaggcgtaccagtcagtccacgaaccgtcatgcatgccaatcaaggtaacttaccgggagctcattctccgtggtccactcggtgcgtttggctttcatgatagtctgcaacttcaacagtgtcggcaacgctatcgcaccagccgtagcagcaacatataggggcgaatcggccgacaagccgaggagcgagcaaaactctcgcgtgaatgagtgtgccacatcggaccatgccgacgggttattgaagatatgattgtacggggagtctcgcagattggggcaaaatgccatggcacccatgagctgttggacctcgcgcagatacctgggcaagaacgtgtggaattcacgcctgccatattccaaagctgcctgccgtccacccggactgggtccttgctgatgctgtccgccgtagaaaagccagacgaattgcagcctgcacaattcgaactcaaggttactacctctcgcttccaaggcctccttattctccctggaccactgtattgccggcagcaggttgttgttttccttcagctcatgaaggatgtggtacatggtgtggaactgttgccgcacctcacccggcggaacttcatcgagatctaagagcgaggccgcattgtctatagcctctatatctccttcttgctgctttttcatcgctttcttttgtgccatttcgttcaggaactccgacgcaacggaaaactgtccttctcggagaaggtgcatggcgatggccctgttgataaggtgttcttgggacgaaaggacatcatgctcggtgctcggcaaaggtcgatctttgaacaactgcgacagtgaagtagttaacatatgccattcaccgtaagagcctgacgcgtgctaccttatctaacgatttggagtatttgttgagaccactgtgtgtttcttttagactatcgttgatggaatcaaaagacgatttgacgggattctggagcttagccagtgtaatggatgcttgactgggatctgggattgtcctcgtgatcagtatagttccaggatcaagcccgcgcaacgtccgacgaggcacacgcacctgcagcaattgcatctcgtgccgactgaagtaaatctatggtagactgcacgttcttaattccttgaccggccttgatcttcttggaaagccggtcgtgctccttctgcaccagctccatgacggggcagacgggaaagcggtgtccgacagttaccgcaccttcacttaagcaatcgttgcagccatatgtaggtgagcctggtgattgtgctgctcaccgcaagatctgttatgaaggtcaagatcaacaacgaactcgtgagggagatactcgaatggaatagagtcggcttcttcttcaggtcatcggagcatgggcaggtgaggaggagaacggagcggcaaccagcccaattacgacatgaaccatcacgtgcaactatccgggtgccccgcccgcggcccgtttgcagtcaactttccccaataacatgatctagatcactccaatgcaatctataaatgattgctatctacccaataaaggtcttttgtgaatcccagtttccctctaagatactaggcgtttgtctgtcactgagtctcaacactgataagaataatagactcgtaatgagtgcggcatcggattgccagtcacactggaattgcttttcccctcactaatgcagtgagatgccgccttacattgccagctcacaagtagctaactcattacttaacgagttaacaagagaacctgagccactgagcaagtagagatccgtgccttacccgacaagtcctatgaatgcctctgctccacttgtcagatagcatgctggaatcacactgggtgcgtcccacccactcactcttgcaggccctctttgtcctgcgacatccgggtattcgaagcacacgctcgctaactatactggtccgcttcgtttctagagccttagcgggttcctgtcgactggattgccacaacccatggaggtgggcacatttccttgtcttcgaatcaaagttactaccaacggtgcattgagagtgaggcattcagaagagaccacaacaaaggtgcctttctatacgccttatctgtccaagtcaaaataatgtctctcctctgaggcccttggttttgggcaatcttccgaatttgtggcgagaatgagtgattggcctaggcaagacccatattctgtcgcggtgaagcagctctgcctgcaccaggggatccctattcacaactgtttggattctggacgccgacaatgacatagcactggctgtattgcagattgctcttccgtaaaaaggtgctgcctgtcaagatgccgacttaaagcgcagtgagtaattttcggtagtcattaacagctcgttatgtttgggaacaagactgggtccggtagtagtagttccaaggtgacagtagtgggtttccaaaatggcagaacatggcttatcgacggactgcaccctgactcgctgagaaacccacatacaccactttaactaactcagcggatatttccagcttggcagtctggagcatcatgattattcctctgtgtgtgtgaaaaggtgtcggtacctccctagtagtcgcgaagcaagacagtgactgtaggatcatacaggcagcagattccgaccaatcatagccagcatagaccctcgcttacgctagctcgtccggtggggccccgccgcagcactatataagctcagcgcacccgccctccttttagacattttctttcttttcttctccatcctggtgcacgggttttacacgtgtcagtgaggagacatccgagaccgtgtttttgctagttgaaaactacctagtttgaccgctctccttggtcttcggatcggggaggaatttttgaaaaaaaagatgccatgccttcaaattttggaggcggttaagagtgcgtagacagtcctgctgttgcccatttgttagttcatctgggtagtactcgagattggtcttcttttcactgctgttgcctcccttgaggaggcctggagagaagagagcttgaccacctgtaaatggatgtatttatctactgcatgtcactattataatagacccaagatatctggtacatgtgaatccagttcgctgcgcatggttgactcgggccgttctactgggggtactccggactggcagacgcgtccagtgtccgcccactcaccacggcttctcccgtagggcccttgtggcagtgctgaggaacgattgagttgtggctgaatgcacctaggcagctgcgtttcatgcaaaattgattggtctagatgtagtgtagtgttctagaatggtaacagcgtcctcacgcttacccccaaggatcgtaagacttacccaagtagtatcacgctttcctgtgttctgtctatatggaattgagacctgctagtttcggatatacactgtccatcccgtggggtctgtttgaccagagtggcccccaaaagtcagggcgatgatggcttagccgctcaccgctccaggcatggtgggaaacccttgtgacgtcgccaactgaacctgctgcagatgccgcgaacaacaaccacctttcggccagacttgtacttctactttctccttcaatgatttgacatgacatggacagcccttagcccggcttgttaaggctcatagcttcttcaacctcggatatgttacagttcttccttacctctgtacaatacgacaagacccccggagggtcaacgcttctgtctctttcgcctttatttgagcacggcctcctggtttcctcttcttcggatttcttgaactcccacgcactttcatagtatttaaatcacccttttgacagcccttatgtgttaaggaaattgttccgtcttcatcatgccacctcccgcgacgcagacaggcggccaagctccgcctccttcgataaccccccgcgaattggcaaaacactctattaacacgaaagatgtacagtctacacagctcgttggttctgagggacagtcgccacggcatggtcgccagagactcgtattcaccgatccggttgccctccgatatctcgaagaggataatgaagcagatttgctaggtcgacgcttgactttagaaggatatgaggcattcattgttgaacaatgggcctgcacgcgcatgcaccccaccttcataataaccacctatacgggggatccttcgcacaaggtcgtggtgggggtgctgagcgtccccacagacgagtctaggtggtcgccccgtatgaagatgtacttcgacgcagtcaggcaatgccaggcgcggaaaaaggaaacgccattggggacacttatggttaccgacctgaacgagttcccattggcactgactctcattccggtacccgacggtgatgttctgaaacacaaggaggattttattgtgaatgaaaacctgaaacggttgggctgttcaggccgctctggtttaaagctacaaccgccctcacccgctaccgaggggaagttccatcacctttaccgaacgagcgaaaaggtgcctctatacactgccgtcatagagcttgtgaagcaatgccagatcgctctgatgatgtttggcaatcttgctccagagtacgttgacggactgctctgtgatgtcacagaagcggccataaatgattggtggaccgagacgggtatggacttatacaacattgaaccgagtgattccatgttgggtcctatctcagtagccgcgctattgggtacactcatgggggcgcgaaatcggctgcatgctttcggcgctccggtgggtaaggatgcgtttgatattgataacctgacgaaaggcatcggaagctttcaaaaatcacagaaactgaaacgtacccgaatattagatcgacagaccttagatcgcctgcaccgggtgacagcgaaagctgcgaatgcagaaggctggaccgatgccgtgaaatcaaccatggcagaactaagcggacacgggggagagatggtcatgggaatggtccggggccgtgaaaaaggcgggatagctgatatcgagaccctcgatatcgataactttgcacacctggtcaccggtgaacgagcaaaatggctgtggaggggaaagccgcgaaagggcggcattgacgacaatgcacagagtgcagatgtcgtatttactacagacgacccagtggccatttttggacgagtcgaaaacgatcctcgcacgaagatctagtagcagaccgcgcactgcaaagctcagatcgtccagggaggccgccagaatcagcatcgtccttagatgagaaagaccaaaatctgggccggttagtccgaaaaggggtgagcgagaaagtgtcagacgcgcgggcaggatttggccggttcaaggatgcagtaggcctccggtcccatccccagaagcactctagggatgacatagaccttggcggtgcctctactcatttgtcacccatcgatagcgacacagaggtgtctcagtcgaagaaatcagatggtggtgctccagtcggatccgtggatgtgcaggaccatgaaggtcaggccccgaaggatgactcgcaggttgaatctcccccaaggacgatattgccgcaatcacccaaatcaagagcgccagccataaccgtagaaacggttccatcccaggctgattcggaatcgtcgcgtaaggtgtcagtaccccgaacagatgacgaagcgcaggaccttgagcgctggaggacactctccaccgacattaccgtcgatcctcgggagcagacatctgaagttggtattatgctgctgcgtcgaccgcagagctgcactgaactgaacgtggcgagtgactccagtcgtcttgataactactggcctcgccatctgtccttcagcactgtcgaagaggtggtgctgggatggaaggatttgggaggtgaggctttcaaagagaagcccgatactcttctggatgaggccatcatgcaagaagacattctggcctcagatgcacgaatcttcagctcacgtatccaggagcttagtgagcacactgtgccttgggtcgagcagcaagtgtcctctgtagatgatcttagccggtgtttacacgagagccgcgaaaaggtcaacgctgcctacctggaacggctgtcaatctttgagcagatgagagctaggtcgagcgacctgttgacggaagagcacagccaactcaccgattacatgaggagggtcgaactgatgggcgcgaagctggactacgagctccatgttctggattcacgtgtcgaggatgtcgaaaccaacctcgacgagttcgaacggcatgtaaatgccatcgaaaacagagtcaagctgctgatacggggcgagcacgaaaagcaggacaattcctggttctcctgggttaggagacttaccggatgctcgacacagtgactgtgatgtctcttttcccagaaagaagccttgtagacatatatcatttctaatgtacataatttccgagatagacttgcgcagttcgcgttgaccgtgcaatgccaaagacccagtcttcgctaacagcaaaccccctttccagaagcaaacaaccttgtatatccatgtccgagcagaagtcatccatcccaatcagcaaaatcccaggccttccgctcccgtcagtcaatcagtcatgccataagagagaccaaaggaaaacaagccatccagaagagcaaccatgacagatctgaaacccgaatagattatacacgttttatagaaaaacagaaaaaagatccaattagatgaacaatcgtttcgttgacctcgcactttacatgccgaaaccacccatgccgcccttctggttcgcctcaccctgcatcttctcgctgaccttcatgttgacttcgaagaacttgccaacacagcggtcaatgcagacggactcgcccttgttcaggtcaccttcgcggtagtcgttgggaatgcacttcttgatgcaggactcggtgagactggtggtcatgagtgggttagttaagtataaaaagtgtccggggaataggcaaatgtttggcaggaaaggaatatgagcgttataaatggatagacaggatgataataattgaatcttaccggctgaacatgtcggtgaccatctcaacttccgtctcagccgcagcaatcttctgttccgaggaaagcttgggggcgccgccgaagaggaaagacatgatgacgatgtgtagtgggagtggtgttttttagctgggttcaacagattagtagctagtttcaatataatgctggcaatataaggagcaaatcagtcactcacaagtgagaacagagtttatcaatgtgtcttacaaggagtatgagttgaatgcgctgaacgagctgccggagcagacctgaagttgccgggattcgaagctggcactgccgctgccgctcctcaccgccttaggaattttcgccggatttgccaacgcgttatttcccgcacaacttggctctgttctttttctctttccttccttttctcaaaatgtgagcacgtagtagttctcttttcactctcaatgcaaccaattcgcccgttcagggcgtcgtcgttgcgggttggaggtcttttgtctaggtaagcagttttatgttttgctgtgtttttcacaatacctctttttatcctgcacttgcatgatgagacatacccttccaaattacagaaccgctgcattgaagcttgggggtttatcttccaagttatgagtaacaaggaagctttatgtcttctgattttatcttgtctctgctatcattttgtatggtatttgtctgttagacatcttgctaacggcatgttcagggcaggacttccgatttcccgtacatcgcaggcctttcagacttctggcaggcttgctcgagtaatacagcacactcttgcacctctggtacaaacaaggcataacagcgtcgatgcgtatcctgagaaggcgttcaagaggcgtgtgcaattgatcgaagaggctgttgctgagtcgtatccccggctcgcgtcaaacaagaacacggtgagctgtgcggaatttcgtggccgctacagccatctagcagataatgaaatagtagaggatgatacagttgttattaatggtaggtcctagttctagcctagctggccctaccatgtcgtctcgtacttaaatcagtaggtagggtacgtaccttaagacttgttggaggcaatttgatattcttcgacttagttcatgatggccataaaattcaagttatgtgcaatcgtcgtcgactgaaggatatccctccggcgaccttcaagcagttctaccggatgcttcggcgtggcgatgccttctgtatgtttcaccagccgctccttagtattctgctctagactgaacgatatcctatagccgtaacgggtaatcctcaccggactgaacgaggtgaactcactgttctggcgaccgaattaccgcagcttctgtcgccctgtctgcatgatattcccgttgatgcccaagggcaggagaattcgccgtaccctcgacatgttcaattccttgcggacccggagacagtaaatgtcatcagagctagatcggcagttgtccaatatcttcgccaattctttgtcgaccgcgcttttatggaggttaatacgccgattatcgaagctgttgctggcggtgcaattgctcgtccatttcatactacagccaccgagtttccagatcgccaattgtcgttacggattgcgccggaactctggctaaagaggttggtggtaggagggtttgaccgggtttttgagattggaccttcgttccgcaatgaaggtattagtcttcagtcgaagtgtttgaacgaaaactgacgatttgtgacaggccttgacaaaacccacaaccccgagttcaccacttgcgagttctaccacgcctacgccaacctggaggatctcatgaccacaaccgagcagctgctttcgggcctggctgagcaccttacagcattccatcaatcgtcacccttcaagaggcctaatcaggaagacacacctctgccgttctcccatctcaatttctctgcacccttccgccgactcgacttcatcacctccattgagcagagcatcgggcagaaactgccagacctcgcatctcccgatgctctcgagcaggtgaaggcaatcttccgtgaccgcaatcatgcacttccagataaagtgaccctcccccggctgctggacgagctctgcagcatctacgtcgaacctcagtgcatcgacccaaccttcatcgttaacccgccggagtgcttatcaccgttgtctaagtccttcatccaccccaccaccaaccagcgcgtcgccgcgcgcggagagcttttcatcgagggccgcgaagtcgtgaacacatacgaagaggagaattcgccgttcgaacagcgtcgcaagtttgaagaccaggttcggtacagcaagcaggctgacgaggcggaagagatcgacgagagctacttgaaggcgctggaatggggtctccctccgactggcggctggggatgcggtatcgaccgtctctgcatgctattcacgggcatgacgagaatcggggacattctgccttttggcaacttgcgcaaagtgaccacgcgtgctgatgcagcggccgagagtcaggctaccgaagggaaagaaaactagacggcgtttagtgaatgggaagacacgatgacgcgtcttgcggcggcactctcattggcccgttgcaggcgagtggattttcgcgattcttgcaagatctcgtcttgagtgtcttctgaacgttcagtcctgcagacttcgctgggctgctcgactgctgggctggaaacccaaacggggatcagaccgactccaactgcagctatgagcaagctgcctgtacattacatgaattctatgttatagtaaccacacaacccacctcttcattgtacatatccacagtccagatatcacaactctcaactgaatccaacatccacctcttcatattccatccattcggccgatgccatccgataagaagcgccgataagcacgattgaccggcgcgggccgagggcctccatcatcccacctgcaatcttttcccctcattatctcctcttcaccaccaacactcttacaacaacaaaaccaccaacattaataccaacaccaacaatggctctcgacgacatacccgtagcgcaagctgtcaccgtcagcctgcaagagctaatcgatggtacttccacctaatcccactcgacactcaaagctacaaaataataaatctgaaccactccaaaacacatcttatctcgcccaactaacaactcattttcaacaaaacaacaggcacaatatccccccaaaccctaacggcagccttcggccccttctccctgggcataatccttgtcaaagatctccccccaaccttctcccacctgcgcgcccaagtcctctccaacgcctcctacctcgcctctctgccccccagcgccctcgactccctaacttgcccctccgcaaaatacctcatcggctggtccctgggcaaagaaaccctccgcgacggccactacgacacgcacaagggctcctactacctcaactgcgccttctacaaagacccttccctgcagggcgccccctccatcgacacagagttccccgagtacacttccccgaatatctggcctagcgagacggatctcccgacctttcggagcagctttgagcagctgtgtacattgatcattgatacggcggcgttggtggccagagcgtgtgatcgcttcgcggtggagagtgtggatgggtataaggatgggtatttggagaaagtggtgagggggagttttacgacgaaggcgaggttgttgcattattttcctactgaagattcctcctcctctacagaatctactgggggggaagaaggggctgaggataatgatgatgactggtgcgccacacacctcgaccacggatgtctgacgggtctcacgtccgcgatgttcgtcgatgaggaggcgcatgatccctcctccttggaagataaatccgctccgttgccggagctcactacctcgccggatcctaaggccgggttgtatatccgctccaggacgggccaggtcgtcaaggtgaatataccgaaggattgtcttgcgtttcagacgggcgaggcgctgcagcttattacgaaggggcagttccgcgctgtgccgcatttcgtgaagggagcgaggggagtcggtaaggtggcgaggaatacgttggctgtgtttacgcagccgaatttggaggaggaggtgcaggagggggttacgtttggggattttgccaggggggtggtggagaagacgtcgaaataggactgagtgtgtctagtttagtttattgcattggattagcttgctagcgagcttttggtatcttcttgaatatagtacagtccagctcaatcaatcatcatgtcttacccgcttccgctccctctctctctccttgtcaggcatatagttcccctcctctgtttcctctgtcccacctcgcagctggtccatccgtagcgtgaagtcttcctcttcctcttccgattcttcttcctcctcctcctcctcctcctcctcctcctcctcctcctcctcctcctcctcctcctcctcatcatcatcaccaaccgacaaccgactcgtcccctcctccgcctcactaacaggattactcaaatctgcactccccaaccccgtactaacaagcttactgagcttccctaccttcgcaaaattcgaccttgacttcgtcgacggccgtcccacatccccaggtatcttcgcctccctgaaatccgccggtctcgccaccccatccagcacgcggagattagcccgccacatcttcacgtccctggcgtcgctataatgccctacatcctcgccattcagtgagtcaatcgcaagcgtctgcgtgcggaaatcgccccagaaccatttctgcccctccgggatacgctcgtcggcttggcgggagtacacccgtccgcgaagcaccccttgcaggtcatatccgagtgccagggatccgaacatgagttgcagtgcgtctggttcgtagagccggccgagaatcatgtcctgggatatgtcgacagaggcgccggggtgcatgcggtaccagtcgccgtagccgctcatgccgacgtagttgaaggcggagacgacttcgtctggggtgaggggtttgatggggtggagggtgttgctggagaggtagatgcggcggtcgctgggggtgtagaccttgccgcggatgcggacgatgtatttctccgcgagatgtttggatctaagggccgagtcgcagtttttgaggtcgaggcggatctcatcgattaccattatgtcggtgacggctgggttgggggtggaatgggggctgttgaggttgtagttctggggttttaggcggacggcgtcgccgacggtgaggagctcggcgccgatgaatatcccccggctgtagatggatgcgtcgggccagacacctttgaagtggtatttgtctaagaggctgaaggaggacatgatggtcatggcgtattcgatggaggggtggaggttctcgcgagggatgttttggaggaagtgctcgtaggcgttgaacggcttgatggatttaaggtagacgtatttgtagtgcagggagtagctcttgtcgggactgtgagggtcagggaaggtttcgacgcggaatcccgagtagttgatgctctgttctttgggggatgtttgaacaatgtcttggaagatggtgtcttcttcggggacctgactgacgatacctgctcgccattcaggagtgcccagccatcgtttctcgctgggaaagtaaatttggatctgattgttctcagggttccaggctagttcgccttcgaaatctggcgtccagagcacgatttctccagcacggggcagaaaggacggttgcaagtccaatttctggatgtattcgtcaagtggtgaacgctcggctcgccagtccatgcttccgggttctgtgatgtccgtctcctgtagcccttttagctcaagctgtagcacagccatcttgaagacgtctggcgttccctcgttatctgtacaagggcatgtcgccgatcctgaaagctttcctggaggcctgccaggaggtctaccagggggcctaccagggggtcttccgggtcttcctggtggtcgtccgggtggccttccgggggttttgcttgcgcttgatccgggaggtcggccaggtggcctccccggcggcctaccaggggttcgaataagcgttccagttccagaaggtctcccccgaggccttccaggacctcgcttttctgagccaccttctgtgtattgctgtcagcattgcactggaagcctggatagccatggaaaaataccttgtagcctctttgacattttctcgcagagaacgcaggcgcatggttcttggccacccgtcatcaggtaatagaaatgcggaaagaactgcttcgtggagttgaaatacacatctgttggatggccatagaggaaacggtcgtactgcaaagagttagggatgtgaatgcgcttgggagtagagcgcgaaaaacctacaatatcggggtttgccatacgcggcctgtcaaatagagcataaccatcgggcagactgtccaggatgtattctactcctaaaagcagggttagtgaggtgaaaatgcaattatgatttcaatatgctaacaaatgcagcgacatggctcttttcctttcatttcaaagcatatcaactaacgttggcctccacatgatggtacaattaggtataagttgcgccaaacatctcattatggatcccgagtacatagtccgaaaggagtattggagaggtaaatcacgaacaacctcaacagcagccgtgcgaagatgtagagtgctcgatcgaagtaaaataaggccaaagtaaatcatgcgatcaacgtaccacgctcataagctcccgtcttttgcagccacatcgaggccagcttctctcgatagtaactatcgtctggtctcaggaacctctcatctttgggccagttgtcctgggtgccgtcgctgaatgcgcgattgattggaattacgaccattttttgctggtctgatgcagatgagtcttgcataatgactgacattatagcagaaggggcgtgtttcccctgcaggagtagttaaacttagataagattgaaaataagagctgggtataagctgtgattagtctgcacgcagaaggcatattatgggttggaaggaacacgtgacaggaacactgagtaagaagaagtggtaaaaccaaagggtagaaattcaggaggaaaggagacaataagaaagctatgcagcattgatgatagttgaaatgaatgcatgggacgagaacaggatccgctctgccgccgtgggtgacggtcatgtgactctacagatgggtaaatcaccaccacagcttcacaataacatgtcaatctatttccatcatccaaaagtctaggcacagattcacccggacactaattcaacatgcattgataaacaaacagtggtcagtggtcagtggtcacggcctcaaccaacctgatctgaagtgtaggagagcctactgctggtcatcctgtacctcaactgcttccgactctgatccatagggtggtggagcaagctctccttcttcaacccagactttgcgtagctcgttttcaatctcctcccgacgctgtttccactcttccaccttgtcaagccgctttcgtatctcctgcagctccttctctactcccagcttctctttggcggtgccgattctctcgaactcccattgctcaccctcttcgccaatactaatgctaaggttatatgtgtgatacttcttcagcgacgcgcgtgtggagatcgtgatcacggttattccccgctcctttgcccgttgatacagcaggccctcgacgtcagaagagaccgctgaggttccttcatcgaggaaagcatagcgaggctcgtggtagtaaattcgtgccaaagccatgcgttgcttctctcctccgctcaaaacgtccttccactccttgcgagtgtcccatccgccctctcgcccagggaggtagcccagatgagcgtcgtccagaattttctgcagtgcagcatcggttatgcctgcctcgtgcatgtcgactgcagtgtgagggtagattacttgatcgcggagagtccccacgctgagatagggccgctggggaaggaacatgatgccgtcaagcccaaaccctcttgggcgactgaccaaaccgcggtacactggccacaatcctgatacaacccgggcaatagcagtcttgccgacgccattcggtccagatatcagaagatggtcgccggagtgcacgacgaatgacagcgactcgatcagatcatcgccaccccgggggtatatagaaggtgcgacgatgggaacttgttcaagacgtacaccatcaaatccgttatgaatcgtcccttgtacatccgcgagggaatatagctctgcatgggaattgcgtggagggtagtaggcacttgcatgcactcggtggagcgtggatatcaagctgtagacccgagacgtgtacccagccagctccgagatgtccttgatactatacatcatccggccacccgcatccgccaaagacagcatcagacgtttgttcgtaataaactccttcatgcgatcgcgttctcgaccagtctcctttggcacgtccaccagctccagggcaccacccatgccgccccaggctggaaggaatattggcagggacgtgatcaggtagccaaacgcagaccaagcgtatttcaggatgacgtcttctaacatgttgtagcggatcttgagactgtaaataccctccatccagcgctggagatctttgaagcttctcattaggaaaaccctttcgatgtctgcaccgccatagaaagaaatttcctcggcattggcgagtaaccttgaatgtagaccccggaagtcaccctctttcttcccctcgacagcctttagctttccgaacggtggcgagagtttcctcagaactgctgcggtactgaagtaacccgtgagaatacccgtaagcgccagaggcccgagagaacggtacaattgataattaaacacgaataggtccaccataggcttccccatggacgaatataaagcggctgctgcagaacagaagagggtaaggtcttgggtaatgaactggtctggtccttggccaacaccgccatccagattcatcaacttgtagtagttgttgtcgccagtaagataaagatcgtggatatatctcgttagtcgggtccggaacgcaatagacacctttgattggagaaacttgatcatggcattggtgtaggaagccagggtgccaatgccgcaccatttgagaatgccccaagcgaaagcgcgccctttgccagcgacaagatccctcacaatctcgccgtccagtcgtgcgatcagtagagataggtacgtccgcaagagcaagaaaaccccatggcccatcaataatcctgtctctttgctaccccatctcgggaccataatactcccaagactgaggaattgatgaagaaatgccaaattgatccctggctttgtggttggcggcggtatttgattcactgattctccgtcgccgacacgagcggcagcaggtgggttcaagaacaatcgccgatgcgcatcgaaagtcgtttgtttggtcggatgaatcacaaccttggaggtcatggagcccttatagggcacatagatggtacgagtgccatctttgcctcgaatcccggaattccgacgcagcagctgtcttcctcgtgcacgttctttagccctttccctgaaccatttgtagcctccataaccagaacccaagatagataggatcagtgcgatcgtggcgatgatttgggttgtctttgatgaacgcttgattcgggagcgaacgagactggcatacttgttgtacagcgccacgaggggatcttctcgacgtcgaagggttgaatgagcggccattatttctcgtgtatggccagaaaatcacttcaagtacagactgtgggcaccttataggacagtgccctcacggcagctggcattcttaggccagactgtcgaaggccatcaggagatggtggaagcgtccgcagggatgacgcgttctatatcgttccgtggtgcaatttcgaggtcggaaatgctgtgagcagtaaatatgggtaagaataattgtggttgtgagactgttgttagcggacaactcactcaggagctcacattatggatgaagctgacgatgttgtggagagttgatgcatgtgaagacctcgggccaacattgcggaggggcggaggcgcatctcacgtgcggagtccccagaccttcattacatcaggatttagcatcacagagacctgctcggttattttaagaaacttcccataagcctaatatccgaaaaggtggtacgtataactttttagattgcttctaggtgttcaagtattcaatgaacccgttgacatcatccggttgatgttgtggcactgaatcatttgatttcacagatcatgtaccacatgtagtaaatgaggcacccaaattgaatcaattaatcgacagtaaaccggctgtgataatgctctgcggtattgaaattggcaggtccactctctatcagtcttactatggaggcccttaagcgcccaacttcctaaatgggaccaagtgcgctgcaaccaagaccagccggatagagaagtcgggtacgattcatgcgatccacaaccgaatagaattgggggcattttacgccgtgtggaaggaggggtctgatcattgggatgaaagaagaaggtaattctcgggaaattacatgatggtagctatactccatgcgacgaaagtacctagacgagagtacggtagtaacgaggtcactggttcatctgatagaagtagttgttatctgcatcgatagattgatctggtgcaggtcaattaagcttcaatagcgggatgttgttggtaaaatacaagatttaccaatatcgcacgaggcacctaaatttgaggtcagtgcaggtccgggagactttaatcggagaaccatatggcaggccggcactttggcaaccaagaaagctcggagagatcaagcgaatctggatcgttgtcagatttgaacacggcatttcttgattccgatatcttggtctagctcttccatttgtcctcgatcttatggcttggatgccaggaactgaaggcataaacgaatatcttgaagaacaaaaatagcatccgaaggctgcagtctcgcacttgatgcgggggttggatacaacagtggggatggcatggagatcaggtcttacggggtaattaccagctccctctcttgctgctgagtgatggtatacaagtccttgccagcggtacaatccaggctgtctccgcatacctgtctgaaaccaaaacttgacaatcacttggatctcaagacaagcaaagtggtttggagaatgcgccatcccttgtgtgtcaatgatcaaccataaaggatattggaatgtagcacttaggtagaaataggataggaagattgtattgttggggttgttgcttaactcctacctagcaaaccccgcataatatggatgactgcagtggcatcttctttggcaggaatggctatcaccctttgaagcggaccgttatttacgaacgtagggtaacacaaacgaaggaaaggggatgctgatacctacagcgtatagaacattgagactaggtatgtgtgcaggtatgcaagcatgggtaggtggctagataggatgatcgactctcctctcgacaactgcacgggcctatttttgttagagagcatctgattcgcaggcagtcccaagtggatgcatggaatgacgccccgggcgcattatccgccagccatggtgatgagcctttccggactagagcatgttaatggtcttggaagatgacccaagacctctaaaagctagctgctgaacagggccttggacccagcgaaggaggaataagattgacggcgacatgggagacctgagcagtcgctgaagccgatcacggtcggtgatagatagccaatggtatgacttattccaaacagaataacggatgatgcatgtcttgattgaccttatagaatgctagagggcttgaagatgttagatgtgagcggattcgtggtactgtgttagggcatgggggtttttttaggctgagggctggcaggacgaaaagcgaatgaagatactgatttcctcggagtggaggtgcccgtccaggatctcagtcccagaagactgtaatttcgactcgatcctgtattaggaggtactgatcacccacaatagctgtaagttattcttgggccttgcctacttggtattggtgctgcccgcttggctgagcaggagaccgtcgtcacctggaactgtttccggggtcttgaagaggatggagggagggccagggtgtaggtctcccatgattgttaaggtcatgagggatgagaagctgcaggttcagtgaaggtggtgtggaccataaattgacccgactcgtgcagaccatactattacggaagagagatgttacggccaaagaaaccacggccccctcccaaagacaccatcaaatgctagcagatatgcacgacggctacaggtcctctaaagggactattgagctgccagatataccccagcctcaccttgtcagtggtggttgagaccaccttgactcttggctacctccgattcgtcctagaagcgcccgcggaataaaagacgagcaaggtccctgcaccaagccttctggggggtaacaatgataacacttactttcgggctttgctatgtgatcaatgagagtaattattgaaaataaaatcagactttcataacttctcccaattttggtgatatttctaactgggtgcgactgctacataggacggcataggcctgttcacgagtcggaacgtgttccggatgacctcgagtcgaaggctactacatacagaggactacttactacctgggaccgggctgtgggtaggcgtgtaactaactagcttctgcctatgcatgaattacatcagtctgaatcaaatgaagtatgggggatcctgctggtatccttatcatccacatgtctgtgcaatagtagttaatctgaattctctgaggagcgtggttcaccatcaccatgggtgccggcaaagataagttggtacgacagacctcatagtgattaaccggttccaatggggggtaatcagggcgtgcaaacttcaaggtacggggcatctcccgtcaaatcaggcccgaacctgctgcgaatggagactgaacctccgtcccaatgctggaccagccagtcgtagcagttctgagagtgtctggccccaattctgcagccctgcatcttttggtccagaccagacttggcctgtgttctcccgctttttctttttccatttttcttcccttttttcattcgtcttttctcctggggcccgtactaatttctcatgcggtttccgaggtctgctgctttcctcttaccccttgcccccccgtttccctaaggcacatccgagcatccatcaatgctcgtccctatttaacggtacctcctgtatctctctgcacaactggttagttaatttaaggtcagcgcatagcaacacgaatggagtaattttaaattatttttcattttctgtctcttattattatcattcctgtattataattgtgataataataataatgatgataattttggttttattactatcatcattgctgtatttgcccgcccacttccacctccctcccctcccctccccttctcctctctcacccctcgggctctgcgtattcttctgctaattccctcttactctatctttcctcttttcgctcttattccctttcccccctttccccttcgtctttctctctcttaaaccggttagccgccagtcaaggagctaagaaataagccactctccactatcatcaaccggcttgcttgaccacatcaaaacaccaccgcacctgggctgattccccttgacttccgtgctcccctgtcgctcatcccgactgtagaaaaaccgtcatcagaccgtccaactagtggaaacaggtctcttacctagtccgctggctacactttttttttttttttgacacttcctttgcccatcgactaagcgaaagggacgaacccacagcacaagaaatccgatcaccaaccgccgatcagattactttctcggggggcacctttttagagttccttttcaccttaacttccctcccgctggccagcaacccgtcagccccagtgcaacaagcgatcataccctagatcgtttacgttacagctattattcctctccaactaactaactaactaactaacccatctaccgggctgtctgaccggtgacctttgcctgaaccttgcctaaacctttttatcacattctactactccgtaccattcttaaatccaaaaggtcatcacgagtcaagaggcgccctggcccaaccacgtgatcccctactttcaaacagcctgcacttcacacgctcgaacccttccattcctgcgatcatccccagacttgacctccagatcgtgccggtcgcatatgcttttatgctcgtctgccgccctgtatattctggacattggagggcggattgattggatctgctcatagcgaacgagttctttttagtgctgcgcactagccttattccaggcggtggtccgggtcccagagctaagcaactcactggtactaccaccttagtaacctgcctccatcccatccattcagtacgtgcgaagagccaggaggcgtgactgcaccctctctctctctcctcatcttccttgccggcgcaacccccctccctccccttctcggcggtaaccctggtggtcattgtcctccgactcctctctatctcgctctcgctctctcttttctactctcgccactcttcttccccttggcctttttggttttcctgtcggctcagtgaacctcgctctgctaccctcaatgctcggagggagcttggagcgagattcttcaccatcaaactcaaaaccgaccaccggagaagcgcccatgcctatcgcgacgagccccccggactccagtaagtttccaacaccgttgtttcctggattcgcagtaaaattctccgatgcgcttcggtcggttccgagtattgttactgatatcttcttggttagatcctgaaccgtcgcctcaggaccagcccgccaccaccgatgcgtcgcctctgtcgaacaatgtagagcccaccaatgcggctcaagagtccgtcgcaccggcccagggctcggtagacgagtctgcagccacctctgccgacgcaccgaagaaacatcatctactgttgcccatttcgtcgcgtgcatccttaaaagcggatcgacagtctacgctggacaagagtcaagacaccgcccacgatgactccgagaatactcttcgcggttcgaaaagaagcatcttcaaaggtcgtagggacaggagcagaggcagcagtatgaggtcgcgtcggcagaaccaggagggggccagtatggaggaagacaagtcggcaagccctgacttgcgtgatccggccaagccagagaggagaagcaaggtctcgtataggttgttcgctttcttgagctgttgttcctcgcccagcgatgattcggaggaccctgccatccccgtgaagaggacatccagacagccatcggtcccccacacccaggccactccggagaaggccgacgccaatgctggtgattcgagcaccgcggaatccaaagacccaagctactaccgggatgagaaacccaacatgaccgtgacgtcgaaccagtccatgtctcaagtggacgaagagcgcactgtgactacttccgagcagggcgctcagctcgatggcgcaacggtaccttcgggcccggcagagacagaaaaagtaccggccttgccacaggacagtgctgattcacaggggcttggtgtaggccagagtactcaaccttccaccacgaccgccgaagcgagcgctgttgccagcgaagcggaggaacccagtcagaaaacagaggagcagataatttctacctccacagagaaggctcaggatactccgactgctcctatagaactggatgaattgcctaagcccccggcgtctgaaaacagctatgacgacgagaagtacacttcacacgatgaggaggcgacagtacttccagccgaattgcctcccccgacgggcccatccggacaccacgtcgacacaatgctagaggagacgcaacagcaattcctcttgccaccacctcttccccatcttcgggacaggaaatgcttggttcttgatttggacgagacgttggttcacagtagtttcaaggtccgccctccccagattatttacccagtgccagactgacactatgttcaggttctcgaacgtgcggacttcaccattcccgtggaaattgaagggcaatatcacaacatctacgttataaaaagacctggagtcgaccaattcatgaaaagggtgggtgagttgtacgaagtggttgtctttaccgcttctgtctcgaaggtgagttattccaagacgagggttgtcggctacgcattcgctcacgcttcattagtacggtgatcccctgctggatcagctagacattcacaacgttgtccaccaccgactgttcagggatagttgctataaccatcaaggcaactatgtcaaggtttgtctcggccagctccattcccttgcgtgactaggatgctgatccttgtgttaggatctttctcaagtaggccgcgacctacgcgacacgattatcatcgataattctccgacttcctatatcttccaccctcaacatgcgatacccatcagcagctggttctctgacgcccacgataacgagctacttgatctgattcccgtcctcgaagaccttgccggggcacaagtgaaagacgttagtctggttctcgacattgcattgtgatgcctgtaactctagttcttctggcatttgcattacagcatgcttatcttcacattgcgggtccagtcggtttccaaaaagaaagagtcgtctgatctttgttcaactatacgcatggaacgtctgctgggtcgagcaaccagaccatccgggcagctcactccagtcccgtttggaatcggaacactcgcggcagttccaccatgaagatgtgttcccctttcctgttcttcccctttttgaccttttttccttttaccccatgtcacttgcaccgtttttcttccgagcaccggccatgttcttgcgctcccagcgagcagataccagattacccccgccagtcttgtttcctagtgtttgaagtttcctttcttgttgcataccgcaggcgtcagtcttggtcatcagccaaaattttgctgatctcatgtatacgctccccgatttacattccctcttttctttcatctgtctctttctacttttggttcctttcatcgtctccattttgtttcttcttgcttaacatgtagcccatacgaggctcgacccaccgtcctggttattttcctagtctccttgtgcccgaagatgtggaccccaaaacccagcgttgtttttgtcattggtgcgccatggtctgttttttggtaactcccttgcgcgtggcattttgattcatgtctcaagcgcctgtcgctgcttctggtacacgcatagtctgaatggtcccggactcttttgggatcggcgactttgcaatgtatatgtactgattgggcgtgcgtgctgtacataaaagcgtccgcctacaccattcagcttgtcccgtgtttaagtagttttgaattgaccatttcacgagacggcagagctccaagtaatatttagtctagatcagaagtagtgagaaaacgagaggcagtaacgcatgtaggcagggtgattggcgatatatcatgcatctacagcgtgaagtggatcacctcccacggcgaaggcgggctgggatcacgccgcggcaataatgaccgatcggtcatcttcaaatcttccatcgatcccgcttttgtccgcactacatcgtgtcagctcatgtgagtattccccgattagccccgtcataaagtctttcatacatatatacatacatatttcccctgcaaggctgcgtccgttcccttgagcctccatccaaagctccgacgatctcctaatatttcttggcagcgtcataccattctccccgcctccgataccatcaccaccatcaaccacttttttctcgcaggacctccctacacacacgcgcccacaccccatcgctcaccatgaaggacaagaacggctgggatggaaagctacgggtcgaacccaaagcgacgatcacgaacccggaagcgctagaagaccccgattactcggactcggatgcgccgcctgtggaggagatcgaggccgatgagggtatgtccatcattgcccatatataccgggatgctgtgaactggtataacggtaacgcgagagaaaatatactgatagtgggtttcgtatttagatctattggaggatgaggacccggacgcagaggtatacgctgatacttnatccgacgcgacgcgttggttgatggacacaaccagctagctaacacatctcacatcaggaaatcgaccttgttcactgtcgcataacttcgattccggcgttgcgattggagcggtttcccaaggtgaaggtatggcaggagtgcccggcatgtgtgtggccgcgcgacccagtgctaatagaacggtgaatggtatagagactatgcttccgacagaaccaaatctcgcgaatcgaattccccacggaagttgccaaatcgttgacggaactcgatctctacgataaccttatatcgcatgtgaaggggcttgatgagttcgagaacctgaccagcttggatctcagcttcaataaaattaaacatgtcaagaatatttcgcatttggtcaagttgaccgatctgtactttgtgcagaataagatctcgaagatagagggggtggagacgtttacgtcgttgcgtaatttggagttgggggcgaataggatccgggtgggtcttgaatgtgcttcaagtgatgattggggtattgttctgactggttgcaggaaattgagaatctggataatttgaaggcattggaagagttgtggttggggaagaataagattacggaattgaaggtccgtggattgcattgtgattcttaggtgtgatatgcgttggctgactgaccggggtgatgatatagaatctcgatggcctctccaacctgcgcattctctccatccagtcgaaccgtctcacgaaaatcagtgggctcgcgaacctgaagaacctggaggaactctacgtgtctcataatgcgatcaccgacctcagcggtctcgaggagaacacttcgctgcgcgtgctagacttttccaacaaccaagtgtccaagctggaacatttgtctcatttgaagaatctggaggagctgtgggcgtccaacaatcaactgtcgagcttcgatgaagtggaacgcgaactccgggacaaggagaatctccagacggtgtactttgagggcaacccgctgcagacgagagcgccagcattgtatcggaataaggtgcggttggcgataccgcatatcatgcaggttgacgcgagtaagtcctatcgtctatatctactaatgcttacggagatactaacaaaacccaatgtagcgtatatccgcgtcgtgtaagggaacaacctatgttcatcttctccataccatcatcaacatcatccataactacttatctacccacctacctacctactctattagaattacaataaacgaagtgacgtaccgtagcccgctatacatacatgtacaacccaccgacccaaccaaaaccaatgcagtattatacagagaacgaaaacaaatcatacaatcatcaaaccacttcacttcacttcgtcccctcatcctccccatccccattcccactctcctttccattctcactctccatcccaaaccgatacaaccccatcaaactcttccccccaaacctccacacatcccgatccagcattctcttcacccgttccggcacatgcgccttcctcctcatcggcccatccgccaaataatccaacggtatcccgctcttcaccagatccttatacatatggctttccttgtccacgtagaagaacgtatggtaagggttgcgcgtcatcgccgagacgtggttatgccgcgatggttggatcgtgcatgtcagggtgtgtggttgttgcgtcgtttcttgggattgcgttgctggtgatgctgtgtggtttgcattggagggagattcgtcttgactctgggtttgtgtttgtgtttgtgtttgtgtttgtgtttggttctggatgggaatggaaatcggcgatgccgcaatggccgaagacgccgcggatgcggactcgaagatggcgatggtgttgtgcgcggatttgggggatgtgtttgtggggtcgtactaaattcaccatatttctttagcattgggtttatgtatttaggaaaaaggggggtaaggggggagagggctacctttagatttcgaaatgtcacgacttcgccgaatttctggagtgcggagagaatgagtttgctttcggagagggagcgcggggcggggtgggttttgatgtggatgctgctagttaagggtttgagggtcattttgtctttattgtgcggttcttaggattggagttgaggggggtgtggtgggatgttcatgagtaatgaatggatgaattgaaagggagagagagggtaatggatgaatggatggagaaatgtggttatcgcgacgcggtcttggcgggtttatctattttatcttatctattatctacatgtcacatgcatcaagtataacatctaagttgttatgtattcatatatatcatatacactcatagctgaatggtctagaaaataggagcgtagagtccgtactgtaataatcaagttagcaaatatccccacgtatcaaataaaaagcggaaggaaactcactcccaaaggatcattgaaccgcaacccgcgatccaacccagaaatagccttgatctcctcctcctccaaattccacccagtaacatccaaattctgcttcaaccgctgagggttgttactcttggggataacagcaatccccctctgcgtcgcccacctcaacaacacctgcgccggcgtccttccgtgcttctcggcaatgctcttaacaagctgatgctcgaacagcggcggcgaatccaccgcattctgcacactcaactcgaggaaactcaacggaccaaaagaactatacgccgtaaccgtcaacccctccttctgggcatactcgaccaatcttgtctgcgtgaggtacgggtgatgctcgatctgcagcgtggcaggacgaatgcgcgcataccgcagcagatccatgaccagctgcgcagagaagttactgataccaatgctgcgggcaagcttcttgtccacgagcgactccatcgctgtccaggtctcctggatcgtggcgttgccgaactccagttcgtccttctcggacttccagcccggcgggtagcggaccgcagggtcgacgtatttcagagagatggggaagtgcacaatgtacaggtcgaagtagtcgatgccccagtcagcgagctgcttgcggcaaatgggctcgacgcggtcgccatcgtggaagctgttccagagcttggagacgatgaagagctcttcgcgcttgacgagaccgtctttaatggcgcgggcgatgccttggccggcttcgacttcgttgccatagtctggtttgcgtgtttagattgggaattggtagtgatttataaggggaggggagggtagtaccgcaggcgccgtcaaacagacggtatccttccttgatggcgtggtagatctggtcggcgcaggtgtcgttgttcaccttccagagaccgaagcccacgaggggcatgtcgtagccgctgtttagctttactgtgggagaggccatggtgattaaggagtaacaaggtcgtgttgagacaaggtatagagacgcggtcgaagcaggatcagggggggatgaagggagagaaggggaaggtttggaggggtaataagtaactacccctcggtcatggcattatgaacttaatccattgcgcgtatccactggaggcgccatacacggcacggagagcggcattggaggctaaatgaagttgtggcggctgttttgaactggggaagtaacttatccaaaggctggccggaagccatccaaagtcgggcccggctaaattaacccatttgccggctaaatgcacgccactcaagaccctaatcttgcttttctaccattactacgtttacaacttggaagataatattactgggatatttgtaataagaatagaataatcattgtgaataaaaggtatcctgccattattatacactgcatatgaatcgaagattaacccgcccatcacattattagaaatactttttttcgcccgtaattatcattaagtattctcgcttggcctgttcattaaacggcctgtactgtattactcgcggtgtaagagtgcgcgtgctcatgcgctcctccgttcatatcggtcggcaggctgcccggccacttatcaagctcctcaggcataaagtcatagctgtggctgggatttggctcacggggcaccgcaacatggtgttcggatgacgggtagcccatgtgcgggtagtggctgccggggatgtccccagacattgcagtggttggtggcatccaagatgcctggctgttgttgatatcatcgatagactgtgcgctcgtcaccagcatgccattcagcaaggcattgttatcgtgcacattgaccccaagtggctggctgtggacatagtggctatcatgctcaaggctgtaaggaccatgcgtggaatgcgacaaaggaacttcagacatgctaaggatgcttgtgccactgttggggccattgagactagtctgctggttgatatcatgtgattgtaggcttgggaaggcatccagacccaaggtcacggcgatcttatcgttgaggcggtcctcttgcttaaggggactcatgaaatcaaaaggcgcgttgaacatttgagcaacgctctcctggcctgtcgaatacagaggccaagggttttgagaaactccgtggttatgaagcagctcgtgggattggggttggtggtagacactagggcccggccggttcaagagtatcgagtcagccagcgacatgggaggagggagatcgatgcccgtcgctgccttggggctcgcgtgagggattcgatccgacgaaaccactctacgccatgtcgtggtgccgactacgtcgcgaggcagcgtctgtcggaacttccagaggataattgccaccctctttttctcactcacggcatgtccagagtaagggttggacattctccgcgagctgtagggtgccatagcccggatctcctggactacagtcaggtggcggaggaactccctagcttgctcgtggccatggtgtccagcatcctcggccatcttttgatcttgcgtgagcttggtgaagcgattcgcccaccatttggattcaaagtggggcttgaccttggtgtgcgtcgcggtgtgcacaggcctcgcgacttcctggcgcccttgatagatctcttggccattttcatacatgtagatcttggaggaccaattctccatctcactgaggatcggaacgccagccgcactggcctgggcaaaatctaattccaagtgaatgccgagtttagagcgagcagccgggaagtcgtccatcaacttcaggttggcttcgattaagataatgtcgcagtccaacgacccattagaattcgccatcagcgaattgaggtaaggaaaagatgtttgccagttcctgatttcattcaaggagattggtgcgaccggatggcgctggtcgtcttgaaggcgactgtagatatggctcgcgtcctcgatacgatcattcttgtctggctcgtttacccacataccgaacccgaggccttgaatagtactgaaattgctctcgggccagctggcgttcatggaaaatggggtaggcggcagatctcctccataggcctgtctcatagggtcatgataggtggggtggaggtgagtgccataatgacttgacaagggaggatccatggcaggcccccatcttggaccagcgggcggatgttggttgttcgagcggacgttcgcctcttctcgtacgagtcgctcccctagacacttttattagaccagtccgacttgagtattacttgaatatgccacttacaatcggggtctcctttgaggaacgagtcgaggacttggaggtggctggagacttgctttctagttcttcgtttaccagttttcttgtagatgaactcagcaatgagctcatttcgaccatatgactttcctcgctcggaccatttccgtctgcccattggcggattcgcctcgagagctatcacaacattagctttcatgtaccgttcatctgaagcattgacttctcaccttgttgaaacgcgtcttcaagctcgtccgaccataccggttccccatctttgccagtgtctcgacgtggacgggacctgtactccagatacttgctggacctgagatagcttctgggcctgctacgaggaccgattaggctgggcccagataaatgcaggcgccggagcttcttgctctggagccggaggttctgagggggctgaagggtggtgggaacagtgggcactggatgtgttggaactgggggttgaggatacttgaaggcaagttgctgcagctggtcgtcacgaccaacagtgctgctgtcggctaggttgtcagagtatgtctggacgttcccagaggtgttctgcagggccctgtccgtatgggcaccgatgctctcaagagctgactggtgttgaggcacaatacaccccgtttgccagtgcgccatcgagcggaccaccggagaggattgactctgggaaagaatgacaaagaatgccaaagaggagggtgatggaggacagcaaaatgctttctaccgccgtaccaaagaaccagtagtcacaaaccagcgatcaagaacgtagatgcttggagagaatgtaagaattgggaaagagaatgtgggagcgaagagcatggtgtttataggaaaccactactctccctggagagggaggcctagtggcatagctgaatcacgctgctcgttgatacaccacccctccaagggctatgtcaactgttcaaggcggggaaaggaatctcctcccaagcttcacgcgtccaggtcgagctatgaacgaaggaagatcctgtgtccgagcaaatcaggaggaaaggaactgcacgatgggaacgagcggaagacccatgcaagggatgctccctgagcacgaaccagtgagctgctcctcggaggttttagtgcacgagacgagcagtgactgctaatttgagatacatttaggagcagctagacgtccaggtccgtggcaatggccatcctctggaatgagcagtggccaacgaaatcgtccagtgccacggcagtggaatgtaagaggtggttacgtagatcatgttggaatgtatggcctggacaatcccaggaccagactaatcttcacttggataaccagggctcgagcaactaggtgtataaggagttaagggaaggaagccttgaatcggcgaggataaaggaacccgcgatgggatgacaggaatagactcggatgaaagaagtccactgcacgagcggacgggtaactctgcaggacgcgcgcgtgtgtacgtgttgacagccgcaggaacgtgttaaacctgcgtccgcaccatgctcagcgtccgggaacgcaagggatattaatatcaaaatcgaaccattgctattgtctgtccctaccaacagggagaaagagtagggacttagtcctcttcgccgtcctgggcccctacagtgaacttcttgcgcccaggcccggcaagcttttgtagcttgaccctgtccatctgttcccctactttcttttcgatctgcttgatttcttcctcggcatcgattgcctcctcgtttgcaaactccaggaccagctttctgcccagaagatgggtattcttcaacgcgtccatggcgttttccgcttcgcgagcgcttacaaaatccgcaaaaccgaaaccacgagccgatctatcaaacttctgaggaacccgcacagagcgaagttgcccgtaggctccaaagagtgaccgaacatccttcttggtggcctggaacggcaagttcttaatgatgatcttcgtccttctggctgcaaccttcttcgcggtatcttcacgtctccgctcttcagctgcatccattccacggtgagacaccctaactaccagttcatgctgatcaagtttgtagccattcatggcggcaagcgcagattgagcctgggcttttgacctgaactccacgaaaccaaaacccatgctgagcgtctgtccaggatgcttagggtcaggcttcgtcttgatcttagcagacacaaagccgtccagtggccggaagaggtccacaaaactctggttcgtagtagcaaagttgaggttctttacgaagagggttgtagtgggcgtaaggtcatcaacctcatctgccgcgaaagtgtcagcagtggagaagccttgagagacagccttagtctctatcgttgccttctgtggcacgactgcagcatcaaacagatccttgggtgccttctccaggaagaggatggagtctccgagtttccggtaggcaagtcccttgaaagccttctgggcctcatcgggtctcgaaaactccacgatagctatcgttccactagggggcatgagtaacctcgttatttgcccgaatggttcgaacattttcctgagctcatcagtcttgacgccgtacgagaagttctttacaaggatagcagtgtttccacgctcccgctgcttgaaggcttcgatattaaccccattagctgagaagtaagctttcgtttcttgaattacgtgggtttcagcgtgggcctgcttcacagcagcatcagatgaagtaggatccaaaagatctgctttggaaacaccaagtcgctcagctactgaagacataacggcatccgtctgcaatatattagcgtatagtactggcggctatcatacgagctactcacgttcatgtagagagagttccagctaaacgtagaagacgaagcatccatcttctttttgatctgcttttgctttttcaggggtagtttcgccagctccgcatcatcaatcttgtaagtcttctttgcagctgctggcagaatatgcatcaagcgaccttggaagtgctttccgtcaagattcttgtaggcctctacggccgcatctgcgtcgaggtactgaatataggcaaagcccttgctggtattaaccctagtatcgaaagccacatggatctaggcacattagcataattcaaataactaatgagtgaatcaagcaacaatattgaggtgtatagctcatcagataacaagaggcatctactaaaatactctttcctggtaacatcatgtgctttgcatctgatgtccctatcaggacgatcatcattgagctggggagggggtcgtggatggcagaaaataaaactcatggattcactaacctcttcaattcgtccgaagggagcaaatagcggttcaagatctgactccgaggtgtcataagcaaggtttcgcacgaacagacgtgcagatagacggatattctcaatattcgtgtcgacctgcggctcctgaaccgtcttatcctcagtcgctgcgggagcgacaatctgggcatccctagagtcagcacctggatcctctgcttcttctggagctgcagattccttctgctgcgcagcagcgtcgaaatccgcctgctcttcctcatcaagcagaccaagaaggcgacttgtcttggagcggagccagtccgcatccgaaacagctggcgcctcagcctcggcgacagtatcatcttgctctgccggtgcctcggcgttgccttctccactgtggtctaccaccatgggttcaggtgatccatgagcttcgcggtcagctgtgtgcatctccttagagtgatcatattcctcgccaagcttcgccttcttcctctgtgcataggtaagctcctgaggttgctcctctacttcagcgggctgttctgcaggtgagtcattctccggcggcttgggcacatcatcatttgcccatgtcttggtcttagacgaatgttgcattacagagagatactcttgcaagcgagcgtcttgcggggcgttctcgccatcccgtttacgcttgagggaagtatctgcagcattgctagcagaactcttatcatgttttccagctttgcgagtgggttcggcatcgatctacaagattactggtcagtcacaagaccaccttgactgtcagcggggaaaacaaaagaaacaaagcaagtgggaatagggagtagagcacataccggcttagcaatgtctactgagattttggacatcttcacgtaagtcttattgaagtaagacacagcctgctgggccacctcatggctcttaaagcccacgaagccaatcctgcgtttaggcaatacatgagcgtccgtgacttggaagcgagtagcgaagtgcttcctcaattgatcatcagacaaggttggcggaaggccagagacaaatactctggtgctctccatgattgtgacaatgtgtgccactaaaattgtatggaaagaaaaagttcgaaaaaattttggtggaatgtttttttttgcttccttatagtgccgagggcggtgaggatggcggcctggcccgtgcgtgatccgggcggcgtccattgcgtgcagccagcaatgttgattcccaatacttccattgggcttcgtgggacgtctgcgtacactaaattaatagcgcttgatcgttgttttgaatccttgctcattcaacctattactacattcctcatcgacgtccagcaaaatggctagcgaaaagaaagataagcttgagggtaagtccccggacgcggcattgtcaaatgatggctaacatgaccgttcagcgcagatcaagtccgtcgatatggtaagaggaattgctggaggtaaccaagaattgtgcttacaacatggcagacggaggatatgcagcaggaggctgttgaagttggtatggtcagccctacgggtcacctcgaaaaggagggctaatacaacggctagcaattgaggcaatggacaagtaccacattgagaaggtaggttcggtgtcatctgttggttgactatgctaacgacagcaggatatcgcccaatacatcaagcgagaggtcagcattgcgcactgtatccggaccacccctcattgctcacaatctacagttcgattcgcgcaagggtgcgacatggcactgtgtagtcggaaggaactttggcagcttcgtcacgcatggtgagtgtcatggccagggcatcaggggtacgggctaactttcgagcagagacgaaacacttcatctacttctacctcgggcactgcgccatcctccttttcaagacccaatgaacatacgaccgcagacaccggtctgattcgccaaagcgatgtctataaccctttcggataattcaagcagaagtatcgtgcagtgaaaggtcccatgcaagagctggaaggaaatgcagccatatggtccaaaacggaatgctgtggggttgcctagagggcacaacgaggcggtgattcttccgcgcatttacctgctacttgattcaaattctttgttaatcatttcaaaatatcctagtgaatacaagttgatccaatcgcagaactactgcagcgctgtaccgtagacacgtagcttttccagcacgcaggctacactgctaactcactatatatataatgggaccgcagcaacttacgacaccgccgagtgcggaacgccaagtgccaaaccgcgccaagccacagcgccacacgtcagccccaatcagtttattatatggctgcctcccccttcccattacttgggctgctgccaatgttgtccttctacacgtcgcattacatgatccaacacgatcccgattcctgtcatttattacctccttagttagaatataccaacccacccgttgtctatcctgggagcactccaaagccgtaaacatggccatctgcatcaccttcggaacacatggtatgtgacttatctactcccttccctcctagttactccacacgaccaccgaccggggcgacgaccatcttgagcatcgattccacaagaacccacgaccaacaaagagtatgccaaaactaacaccaaaggaatccagagttcacttccatgctagaaggatacgagaatgtccgcgcgttctgctataactgtgagcccctggaccctgacaatcatgactgctaattttagctctggttcctgatccaaccaataattaaatcgattattgactgacccgtcttccttttgatctaggccaacattggaatggtcattgtttgacgagatggtaagcttcaacttgactaatttcttagatgggaatatgtttggaggtgtatgctaatgtatgatgatcaactaggccgtggttcaccgtctgcttcattgtaaccttgtcccccgtccacatgacctcggaccaaactgaccgtacatacttatagcctgtcatccctctcgcaacacataagtacaaggtatgttaatagactgttctctcctctctatgcaccttggatggcgtaaactaatatccttataggaagtaacctgctatacatgccgcttcacgcaggatctacggtaactccattcctccctccaacctacccaaggagcagggaaggatagaaactaacacttgtttccagcgaccgtcctgatatcacaccagatacaagaccccctccaggtgttgtaccgggtcaactaccgcaggcgtactatggcggcggtgcgcctttctatcccccgcagcaggcatcgggcccgcctccacaggcgtccgggggtgtggtagcgccgcagcagcaggcagagcagcagaaccatgtgtataagtgatgtatcatttcgatgctttttcgctgatgatgtattatgatgggttgatggtctgtctctgtatttatcgaataccttttgcttgtttgctgttcttgacgtctggtggttagcttactcgctatcgtgcatgtattgtatcgaatcggagttaattgctctaatgaggtgcatactatatgtgtagatccatattatcatactatctaatttaaaactgtacagtaacgaatggggtatatatccaagccaaaataacaaaaccaatcgtaaccatcccaagcccaatatttccagacatcaaacacatctcatcatccagttaccataaaaaaggtcctacttctccaaaacctccttcttctcaggcacaggcgtctgcactcccgaaacatccccactcgtcatctccccaacaatcatgccctttctccttcccctcttccccataatatccaacgccatcatcctcaccgtcctcacaatactctcccgaccctcatacaacgggaaaatgaccaccccgaaagtcgtgcagaaaagccaaatcagaccgacaacgacccaacccgtaaagaacttcttgctgaagacatacgagctgccatacatagggatgggccagagaatgaggaagcagaggaccatgaagatggtcaaggtgcgggagtagagagcggcgcggttgagtttgcgtgtttcttcttcctcctgggcggcggactgggtgttgatttcgccggggatgagttcgatgtcgatgtgagcggctgctgctacgtcggcgtcgtcgacgcggcgaatggcgcgcatggtgccgtagtcgtagttttgagagccgaagatgagggtgaggatcggggagaagatcacggggctcaggagggcggcgacgttaccggcgagcattgggtagcttttaactatgttagttgattgtttgaggagagaaggtgtggggatggactcactttgcgccggttgtggtgacggttaatatgccgtattgtttcttggttgtcacgagccaggcgataaaggagactgcaaggccgaggggtggcgaggcggctgctgcgatccagttctggtgcttccagatgagggacatggcgccggggaagactgcagaggagatgatcacgcccatcagcaggtagaggtagcccattccgataccagcgtagtagagaccggtggagaagccggccatggcgatggcccagaacacacaggtcatgtgcgaaacccagacgagacgcttgcccttggcggatgggtcgatgtaggcctggtagatatcgtaggtgaagatggatgagacagcaatcagctgggcagagaaagcggaggtgactgccatgaagatcatgattgttgtgcatactgcgccgctatagccgagaagcttgacggcggcaaagggcaggacaagaccggctgtgacgtcgtcggggctcaagcgctgagtgccctccagagagagagcagtcatgcccagagtgctggcgcacaaccaagggattgcgaaccagcaaagaccaccaatgacatatccggggaaagcgtgcacggggcttgcggcaatagctttgttgtagtatccgttgtcgaggaagacagtactgatggggttcgttagcaagcaatttatacgggagtgtggtggttggcatacccaaagttgccgaccaggttgataatccagaagatgccaccctccttcgacctcatggtcagatagcttccctctgcattgccgtcaactgggtggagcttcgatgctgctactagtgcatcatagacagctccaggggagccaagcttgtcgctagtcgcgtaggcagagaatgcaaagatgaagatgacgacaataatcacgacggtatgcaaatagtccgtgatgaatgttgcctttataccaccaaacagggtgtagagcacgacaccaattggcaggaggaaacaggcagcaactgtattaacccccgtgagagacgtcaggacggcagaaccaccggtaagcagcatggcagtaacgagaatgttggtcatcaggcagaaaacgatgaaaacaacatgaacaacggttccgtatcgagcacggagagcttcgaggaaggtatgcgcatttggagccctccgcttgagctcgatggccagtgtagcgaacaagatgatctggaccgtagcacctgtatcaccgaatcagaatgatattgaccgtattgttgctggctgtaagtacctgatgcatagaagaaaggacccgagatgccgtactcgtaagccacagtagtcgactgaagaagagttgcagcccatgtccaactactgacaactgccgcggcaaccaagcccgacttgactgatcttccagccgttgagaacatttccgatgtctgcacttcattttggtatctacacaaaaaccgtaagcctcgctagactccaaagcttgaaggggccaaaggccatggttgaaatggtattagactacatacctcttcagagcccaggtgataaagatcataagcagggcaaaggcaaagcccagaccaatgatgatgccatatccaaacccttgcgagagaggcgctgtgaatgtgacagtgtctgaagacatgttggcagcgtatgaacacgcgaagcgatgccttgctatggctgtaggatgactgaatgagacaagatcttgagcatggcggcagaggcaagaacatataaggcacgggacccttgaaaaatctccgacctcgcagacacgctggtgatcggcgggaaggccatattgaatcaatgactaccgatccaatatcattggatccgaggagtcaggcctggggaagcgaatggctgataagaacaactcctggtggtcgtttcgtaatgtgctttcatcagatgggagtgtaacattaatggcagcggactagctccaggaagtttagtaccgagcaatctagtcagtgccatcgttccacagttccattcgcatacacatggattatcccatggcccctccactttctttgcacgaaaatgaacagccgaaccccaggtgggttatcaacgtatcaagcccggacagcttattggcgaggcggaaatgcttcttatcagcggaggtcagcgcaacgacgcctattggcccgagtcgggagcggacgatgataagaaaccgtagactatcagataaggaggtcagccaagtcatggattggtttgttggtgcagcctgtcgctctgccaagagctccatggctttatggggagcagacttgatgatagcgctctatcagttactacattacttactcgatcctgccactaatgctttgggggtctaccccactgctcttggttttgaaaccggggaatttccatcgtgcttccatccctgtaattggtgggtgtctgagtaggaaccaactgatcttgctttgcatctgaggtatgccagatctcagtactgtgcgtagggcagaccttgcttgtgtgaatatgtcatccacgtgtacttcaccttaggccattcttagtatgtggattgatctacttactaatatatatctactgccattgtatcgtcctttactgggggcatgtgtgcataatatatacatcacctgtgctagagttgaacagtccttctaatgtcatagtagttctctggcagttgggtgcccatgtacatgtgacattatcactcagtataatctatgggtctcggtgtcaggactctctacactggcactgtatatattcaaacaatatactaggcctcctaccaacccaccaagtctggcactactgcaatgatctaatcatctcaccaccgtataaattgagctagtattcgtagctagccatgactcacgccatttcaagcaactatacatcagcactagcaccaaggtaccttcaccatcacataaacattcacagcctaccccaaccaggaccaaatcatctaccaccaccaccaccaccacaacaacatgaccaccaaaatctaccacaccaacaacctcaccatctccctctcccaccacccaacaacacccggccacaccatcgcaaccctaaccaataccaccacccccaagaccacactcttcgccctccccaagtccaccttcatctccaccctcgtcaccctccgcaccatcatcccctccctcaaatcaacctaccacaccccccgcatcgccttaataacctccggcaacaccaccctttccctcctccccctccacggcctcacctcaacctggaccccgataaccagtcccgaaacaaccttcaacgaccctcaatcctcctcccacccccaaagctacataacatccaaatccggcccccgcatgccctccgcccacctaacccacatagccgacattatcaccacccacaccccatccacccccaactacaccttccacggcccttcctcagacaccaacctcttcgcgaacataattcggggcaccgagcaccctcaatggcgtatctgggaggatgagtcccgtgtagcctttctaacgccttatccgaacacgcccgggttcacggtgctagtgccgcgaacacatttggggagtgatatatttgcccttggggaggaagactttgaaggattgatgggcgcggcgtggacggttggacgggtgttgatggaggcgctgggagtggggagatgtgggatggtgtttgaggggttggaggtggattatgcacatgtcaagctggttcctgtctatggggacggggaggatgatggtggggagagggaggtttttcgtgaggtgtatcctgggtatgtgagttctttgcctgggccggaggtgggggatgtgggggagttggtgaggagggctggggagattcgtcaattgattgctgcgcaggagtagggaggagatgggggtgtggttgtgggtttgtttgatttaattaattgatataaggatcggggtgggttttcatcgagtctcgttttcattgacaagcactatattacacaaaacgcatttcttcacggaactagggctctccattaattgttgatgggcacaagtgcacggcataatttagcgataattgttccatcctattctgcagatagatttggaccaattgtagaagcacaagatcggcatgtgccttccccactaccagcacacacaagaaagaggcaagggacaccaggggtatatgtatcgaagggcaaaaggttggatgatggattcgctggcctcgcttgatccctgcgctgctgatctcgcgcgcgaccccgaatcattcgacacgagccagacatatcacgtataataggaccaggagacagcaacggggcgagagtacaagtcgcatttcagcggcttatgaggagaacttgcgggtgatcttggcaatgactggatatgcgcgttagaggccacttcaccacccagaagacaacccggaaagcacacttaccgtggagaccaacgacggagaaaatgaagcccagactgagaaccaggacaacaacggggtcaaccctcagaccggggctctcgtcagtgtagagcttgagcatcgtgccggaggagccaccagcaccggcggcgcgagtcgagctgggtctggcattgcggagggactccttgtggtcagcggccgcgcggcgacgcatagcagcccggggaccaccaggaggagtaggagaggaagggcggttgacggaggagacagcagaggcgccggtgccagcgccagcagacttggagtcgggaccggactcagcaccggaggtcatgggggaagcagcacggggagaggcctgaagagaatacagacgttagatgaggttgcccttagtctaattgactgaagttgtcacaattcgtcgatggtctggttgagttcgcttgggagacaacggtagccaccaagaggatcggcaggacaagggtgctcaccattttggagaataaggagattcaagaagataagaatcaaagaaagtgaagctgaattaaacaataatgacaacaagaagcaaggaagcaattggccgatgaagagggaaggagtcggctgaagagtagaagaggaggagatactggtaggaggtccgggaggtgaggtcgcgagatgccagaaagaggccacgctcacgatttccaactggcggaaggtaccgtcatttacggtaatgccaagacctctactttgagaagtgtagcttatttaacataaagttgctgtaactttcacaacaaatccgatgtggtgtaacggctaacatcgccgtctttcacacggcagctcggggttcgattccccgcatcggagttctctttttgatttttgtcttcattctttcctttccgttttaacctcttaatgtgatgtccctttttgcacttggtttttacgtatggctagtgtggtgtaattgtcgttattcctgatctcaataagccacagtgtactttgatcgactacaaagcgaggctctgaagctccactggcccatgagtctcttaacccttcgctctccactacaaattctagaccttgaagctacataggttgtgacgatctcgggtctaaactttgtagactgccagatgttgtgcgcccggtgaacagaaccttggattagatctcgactccactccacaatcaggcaggtcagctccgacgaagtgatgctttaggcacggatagtctacggctaaaaggggcaaaaccacgagccctatgcgtgtccctgaaaacactgtggagcagttcagtctcgcgcggctgatttatccattcttgcggagcagactcgtttgtctacccgccactcacgtggaaaattcaatcttaagttgaaccagcagagatccggcccatggatgccattccagaaccgctggcaggcagccacatagacgcgacagccgttggaagagttctcctgacatgacgaccaattagaacgggctctccactcgctgagctagagtgtagttgtaaagcgtagagaagacagccctttagtgtcatgacttcagacaagcctgagtgagacctgtgtcgccatagcaataccgcaatctgtgacgacggaaaatcttgggtgttttttacattgccgttgtttcaccgggggcacactaagcacgttgaatggcacatggagcaagcagcaaggggagggaggggaaagcgcactaaaatagccacacgacactgtcttagaagaattcatgggctcacagacctgtggctttcagcaccttggtttgagaaccgcattggtgcttgtgcttgcatacatggtgagaccggagtcaccgaaatcaaagaggtttcccaagtagatgaagactttctgctccgtatctgctcttggagatacacgttatcaggtctagctaattcgtcggtacggcgtcgactccgacaataaggttagatgggtacgtaacccggcgtgagaagaggcttaaatgtcgttatgcgtctgcctaaggcaaattttgtcgacctagacctcttccaggtgcttcatgattcactgcagaagcgaggcaacgacaaaatcactcttcttctttactgactgaacgaggaactgctgaccatgcagaggttgccatgcacccaaagtgacaccgcacattgtactaggtttcaggaagctgagccacggatctggtctgatctgagccggccaccacaaatttggccccaattctggccccgttccatctccggggcaaagggaagccgtctggcgcgcgctagtctagatggggaggtagttcggtgcaacgtttatctagtctgcacacagttgactgctgtagataactagtaaacagtggaatggttgcctaagacatcctcatcctacggcgtagatctttcgtaagcgggatctctcaggccggtatagtgaacaacaacccagatatggtgaagtttatggatctgattcaaaggcatcgcatggtgggcatatttccctacaaaatgtcgtggatatggatgattcacatgtagatcgcttttcaaacattcttccatcttatagttacggatctcctgccgtcagcgatccatgcttgcctattttagactttcttgtgagctgttggtttgcagctcttccgccacttagaaacgttgacattcccccatacccacttgccatggtgtatagaacggctgcactttgctgatacagtttttcgaccgatcggataatctagagtatcaaggtaatccaattggataacaaagctcccgaaataacgcgatcgatgaatgccccaacaccttggaataactgttctgtcggtacttcggtagccagcccgataactattctactaagaactgtgtgactcggatgcgcccctttggggcgaaatgcgagtaagtgcacacacggaaatttggagctacaatagtcaagtaataatagggcttgagagaggtaacgcgcggcattttactagagagttaataaaatcgtaatcgggaacccaagtttcaagaggcagccggtccatgggtccgacccactgcgacgcgacgaattcaggagacaatcgagtctagttcctttctttctcgagtttagcccaggcacgggatccagttctgagacccggaataacgaataacaacaattcacaacaacacaccgaaggattgattttatcaccacaacaaacacacatccctccgtaagcagaagcctttgtctgtcctcaggaagaaagaaagaaaaaggagcaagggaaaatagtcaagaacagccaaacaagctggagcatatctcatcttcatgttcagtactgactgagtaaccaagactattttcctcatgaatggtccaggtccctcccgtaattaccgtgggtagattaaaagcttcttggctctgagaggataatcccgtgtataagccgaacgccatgataaaccatcataaaattagaagaaaattgggcccaggacgggagtctggcacatttgggtgaaccccaacgcaacttgctttgccgttaaccgtcgcttatatgcttgactccgactaaactgggttgtcatgtaaggtgtggattagttagtcttccagagcatcgtccaaccctcctcggatttttgtgatcatcgctgctttttcccgctttttcccttccattgctgtgtctggactcccagctgaaccctggatgccacatacgcctcccccgaccgaaaagcagccccctcctccttctcctccttctctccaaaagtgcgtgagtaatccgtttggaattgtctgttggttcactattcacatctcgggcttagcttgacagcagcctccgttttccctctgtctctcgctctctcactgccattccacccatcatcttcgatcgttcttctcccagccttccttttccacctctcacattcatacttcctccttcctcccgacactcgttttcattttcccctttcacctctattgcatttttctccttattccttttctctcttttctccctcccccggtctctctctctctctcttgctatccctctctccgactgactctgggcttcggttttgagtccgcaggtgctcagccttacgccaacagacctcctccaatcccgaaccatcgatcatcggactgagcctccccgcccaaaggtaacacgacaattcgcaccacggcttaacaatcctacggcatccccccgagacttcccatcctcctccttcaccctgcagcgagccattctccgggcgcagattcccctccactcgctccgttagcccgtctcgagtgtggcttggtgtggcttatacgcttgtcgtcgagtggtcgtcctctcagaacccgtcatcttcgagaactccgacctcctgaactccccctcctgacatcctcaaaaacaaggccacggccgcaacccactcagatcggggttgtcacctccgcgcatcacgaatctgtgtccttgatcctctgcctgtgctatattttcgcggccgtcgggtggtcgaaccgtcatattgtatcccgatcctgagcctccgacggacaccagctccgtaacggagcacttcgtcaagatttattcccacaattctcgggcctccctgcttgggggcactttcgatccatcttttagacgcggtttccgtgcccgagaagggtatacgaatgttcctccggatcccccaaagcgacacaggatgtaccgaccaaactcgttatggacttggtccttctgcattgtcacactcatccagaccatcattacccttgccctcgagtcgtaagtgtgacttttactactgttgaatcgcaaatttccgagtacttatgctgatcaccacacgaatagttatgtcttcgcaaacttccagatccaactcttcccaaagggcgaggtctcgactgcgtcaaagacagtaacaaccttcttggcgctctactgtttcgggtttatatatgagttgatcctcgtttacgatgctctacgtctcaagaataccattcaagtcattggtctgtgcgtgtgcaatctcggtcttctgatttacggggcggtgcaagtccagcaaatcaaggactccatcgaaatgctcgtggccgaaagcgccatcaccatagacgtgtggggggagacagagccctttctgattatcattccgtgtgtcgttgccatgggctcaattttgatgatgatcatcgcttggaagctctacgatgaattcgcatggtcgatctacaagcatatcagcgccgatctgcgaatgaagcgccggtatcttacatatcaggtacttctgcatgtccgtcgaaatggggacccgaatctaacaggatttctagatctatatcgctctgctgaagttcgatttcttctttttcctcggtttcaccgttcagttccttgtcattgtcacgaacaagacggatgttgaattcgctctcacgacggctgccattcccgttacgattcttattcttgtttgcgctgcgatcttcgtgaaacgagagagctcgatcggaatgatcgttgtcattgtacgttgtcctagcagcagatgggtctgaattatcttctaactggtatcgcagcttctatactttgcagccatggcatacttcctattcaagctggtccgcatgtaccagcctcaaacataccaagagtacctgcccgcccggcggtctctgacattcttcgctgttatcacgcttctcttgatcgttttgacgatcactaacgcctgcgtttgtatgcacaatttccacaaaggcctgaagcagcacgtccataagaagaagtcccgcgacaaggacgagaagacaactgagttgtcttccaatatctcgggccaggtgccgaatcgcatgatgatcgactgagcgacttcagccccacgttatgaaccaaacacaataaaacgtaaaaaagaaaaaaaaaaaagggaagaccaaaaataacagcaaatttgcaaattgggggacttttccttttccgattttctaaccactgcacatttattcatggagcgatatatcttttctttaaaggttagcgagttgtgcaacagtccgccagtaggtggagctactgcttggatactgagattgggcgtgtttccgggatttaccatatgatacctcctactgcgttgctcggttttttcttacgaaccttcgactgtctttccttgttgatttcctcggagttttgtctgaagtggctgttcaccctccccgcatcacgctcttgctcaatgacgcgccgtgtcgcgtctcattgatgaaatttccttgtccatttatttctttttgaccatttcccccttatatctacatatctacaacccccgattatgtgaatatcacgactttgcattatgtactgtatttattaatttgccttgctgcatggagataatcaatcaaaagacactacttatcgagccatcctgttacattcaacctagttgtctatgatcaacaacaacctagatattttcaaatgaaataagcagaacaataacacatcacagtgtattcgagcaagacagtaggtatttatacatacacataaaaaggaggcaaggaaagcaaacaaaaacaggtttcgttctatctgaacaatagaaaagaaagaccaaaaaaagagatgaaaaagaaatctccgatgcggggaatcgaaccccgagctgccgtgtgaaagacggcgatgttagccgttacaccacatcggattgttgttgaataacggactaaacttataatctatgtagaaccatgtaaacctcacctcccaccatccgctaatcaagttactactcttagtactactgtctttcccagcttaatcacaacaagaacattttattaggagtcgaaggagcttacaggtaaagggggaaaaaaggattaaattgaaacgaataggataattagtaatacccccttgtcatatgatgattgaagcgctgacgttggggatggacatggagtatatatccgatgtacgtatatggctgcctaaattatttgaatacatacgtggtgaggaggttaccaaataatgttactacggggggatttgagtagctgctagatgattctgtcgggaagagcatccgaagctggaatgatgagaacaatagaggggggaaaggggaaggagtaagggattgattgttttggctaggtgcataggatgcgaggtatacacggaaactacttcctcgtcaattattcctgtcccgatacggacaatacattattactaccatggatgcagcaaaaagaagaatttgctcatctgattgatccaactaccaagctggtatggctatcgacaatttcaatggagcagcagaaatatatgtataagagaacgagtattaacaggaagaagtagtagtcagaaccgaaaccagctatatgcataaagcagcgagtgaatatcttgactagtaggtcaatttaggcagaaagaatgtcagtcagtcattttatttccctttcccccacttcttcactctgaagaaatagtacaacatgacagcgccggcaatgttgaatacgaaatagcaccagaaaataccgtagtcgcgccaacgatctttccaatagacccatcgaagagcaaggtactcatcggccactgtcatggagcagtattcgcaggcagaggtggcgttcggattgtacacctggcctccagcggcctcaacatacttctgcatgtactgtccacaggtatagttggatggagggtcaaaaacactgagctccgtagcgctgcactccactgggcggccatggaggattgagctgccgacaccagccgtgtagtacgtaaaaggagagacacggtacatgaatatccagaacccgggtaggtctccaggtggttgcagcataccgttgaagatgaacgcaaacgcgaacatgagaacggccaatatacctgccaccggcgcttgggggactgcggctatcacgaagtgagccatactggccacatacagatagaattggacgatgtagagaaggccaaggacatgccgctcggcatcttgacccgtgcccatcacagcccagtaaaacgataaccaaacaaaaactcccagaacaatgtggtaggggatttcaacgagaacatttgaaagaatgaatactttccacgaataaaccctggatggccgctcccggacttcatatagcgcccgctgtgcaacgaatcggggcgtgatctgattgacgagcgtggtgaaaaccgtggcaaggaggaagacactgaagagagcacattggaaaccttgttgggtgttgttcgctttgaagaaggagaagccaataaacaatccacacgctatacccaatgagtactttgcaaacacatattccggttggcggtagtactgctggaacgcacgcttcatgacgtggtagagttggctggtgaaaggcatagcgaattccgagttgttgctatcaccatcctgggctcgtggctcgggctgttgttgtggatcctgaagacgttcgagttctgcgaggacctccttgcgctcagggctatcgttccatctctgaacccagtcaatgccttccgatccctcccctgccacaacctcaagaatgtactccgcaggattttccatgtccccacagcgcctaataccgctgcgctcaaaatagtccaaaagtatgcgggattggtccccaatatcaccaaaatagacagttttgccccctttagtctaggaacaacaagcgatcgaaggtctggaacaacagagcactcggttgatgaatggtggcaaggactgcctgaccgtgatcggcaagccgccttagcagcgagcagattgtccaggaactctgagagtccaggccgctggttggctcgtcgaggaatatcaataatgtcggttttgcagcaagttcaaccccaatactcagcaactttctctgctccacgttcaagccctctcccaaagagcccacaactgcctccgcaaagtcttgcatgcgtagaactttaatgacctcttcgacatattcgtacttctctttttccgatactgaagcgggctgacggagcatagcactgaagcggagggcctcgcgcaccgtagtcgtctccatatgaaggtcttgctgttgcacatacccagtttctcgtggaaaattagcctgcaaagctcttccgttaaccagaacgtcgccggtaacaacaccaatagataccctctgggcgaggacatccaaaagcgttgttttaccagccccagaaacccccatcagcgcggttaaagtgcctggcttaacccatccattcacattatcgagaagtcgccgggtaccatctttgacgggaatatcgtagttgaggcccttccaagaaaggacgtcagtttgctgaggaagactaatagcatccacttggtcccccacttcgggcttgtctgggggcgcttctccatcttcgatcccatcggaggatagcagatattgcggaacatgaccagatcgaaaaaccaaggtttctgctttggatgtctcacccgagttgtattccgaaagaaacaaatagagaccggtgaagaataccaggtaggcgacgagaattccgtaattccgccagacatggctgtagtagtactggtaattctgctccacataagcgtccccggagacgaaccgctctcctgcaacggcacccacggtcgaacagataaaggatgagccagtagcatagcttgggatcaccgatgcgcattcaaagttcctgccatggaactcattcgctaacagggcctcgtacacatagtagatggggttgacccagcggatccacgaaagccacgggtgcatatatgcttgcggtaacacaaagccagtatataccacaatgcataagatacaaacaccagccattgacattgcctgcgcgcttgtccttgttgctgcagctaagctacggaaaatcccggacatcgtcaagacggaagtcaacagaaacatgtagcaaatgaagaactgcgatggttctcgtcgaaggttggacatcaggtaaaggatcacacaaaatagagtaccccgtgtgaatttgataggcagatccatgatccaactggccaaggcctcagcgaagggatggacgaacgcataacccgcttgcttcacagcgattggccgctggctatatagctgaatgatctcattgagtgcgatcaaggcattgaaaagtacagcaaagtatagcacagcccctttctggaagaatgtggcggttgtgggcggagaattgaagaaaatcgagccgatcaccaatcccagaatgggttgtgtcgctaccgtaacgatcacggttggcaggtcgtttcgtagtcgctgaaaagcccggcgcaggcagagacggacttgcatcgggacagagagaagatatgggctgcgcggccgagtatggcgggcctgctgctcttcatgatgggccttgaatgctttggcctcgtctgaatctggtgggtgagcacgttgatactcctctatctgaccgcagagctccttatactcggggctacgcttccaatattcctcgaattccttcgccgtgcgtggtaccttgtccaccatgtcaggacgggcctttcgttcgcctgggttggtaattgaagtcaggaagtcgccgctgacctgtcgatctggcaattcccagcccatttcctcgaagtaaggtactgcacgatcgcggtgaccgaagtagatctcgcgaccttcgtagaggacgacgactttgtcaacgagatcatacatcgactgagaagcttgatatgcagcgatagcatgacatgatcgacccatgtcggcagcaatacgtaatgccctgacaaatttcagagcggatgacgcatcgagacctcgtgtgctgttatcccaagctccgatacgacaccttgagacgaacatttcggcgatactgaccctcttccgctcaccaccgctaacacctcgcacaaagttgtctcctaccttggtgtaataggtgtttgagaggccaaacacagccaggacaacctgagtgagagtttcaacatattcggagcgtgtcaagccttcaattcgtttctgaggggtccgtgcatgcgctgcgaaagaaagcgtttcgccaacggtaaggtgtggaaagtgttgatcgacttccttgttgtaggctacctctccacggtggtgcttgatcatatcctcatattcgatgccttggtaatggatggtgctctgaggttcgagcgtcagaccacccaggtggccacaaagggtcttcaggaatgttgtacatccacttccagggcgaccgaggacaagcagaagctctccactcttgaggaagccatcgaagccatggagaatctgccttggcggaggggaggctcgccccgaaagtgcacgcgcggcagcgcggaagggagctgccaactgtgtggaaatagtattctggatttgcaatgacgagcctgatccagacacgcaaaggttagaaaacacgacaccctgcgtctgctgtacaatgccggactggtccagggctcttaagacgagctttgcccagagacgttgatcgaacgccggattagtggggtccaaacgggggtcatccttctcattgatcgtagcagcgtgggaaatcctgcgaccggttcggctagaggcgattcttgtcagattgtgaagctcttgttcctcttcgtccaacgatggggtctgctccttatccgaaggatacggatcgtgtgcgctggcaaccttttcctccatggtgccagtcgatgagagttcctggatagacccgtttcgagagccttcaggtcaccaaacgagagaggtaaaccggcatctagagagaagcggaattctgccagagataagggttgggaagaaggccctgcatgtacgggatacacctaatcaataaagcccacagggcaaactatagaagggccaatttcgagtgtcaatgttaggaagcgatcgccctgctgcgtatccagccatttttcagtaataaatggatctcactcccttcatccgcattagtgcactcttatgcctcgtttctagaattatttcagccatgtctatgcaatcaagcacggccgggcggcctgctcctctgggatgcaggatctaggcggccctaactacggcctgcagcagctagcgtaacaataagccccaactagagcgtggattgatcggcgctattattacacatagtcgatcgcttcaggccacaccgtgtggaccaccttcagccttgtcattggcggttctgactgactgaattgagaaatgccatttattctagcatctcaacgtgtgtcggtgctggactgtgtgtaggccgtgggaggctgtcgatggagacttgtggcacgtagccgcatttgtgtggagctggacactgaatctcactgtttggacttaggaatggcctagtcggaagatggaggtgatgatcccgacgatggatgcatgaaccggctgtaggtttactccgctaggccaaccagtcattgaaggaggatggtaaaggaaacgctgctactcgcttgtttttcctgctcgggtgaaattacgtgactgatgggagaggtcagcaaaagcaattcagcgaaaaaacacgtcaacttgcgacttcctgtaaaagccctatgccggagttgtcccagggcctaatgagagcaaggaagggaaatattggcgggacgcgacgcccaacccaccgactcggtcacggctgatcggccctccgacgcgccggtgatcaactatcaatccacgatatggtatccatttgggcttaaactcagcacgaaagatactccgtggctctgggttcgccgtaaaatctcaagggcaaccatgctagcgctttagtgtggataccggccgtcgtggattcgggattgccgtcccacatatgaaaacccgagtaataagtagataccttgcggtgaagcttacattccagagggctgtactgtgtatgaagacttcgtttagtaactccttatgtttgatctcaaactctccttgctgcaagttgttgcttcttccgtatccataagtaattgtatactcacagtgcttccgggccattgtgacatgtctactccgtaccctccgtagcaattccaagtaggatgatatctcttcttccgaaacgaggatgaattagtatttgttccccgtgcagccaatcatgccaggtatcagtttcttattatctagtggcgttcattggaggtggctggaggcgaggaacggactcccctgctctgtatattacgacgttcagatggagaaaggattacaaccatcgaaaggttgttatggcttataaagataacaaggtgtatgagctcgaaatttttcttaactgagttgtcttgagggtagagcccaaagcgtgtcttggtaaacagcagagttgaacgtggcgaactcgaacacaaacatctgggccttcgcacatgtagagttgtgttttctggttcttgtaactgaaccttaatgtttcccagacatcacatcgcagatcttaggcagcatatgcactaggcccgcaacacaggactcttgagcttgatggggtgattcagaaccatgcaagaggttagtttcgcaagctttactgaacgcggctatgatcgtgagctgacatgcataagtatgatgtatgatggagcgtggtccatgacagacttttcggagcacagtagagccatggcttggtattagagtgtctcagtgaggagtagaagataagaagtgtctgcgaaacgttgaactggactagatgtttgtgcaggctgggtaggccctgaagggcttataagtagatcgagaagctgcttcgcggcatcagggtggctcaaaggtgagcactaaagttcagagtaggattagagcccaacatgacacataacgtgaatcaatgctgtgcgagttgtagaggacaagaagtccggacagttctttccgacaggctagccatgtcgacagatgcagccaaggcaaccgtgacctcggaagttatccagaaggtaacgcacaaaaaataagcaatgccaaaggcacatctaaacttcgaagatctcagactgcgaattcacaagatagtcagtcacaatacttggtagagacaccctctcaggccaaacaaacaaaacaaacaaacaccaatccccgtactcccccaacccccaatccagtaagcggtcaagcccaccaccaacacatcgcaccataaaaaaacccacgacagctaagcttgactcacctttctttttctcctcttaagcgccatccccaccaatgctgcgtttctttgctacacacgacaggaataccttcctgtcctcggctctgatttcctccgggaaaccacccgaaacccactgcaaatgagaaattcggaggaatcttcaccctgtgcacccgccacttggaaatgagtaatatcatttgcaatggccggtactgccctcaagggcctggtgtgacatccttgcacacacctgcaattggcatcagaaacatcgggggggaggaaggatgtaagaacctcttacattccttttcttctttttccccatgggagagtcgttgcgaagattgtgtgtgcactcggctttgatcgggtgtgcgacactttagtgcaatacgcagcatgccgtttcctgtctctcgctcaccccttatagggtgggttagggggataggattggtatcattcgattccgattattctggtgggggtggcgcttcacttctttttttctgaggttagttggatccctgttctatatttgaggatctgtgtgtgtttgcggtttgggaactggaaaggactttgttttcccccggctaattgttgggtttggggacctgtatgggtccctttctttaggtacggagtacttgatgggtttggtggtaggggatatattgtatggtcaaggaggaaaagctgtgttatggacatgtaatcaagctgctattgcagaatacttatatgcagtttgaccaatgcagcttcattgcacaaaatccactgcttcgtacatcatatataacatgtagagagactgcaaaagttatcgtaaccaattggactttgaacacgttggtcgcttagcatctagctggatattatagaaacaaaaatgaacacaggcccccgagaacattcaggatattttccgaacatcagaagttgaaatgaaaaaaaagagaaatcgttgcctccatattgctccccactcgtcattatgatttcgcatattgttcacttactcctcatcgccaatctaaatatcataagtcagtacaactctcaaacaagccagatgaggagtcatcgtaccttaggagccaggtagaatctcagatgaccgctaccgaggccatactcaacgaggagcggcacctcctgcgacaggcacagggtgaccttgttcgacaggttggtagccttgcagaagttgacgaggtacttgagggagaaagtgagggcaacgggttcggtgagggagatggagacgttctgtgcggggttctcgacgttggtgtgctgacggacggtgacggagccactgccaatgtcaccctggcaggagaacttgacaccctccttcgtagcctcaatgacaactaggagttgaattagtcgcggatcacacccgttgccaataagaagaacataccggactcagagagggcattcagatccctgcagatacgctggaactctgctgccggcatctctaccgtagcagcgtactctgtctccgggatggccaggtgctcctggtcaatatccatcaacttaatatcatattcgctaagtctatccgtctcggcactctcgaacatcaggttgacggcatcgggagagtcctcagccttgagagtgaggatatcttcattctgggcggcgcgcaggaccttggtcagggagagcaggttgataccgagggcaatgttacggtcgcaacggtaaggggagaatccctcggccttgagcatcatggagacgagagcaacatgggagttgtccatggcctgaagtgagataccggagtcattgcagtcgaagttgcagtcttggaccaggtccttgatggcgtcgacgacctgaagaaagaaaccaaatgtcagcaatcaagcattgacatgcaacaatatgatgtagagttactcacgcgcttcagaagactggcttgttctaggcgagcttcaagcactgagtaagctgttagcatagaattctgaaccagttgaagctgtgacgctcacttttgatgtgatggtatgtgagtacggtgagaagctgattagaaggagaagtggaagaaagaggagaggctgagataagtagatggtggttagcgggtgaaaggagtatcgtgaagattggaaatcgtaaagaactgacagaaggaattgagtgcgtaggaaggataacggcgtgtctttcaggttggggtgaatttattgagggacctgaaagtgcagcgaattcgcgttcgagggtttcattagtggggaggcacgcgtcccagtcgcgtcattccttaggctgatatcaccctttggggttagtctgggtggtgcctgaggctgggctataccgcacccgtcacaaagaagtgtcactaccactatgacaaatactacaactgaaacgtctctataggcagttatttctgtgtacctagaaggcctacagggtgctgaattatgcttttatgctagggattcagtctcagaagagtcttgcattgcctagctaagcatgttgaactattattgtgtgtggtcgaatactccaaaccgttgcctgcaattcacgagtaataattgaccagagaacgaagcttaacagttttctgggtcccaatgacaatggcatcaattactgaccactaagcacattattgacttataaagtcgcaaattaatccacctctgagtctataatggtaccaactcagcaatgcattacatcacaactgggataatgctacttcttgctagccttgcagtactatggctcgatagctgcaggcaagtagttgagatatgaatatcccattggtctggagggagggacatgtggagaatgcggaatttggatccctgaagacagggaagatggactttactttgtaagtcctcttccgcggtaatggctggattacaaatgcaatcagtctggagatgatgacaaacattcgaacaactcagaggagagatagtgcatgcactacaggccactgagctattaagttgtataaatattaggatcagctgtgaacttgttcgaacgattattcccccctctttacagtgacagtaaactaaaactccaacgcaaaatcgatctaaatatgaccacagtattcatgttagtcgctcatcataaaaccaaagcactttgatagaatatgcatagcctagatagctcacacaagccacagaacaggagccagcggctacatcggcggcgaccttctatcagtacttgtatccaagtaccccgacctgcactaccgcttgttagtccgaagccgcgacagcggccagaaaaatcaaggcacaatatcctactgtcgagattatacaaggcagtctcgatgattcagagacgctggtcgcagaaagtgctagggccgatatcatcatccgttagtggacacattcagtttttattatatactatccaccagaaggaatacgtaccagctgactttaccggtatgaaagacactgccgatgctgctgaccaccttggcgcagccaaggcaatagcccagggtgctctagaaggacacactgaagaacatcccgtctattggttgcataccagtggtgccgggatcttctcgttcttagacaccgagaccaaggtatatggggagaaaggcgagaaaatctatgatgatgtgcaggacattaaggagattgtgaacttccctgaccacgcgttccaccgagatgtggataaagcggtgtttgaggctggatcggtgcgtccagaagtcctgaagactgctatcatatccccggtaactgtttacggtaagcttcagtagaaaccaaaatgtaagggcatgaaatcaactaatttactgctataatttaggtcaaggccgaggaccttgctcccaacgcagcagacagatatatgagctagccaaactgaccatccaacgacagaaagttcccataatcggccggggcctctcattcgggaccgatatccacatttatgatttgaccaacctatatgtgattcttttcgaaagggccctttcgaagcaagatgatgggctttggggtccggaggcatactacctctgtgagaatggggagcattgctggggtgagctggcccgttcaattggacgaatttgtgtggcggaaggattcatcccatcggccgaagaggaggctttcggcttcgaggaggcacaaaaatgggcaggctatgaagctgctagttgggggctaaattcacggtgtcgggccagtcgtgcccgtctattgctggggtggcagccgtctgcgccatcgttggaatccgagcttcgggatatcgtgaagggggaataccgacgcctacaggaggcggaaagagatgcctgaagctctgatgaaatgttaattgcggctgtacttcatgatgattgcaaatacttcgccgacgtacagtggtcgagtcatagtaacacaggattgaagttccttccatcgtactacgcaaatcacacaatctatatgatcgaatacacctggatcgatggagtaaaacagtatatttcagacgtcattgagtacggtatcgatacaaataattacgctagaatgtaggatatgtacacaaggctgatgatacagaacaaacgagatcgagcgaaagctgccagcattgcttcggcaagcatagtgagtatacaggaagacgaagagacgagtcaaggaaaaaaaaaataataacatgatatacagtatcaacgattgtaaggcccacgggagtccaccaggggaaaaaggtaataataagtaaccaggctgagagaaaatgcaaaactgccttaacgccgctgacaccggaccgctctatacatttctgggtatcaatctgcaaaggttgctaggaagagtcggcttccagctcaaggtagagtaaagcttaggtggttatatgcggggaggaggaagggaagggaatcgggtatcgaggtggcggtagaggagatagggttggaaggatgctgtcgaatgatggcgaaatcaaatgcttgtgacacgtttcgcagctattgtggtacgaggccgttgcttaattaccatttctagctccttgagcatgtttgtgttggcatcagtgcgctcccgagcggctgcttgtcgtgctctatcttccttgactcgtgcgattcgttcttcccgggttaatgacatcctcttgttccgagccggaagagccactgcttcaaatatttcctcctcatcgtctagtgtatggacgatgctcggatctgtgttttccccagtcaacgctctaagggcgtctgcagggctgccctcgactgcagtagaacctccaaggctgggtgtgggtgacaggggtgttttcagaaagctcgagggtcgcgaaaattccggatttgcgggttttcccaagctactcatcaatgcggatttgcctgactcccactcctggaggaggcttctgatatccgctccaatcgattcatactggggcatgaggctcgcctcgaattcgccagcatccggtcgctcgagattagaactagatgcctccttgaggatgtgcatctttgcgtgaagcgcacgaattccctgggagagtgaattgatatttcggtattgtgcacggagattgtccttgttgggtgaggctgttggtagcggagaaggcggaatgacatcacctgacacaatgttcagcttaagcatggattgtgtcgaggattggtacttacgatcgtcctcgttgaggatgttggtcatcttgtgaatgttctcgccagtcacatgggccaggtcccgcatctgctcgactgccgtggtccatctagcaatatcggacccgccgccatccgcgccgagcgcgaggagacagcagaggatactctttctcacgatgtagagtcttccgaaaagtgtgcgaagggcacgtagagagtactggtcttcggtggctcgctcatcgaacgctgcctcggcctccataagctcctcctctgatatgtcgtagatatcataatacttggcgaggttggtggcatcggtaagtgggcgtagggtatgctgtgcccgaatgtactggcccagcatgagatagaacgattccgatacggttcggcgcagtctcagacatcgccgtgtttgcgtctgatcttcaagtctgcttactgggggcaacggcgtgcttctactcgatagattagtgatttttggctcccaagctgacagtcagagcaacttacatgcggtagcctcttgagaccagctcaacttcctgtatgaatacaaccgacgcggaagcggcagagtcaaacccttgggcgttgctaatgaaagtcacagctgcgtcgacagcttgatggcgcaaatatttcagccactgtcgcttggcgaatgcatagaacagaaccccaattacgggcacgagaaccagcaaaactccgaccttccgaggattaagaccagacgatgttcgagaccggctccaatgtaacaaccaagcgacggagaaagaagtcgaagccgtgacaacagcaccttgtatgccaaacgttgtggagatagacgggagatctgctggaagagccgtggacatcacatctgcagctgatgtgtaagacggcgcactgtgttcgttcagcagctgagacgcaacgataacatagccgaactgttccaggaatctttcgttgtcgcttcgtccaacgcgggaattcagagcagactgtggcagacagttccatcagtattgaccgcagccaaggcatcaggtggggagttcataccgtgcagacatcatagagtcgacccagtgctgcccgctgtcgcgagactttccgttcgagaggcttgggcagtttattccgaatacgctcctggaacttcgaaacacctcgtggggcaaaatccgcagccgtagagtcggagaaatcatcgctatggtctgcctccttgacaggccaacttgggtcgtgttcaccttcccctgacgtatgaacagataagcttttgtgatttcccccaacacgtgaatcgggataactcaccctggaggtagtccgccaaaggcgagttctcatagacgagtgattccatgaccagtgaacattccgtaatggtggcgatgagagaggaggttggagagacgcggatgttgtaagacaaggcaggggagacaaaggaccaggcgggagattcgaacaatagagttgagacaggtgtgagattcaagcgcgttcaggtgcgaattatcgcaaacccatctccgcgacagtccaatggggcgcgtgggaaagtcgactcaaggagagggcgatggagtggaggagcaagttagtatcgaatgggaacgggggggaagaagggcgacgagctaaatgcaggttgaactagttagaaatccgaggcgcggcgggttgtaagggagggcgagtggatacgcaagaggaggtaataggtatagtaagcgggtttaaggacggcgcaggatatacatagcaatctacccctggcagatggagacactggttaaggaacaaagaggaagcccgaacgacggtgcctgtgcagcggccacgttgaagatcagaccatgtgtgtgtctggggaactggattgcctgcgcttcccttttctgctcgaatcggagctggcgtttgctccggcggccgcccggccttgtccgttcttttcttctactccgtacctgcaaaccaaaattcactaactaagaataggcgccccccaccgtttcggtgggctttttcccttgtgcgaatcattcgcctcgattcgatctggcggattattcctccagggcactgccaatctcgttttccacccagtgagcgctcgcgatggggtgcaccccaggcttcccaacggattcaaacggtgatcacacaagttagcgagggggtgatccaagtctgtgctttgactttcccctcatcaaccaaaacttgggtggaactgacgtcttgtgaactacggcagaccgaggtttcagcatcaagcatatgctggagcccgcgtgggatttcggatgtcaccattattaccctcggggtacacatttaaacggcttgtttcatgttgctcggatttgaggcagcctcggagaatggctctttatggctaataccaagaactcaaatactagcagatgatttattgacgctgcattgaggttgtctcaagtggctcattactttttccttccacaaaaaccatcaccacagcctggcgcggaatctctggacggcaataacaaggtgagacagaggcggcaatattacctttcaacttccatgtctccttgccatatccacatgcacagtgcctattgaggatccttgtcggaccctacagcatacaggacgatttcgctctgtggcgcaagtagttacatgcagctttacgtctccttacacaatcaatccaactctctccaccatagaagatagtaatcgatactctgtatatgggcacgttaaacgaatacgagaggatgctgttcgtgcagcaacagattatttagttactcctcagtggacaccgttggggctttgtatgtgatcgacatctaacccaaaagggactaaaatagtattctagaaatgcagccagtggcggcatgggacctgtgaagaatgtgggagactaagtcaagtagcatccacagcgagtcacctcgtgaaaaggtgttcaatgaccttcgccaggcagaagttactttgatcgagagcgactcgatttgccatctaaaatttctgcctaaggtgtcaaaccccttcccgttgcacgggcaacgaagcgtcaacatcgcgtctccatacctgagacccatcctcgaccaaactttctatgacttagcctcgatctcgcccccgaagcttgacaggtcatcccatctcataacttgaaggccttctatcctttctgccaattaaaccatagctcccatccgacaattgaaccgccgacacgccatacaggagtcgggggagttatctacgagatatccacatggaatagaggcactgcctaaacatccagtttacttcaaaggggttctccttgcattttctcaatatgtccggctttctgtacgaagctacgaccccgtgcccttcaaggacgagcgcttcaatcttcagccgcggtagcgacagatgctcgtccgacagcatgtgggaagatagcctgggcaactgggacgatactgctaatgtcgagttcacgaccgaaatcaaacagtcagttctcacaggggcaaagcccagacgaagaactaagacaagtacatcttttgctattcacgaagaccttggagggaaacctacacagcccacatacaaaccgaagcgggattcaagtatagcagcaccaaccacgagccgcaagacatccttacttgcgcagccagctcagagatttcgtcccaaagtcagcttcggtccgagtccagacacgcagttgcgacaagaagggttggctcacaagtcaacaactaagagaacggacacagagaagaacaacgcgcttttaatgcggataaatggagcagatggtcaggggaaagtaaaggaaagcctcaaaatggatgtgcgccgtaatacggtttatattcccccggatgatggtacagtggccagcgttttcatgggtctctttagcccgctcaaatcggacgactttgagaagtgtatgaatgaagatactcaagtcaacagcttggagtcacaaattgccaggaagcgacaagctaagcggtctctcgcctcgtctgcccaacgggccccattacgacccagctctaaagtaatgcaggagtcctgcattcatcacgatattgccgggaagaatggcggaaaggaaaatgtacctccaggaacagtcatagctgaaggcaagaaaggaaatcagcccttaaaaatcaagggggatttgggaagccgccttaatgctcctccgatggcggctagaagagctggtgctacaaacgcccctgcgaagcctacatccaagcctctatctaccaagacaaacaacccacttcataggagcaatgtactgagcaacagccagaacagcactaaatcacaacagaacaaacccgagcacaatcgtaccatgaagccaagtttgacatcagaatacaaccgactcggttctatgcgaagcccaaactcatctacaccccgaaagccatcgaaaacaagcacaatactcaagccaactacttcgcgcagtaatgtgaagcctatcgcaaaggaatgtccaattattcttgacagcatcacaaacccggcactgtacgaagagaattggctctcgcaccaggaggtggcaataacacagttggtgaatgaattgctccgatgtacttatgaggagtcggagattgacaaccataccatgcttcgacatgagctcctcgccttgtaccagggagaatcttttgcatacctccacaaacgtctccaagcatcattgttatacggcgcaatgagtataccgaaagacgtactcatgcgcagtagccgtcttcacaatgatctgggcttaaaacgaaagtttttggatatttggatcaagacctacgatccacgagcattgcgagccgcattggaagcagtcactggaaggaagatacctacccccaagttggttcatgaaagcgatacctcggataacgacaaggcgatgaaacgcaggttggaaggatttctagacgcattcttgttacaaaaccaggatattaaccatcaagaaaagacctgtgttggagaggatggcggtgcagctggccggacctaccgtcggactgttcttcgaagcataatgatggtcatccttctggacaaggcaagaatgtgtcaagggaccgccgttccccgacgccttttcctctcttcgtcacccgtcaagtcctccgttgcagttctccaggcactgggtcggtttctgctgccatcatgcggagatatgatcaaagcattgagccatctggactgtgaactgagttatgagcagcatccattggaggaatatgactaccgggtcgacaaccttgctgtagatctccgggacggtgtgaggttgacaagggttgtggaaatgttactctatccttcaacctcatccggtgaactgtcgaacggaagtttcccgctttcgagtcatctgaagttcccatgcagaagtcgcgcagtaaagcttttcaacatcaaaattgccctggatgcgctagcttctgaaccaggaacaaggaagctcgcgaaagacatacgcgcggaagacatcgtcgacggacatcgcgagaagactattgcgttgttgtggaagctggtcagcacatggggtcttgctggattggtggactggacagaagtcaggaaggagattgaaagactcaggcagaaagccgctcttcacgctggtcacggggatgctgaggacaatatttggcacgacatgtgcataaacaggaacgacgagagcgacgaaccaaccttgctgcttaagcaatgggcatctactctagcacatctgaagggcgtaccactcgacaatctaagcactagctttagcgatggcaagatatacgaaagtatcattgacgaatacgagggatatatcgtggatcgccccgagagttatagcagaacagcatctctagattcgcgccttcgagcactgggatgcagtgcacaattcggtgagtttaccaaagaccttactcccttcacagcgactaacattgaccagccaaactcgtggccccctcttcggagactcgtatcgtcgatagcgattttacaatcggagcactcgcgttcctttgttcgcggcttctgcccgctacgaaacgcgcgcgagccgcgacagtacttcagtcggcatggcgacggatccttacgcgtcgagacgatgagcgccgagccgtcgcaagggacattgccagacaatgcgccgcagttgtacaaactcagcaccggatcctatgggcgaaggaagtgattgtgcgatggtggaggcagactcgggctcaacagcgtcgccgagcagttgctacgcaggctcacaaggacaaacgatatctatgaacgcaagtcaccatattatgatagggattattgcattgttcaggcgtttatctacagaccagaaggtctccaagtttagcactattgtctaattcatgtattccaacactaatacatcataccaatcacacagcaccagcccccaaataatgacaccaaaccactacgtaatataccctgccctcttccttgcattatatctcatcagccagatcatcacccaactagtacttagaacctaaacaacatccatgatagatacttattacaaatgggggcatccatcaaccaacaccgaccacccaaccacacacccccctcaccaacaagccttatctcccatgacaactaaaaagaagcaaacaaaaactaaagatacgagatgaaattatccaatgtgattatgtacattggggatagatagtgggggtaatcaataggctgatagtacttatcatatcactactatactagtatttaactgctgcaggtaaaacttactagtacttgcttttgccatatagtatatacccaaccaagtcactaccactactacccacttacccaactactatgccctaccccccctctccccttgctttctattggttatagttatgatggtttggtaataggttatgtctggtaaatgtgctagatgggttatagttaatatgaagcagcctacatacagtacaggattatgtatgcgttatgcattatgcatcatggtgaagaagaaagaaaatagtaagaaaaagaagtaagagaagagcacaagtaaacagcgatcatgacgacagcagacctgcgacgatatcatcatactacttactagtagattctatgatgataaaaataaacttgctctactagtagtaaggtactatatatataaatgatagtatatgcatctgcctagtatttaggtgctactatcatctgggaacatccaagcaaatcaagtcacacctggaagacagttactactaactaagtattgataggcagtaaagtaaaagttgaaatctgaatgaattgttacttacatacatggttatttagctacttactattactttagtaatattaatcatgatgaaagtaaaatctgttaagatgatatgcttatgcttatgttcatgctacatttactgttacagtggagggtgtgcctactacgactcctagttggtagtggtagagtaagctatggcttacgtgggagatcagccatttatcgtaagtaataatactgtgtactattaaatggtgatggagggagagaaagtttgtcgaggtgaactcgtatgatgtcacaggtttttgcagctgacgaggaaaacgactactactacaaagtagttcgttagttactagttaggagaatttctttattaatgtaactgtagttggctgaagtaatgatttgttcacaagtgatgctattcattaatttaccaatattaatgtgcctgttgtcagtgattttcatcgatttgagtggttggatagttagtgggaatgacgtcggttgagcatctgccatctgccagttgagcggccgatcgcatttccacccccctcgactacaaagtatgaccgaggtagtactgggaattctccatgatgatataatgcttccgatgatcagatgctgttctgaatcaacgaacgaatccggaggcttgtgagtaggtaatcatcagcagcagccctgcggggaaaaagaacaacagacgttcgagaagattactggaagcggcaacacacgtctcctcttttctatcttttgtctctccacctccctgtccgatgaccagatcgatcgccagcgggctttgacttccctcccttacggcgtacagtagtctcgctgcaaaggccctgcagtgcattggtaccgacctgctggttggagtccggtagactattatatgtacctgtgctggcgtgaacgaactttaatcgcggggttgttattggcagaaacggccactccgccatcaggagatgccccctctggcgtcctcctgagaaaagagcggtcgatcgccggctcggagggaatcgcgagatgctctttgctggccggagttgctattcttccggatcagcggaggagaaaagagaaggggtgggttccttaagttagtcggtaatgcaatgaggcttagacaccctctgacttggtatcgtctctcctgtggacatcctgtggtgtgcggacagacgtgtccgaggaccaggacagcttgtcttcttccaaagccccttaattgggtacgtctaaacgattcaagctgcaacgtaacctagtcgctctctctttccccctgaacaaacttcgacgtggtcatgcttggtattcgttcgccaaggatcaatcctgcaatataggagtagatgatcgacgatgatctcccaccttccggggggatactccttttcagaacggccagtctctacttttgagatccctcccccatcctctatcccgcagtcgcagtcattcgcccaagtatttggaatggtgcttggcatccttggccggtcaccaactcaacgcgggatcttcttggaccagttgcactggagaggcaaggaggaggaggaatgtgtcgagggcggacagtaggtcggccgctgttgctccggactccgggaaagaccggggaccgaccgctcccactgtcatggggaagttctagccagacgctcgctcattccagcgcaacaggcgtcgttcgcaacttggctgtgatcatcttggcggcaattctccgtcgtactgggggaaaggtcacaggacgttgccaagaactgccgtggaatgtccagaggggagggatgagcattgagcaaggggcagtcgaaacggggaccactcggtttttctactccgcctctcagctgaagggatccctcatcttcatggttgcatggggtgaaatgtatatgccttggccatcttggcggccctcttggccgtctcagtcggaatcgtgaccctcccaagaggctgtgatgtctgtgatgttgaaggtttcgggtgatccgctgtgtctcccccaagccagtgtggtatgtcgatcatgcgctcactgatgaggacattgccatccctttgaagacccgggctcgatgctgccactgacacattctagacgtttgcctaccacggtaagttttcgacgtgcaggccggcccgtcatggagtgcttgggacctggatctttattcatctttgcaacggctttgttctttgttgcctcccttcttcttcgttctagccgaagcaagggcgtaacccccatgtgcgactaaattgctgcattagcgaccatcttatctttcgtgtacccgatacctggtatacgggaggtatggtaattgtggttacctggatcgaagcgaggagtaggctgattaacgtcgacgacgttctgaatccttccatgactgaccatgccatgcgctcagtcatgggctcggagagggaggtgcacttgcatatgtcatggcggcagcctcacgtttatccgcataaaagccatggatggagtgtctgatgtccgggggtgggtttagttcgacagccaggggagtcaacgatgattcgccaattgaccgagtccaagacccccatccatcaatcatgatggttgtacggggtacaggtgggcaatgccgggtcggcggaatgaagctggctgtcgcacgggtagctgaccatgagacaggcaaaaggcaccttgttgccgtgccggtttggcgagtcgctgggactttttttacctggggcatacattactcgattgggtgcgtcgtgcatcgcaacttgaagccggcgcgaatccaagcgcgagtcccgtgctggtggagagggcaaagaggaggagaaagccatcgagcgtccagtcagcgtcgttagggcatcgacccagggagaataaatccctcatacaaaccgctcttaggccgacgtcggccattaaggtacaaggctctaactcttagtcgtcttagctgcaggccaatgacaccaccgcagcaggacttttgatcctgggcgcggaggtcgataagcggacgtattactcctaatcctaatcctgggtagctcagtcggtgtttgttaggttaatgctattcttatccggcgttgatcccggcgcctgcctgcctgtcaacctctcacagtagcagtagcagttataccatagtaccgcgccgaaaaagtggccctgaggcattcgcccaccaaagacacaatcccattcatgctctctggtctgttcgtctccataatcgatctcatggcggtccactcgcacgcgcgacagttcagaatctccaccgactgctgctggtggttcgatcaccaatatgcaagctagccatcctatcccagaaaaggctgggggaggaagaaccggatggggttgaggacggttgttcgtatgccacatagcatttcctcttccgggtggccggtgaccgtcgcggtggcagactatacctgcctactgtacaaaattcttgttccccttctcatccttgtaagagtcaactttggggtttgggttttaattaagatttaatttcatttatttatttctcttttttatttttctttccctttttcgttgtttctttttcttcgggttttgcttgctttccctcggccgtgctgttcagcaagagatcttcagctcttcaatgggcatcgaaagtttgcacgctgttcacgagcacttggaagaatcattgtatatagtttatatttcttattctgtttttcctttccgtcgacggtcggagtttatttgcggaaagtctgtttcgatcttggcttctaggccgcgtagcacatataccagatgtattcggaacataagtgtacataagtagcatgtaccttgtatcttgttctcgatccaagtgcggagagtccgtgttggcggtcatggatgaggatccttcggagaggactgagagagagagagtgtgtgtgtggtagccaagcatgggtcgccaaaggtcgcatttcctcccccaacagcggcatatgcaatgtgtaacgggggtgaaactggcccttcaacccacgccgtgtaagcaacaataataacaagcatacttagtaaatgaaccagggccggaaagcccaaaagggcaactggagtcgtaagactctcgagcaacgaaggatcgtgtaaatgggccgaccccgttggttcgtgaaagtgatcagtactagtacagtagtactactccaaggaatgccgatagttagtacttccccagcagtttttcttcttattcccatgactggctgagatttggatcggtcctgattgctgggatcgaggcaaaagcgggcaaagcagcataagaaaaaacattcccgagacgcgcagattggctgctgcgattgtgggaagctgcatctcccggagcagccatggcactgagtgggggttatccctgaatcgcatgaagcttgtcccagcacttgaaggcttcgcgaggcgtttagcagtctagctgcaccccccatcctcagcgaccgtggatgtgcaggttttttgattgtaagcccgttggtggtggatggggtggaattagcccgctcgatggtctccgctttggagatcgctaccctggttctgagctcggtgaaccgccgcccggctgtcagtcataggagagaaagtgatgcagtttgggtctctactgtgtatttctctggttctggcgctgaccgcttgtcccagttgctttgccatcgggcatggatctggtcatcatcgccatactgctttttttccctcttccttgtctccattcttccggagacaatctatccacaacacagtccagtctgggaaagacggcacgatcgcctgaagggaaggaacgggatctgagatgcacttttgatcgtttctagtccggatttgggggtggtcttggcacgggtctcgtatgtacggcgtatgtatgagcatcggtctgtatgtatggataccaggccgatcccgatgggttttcctgcttcctttttccctctcacactttccatcactgccactcgctgaacatgctgagcctttcttgtcgggaatgcctaaacaattctaaacttagtggcccccaaggctgagatcctagagatgaatggacaagttgctggatgagacgaaactctatctccagaattggctgctacctgggtgaccatccctgggatgatcactgtggagttacccgggggaagacaagaactcggctgtcaaaccaccagcgacaaaactatccaagatcgtgctattgtttgaggaacccattgaacaacgatccatgactactagttcccagtccttatttgcatagttcagatctaatctggttatttctggcaacaatggtctgatctctgatcaccttggagtccgaatatgttgtacagccaagagccaactattcccgcccagaccgactgtcactcccagctgttgtcaatcaggtggcggtgcttctagtcaacaacatacttggggtctgtagcatggcttgaggttctcatatactcatcattctcatttggaccgatctaggtaccagctttcctgggtacggttatcggaaccaaccttgagaggtgagcgtggcagattgaagacatggaaaccacctgcttgtcccattgccagtcgctgtaaccccatcaaactctccgagactcgagagcgtcatgatcgaatcccggtcacagtcggggaattttattgattttcatggttctcttgatgtggtagccgttgtaatgtagtactctggggtagagttggtgctacgtactgaagagttcagttcctcaagttcacctcgtcatagcaggggggttaggggtctagtcggtccgagaaactgggatagaatcgtcgagacttctcttgcagttggttcgcagttcccagtgatgtctgtagcaagcaggcaagtttgtcgttctggcccgcatcatcggcatcacacgagatgctcctacggtactggtaactactgcttcagactgagataaccttcaagactgccgtgacacagcatgactagggggaaaccttacgtcacagggccaagaccatcgctttccggatcaggaaccaccagatttaagcccagctagggaaagtctcggcaaatgcaatagtgagcaatgacaagaaataccaagcattgttattgggattgtaaaacaataatagcaaccagcagggggaaagggaggcagtgtcttgaagaacttgaattgttgtcactttgtctagtctttgagaatgaggcgtgatgccaagcaccacattggtagcactataatgatgattgtcctctgggtgttattttggcctcctaacaaaattaccatgttagtctggtttggtgtgctgtgtatggagtaggtagggtggtggtgtgtggtgtgtattcctggagctgcgaccgaccgaatcagtcggaagaggtagctacgccgaggaacctagtaccttaagaaaccactttcacgcataagcagcgcataaagtaagctgatgggatgtgatgctaggcttaattcaatgctcgatgcaatatttatgtgtggccagtcaaaaggtcaagggtcgttagcccaacaaagcggccgctgaaacggcttcggcgcgactccgacggggttcattttggtcctcccacggtcaagttgtcgggtctgcttgccgtggtcgccctcgtaattaccctggcattacccgccccgacggtcggtagggcaactttcccacacacaacagtagcagctcgtgccgctatgatgcctgccctggctcctgcgctgtcttgtcctcgtgggggttcattccttctcattgagtagccgccctccttgtctgacagcctttctttgctctggaccttccgttattcgctgtcttggtgaaaacccttgagattttgtacgacattccgatcagataaaatatccttttcgctgaatatgttctagaaaacaaagaatggatcacccccttacttttcattctctggttcttcggccactactatagttttccaagaccttagtgtagatggagggggggtgatgtttttttttatggcagcttttcccgattaagaccacagtaagtatggtctgggataatttcttactgaccgggttagtaagatcgaggttagcccgccttggtagccaacctccaaaatgcctcatagtcttttgctttttgtacttcggtgctggcttgccccatggatgaaaccggctcgttacaaaaccggtgactcctgaatcaggtcaaaggaacaacagtcatatctcgcagatctcagcagacaatgagatccgtgatcctcaactagatattcctttgaatgactcttctccaatcctttatgactcggagcctcttccctccatgacggggtttttgcttgacggtaattgcctactagtaagtagcatgacggctgtgtattgacgggagcgtaaagaataccaaggtattggtactggccagcgtcacgtagccgcaggaaccgaagcatgcatggatttggcgaggaaaacgacagggtgggtctgggcttggcggggttggttggactgagcgtctctcgtccgcctgcagaaggaaggaaaagaagccccagagaagatccgaaattgtaatcgtgggtaatgggcgtggtgctcttttttgttttcccaccatttttccctgccctccttcggccttaccctgccgtgccagtgtgtggcgaccactcctgaccaccccaacccggtcactcgctcacaaacctggcgccgctctcccgcctcttttaccctgcgaatcgtcatttactcgctgaggctgcgcctttttacccgccctccttttggctggtgactctcaatacctcgttcatacgcagtactgagcgtatggtaacaatactacggcgacaacccccgaggatttctttggtttttgatttttgatttttcttttaataataaattttgattttcgaattttaattttttaattttttttattttcgcctttccgcaaaccactcccccccccctcccttaattacatttttattttccgatcatctctacattcctccttctctccatctcaatcccacctagcactgccaacacattgcacctgcgaaactctttcgacgcgtcttcttcttctggcgctctttgagctgccaatctttgaagaaggcgtaagtccatctcttggccgcatacctgacgctcttctccttttcttggacctactaaactactatactacgcctctttcctactactacaccatgtgttctatatcatgacaatcatcgtcctactaaggacacccttcatttccgccctctgggtcgatcagtgctactattgatcgataacgagagtgcatcttctattttactctttgattgatgcaattattcttcattcttctcttccctaacaatcaacccatcttgaataccctcataatactacctaccgccaccatttcatcgagtcacactatactaccaccgccaaccctccacctaaccttttgacaccgcacctcaacaccttccacctacttgttcctgtcttccctcttactattaatatacctaatcttcgaagggatggcgcacttgcgtggtggtgaaagaacatttgcctcaatacataacctactgaagatgctactctcacctcatcagtccagcaagtctgcccctcaggaagctgacatggtcgaggacattgatgagccccctgatcatcggtttctgaacacgtcgatgaacaacatggacgacggtgtcgtttacgtcaagtccaccgccgccatgactgaccggaaggagtccctcctcacccgcgccctcaagagcagcccccctccaagcccagccgatcgtcattcaccatctcaggagcactccttctaccgctcctacacctataccaacatcagcggcatctctacagccgagttgaccagcgatggtggcctcacaagcccctctctatccaatacacccagcccgcctctgccctctcacttgtccaacaacacgtcttcgatgggtgataagagaaaggcggaggcggtggaagtgggcgagtcggctgtcgaggcgaacctgggacgcaagcggtgtatcagcttcgcctgcggacgcaaagccgaggagcagaagccacagaacccttcaccacagcgtccagtcacgaagatccatgacgccagcgttacaccaactgagcctaagcggaggaccgttctcacctttgtttgcccggcacgggatcccgaaactcgccgggagaggtcgccacttcgcggtggctgcaggccgcgtccccgcgggtcgcctgctcccatggcgcgcaaggcttccccggagaaggctgctccctcaccggtgagcaaggcttcccaggagcagaagattgatcgccggggtgtcccgaccaaggggttgggtaagttcgaagagtccgaggctactcgctttcacgaatttgccagctccgtcgaggaagatgacgagtgggtaacgaagtccggagagtattcggagaagattacgcttaatgactgtatgaagaaagagaatgctattaggaagctgggagaggaagcggaggaagaggcgctcgaagaagatgacgaagatgatgttgaggactccgatgacgactcgaccgttcacgatttctcttctgatgacggaaatgaatcggataatgaagctggttttgcagagtcagacgagagtgatgatggttcggaatacgatttttgggctccgaccagcactactgctgccaccagccctcaaaatgccgacatcgctcgccaccctttcagtcgccgcgactcgaacacgtctttcgattctgccaacgatgtgcagcagcagcaaagatggtcgcctgtcttatctgccaagacaactagccgatcgcccatgaagatcccaaagttgcgtcctggcacacctaaccttcccgacagtacggacttcgtctgcggaactttcgacgaagaccggcctctggaggctgcctacaagtcttgcatcgagcagcgccgtctttccaagcaaattgtcatccctcaagatatcgatcccagctttcccacttcggatcctgaagatgaggaggatgaggaggatgatattgaggaatctgtgatggatgaaggacctcggggacggactggtagagactctgcgcagaagccttctcctcgtacgtctcccagacgtatggtctcacctccgcctcgccgtcagggtcgttcctcgccaaagcgtcttcgctctccgccgccgccgatgaagctgcggtcttccaaggatgacctggcatctgcggatgaggcccctgctgtgccgtcgcggggactgaacatcagtgaactggtgcaacgtcccgcgatgtctcgtaccaagtccctgcctcggacgcccaaccctttcttcactagtttggacaagtctcaccgctggtctggcattgtccctgtttacgaatcgccggagcgcgagtcgtcacgcacccgtgaggtgcacaccagaggtcccatcgatattgttgagggtctcgagaagaaacgccagaaacgaaaggagaagttctggcgtcagcattgccgcaaagctgccaaggagcagatggtacggcgaccgatccccggaaaaggtgctgaacggatgaaggagcttggcctcgaagttgctgagaggtgcagagcttacggcgttggagagaacgcccagctcgtcctatctgtttagacctcaaattccgcgtgggattcgataaattcttgtacatagttcgaatttttcttatcaccctttcagtcgtccactttcatgaccagcggaccgacgtggtgtacaaattccaattgagcgttgttcgctacaccccttgtcttcgatgttgctattcttgtcctcacaacgtgtccatcggatttctattcgcacggagggtcccgtctgcatttacaggggtggctacctttgattcttcctttttcgcccgtccccctttcttttcgctcttcttctcattatacatagcttgtttattccttcttttcttcattgttcacgtccgcgctgctgagcggcggatttgacgtttcggtcggcatcattgctcggttagcctgggttgcatggaggcggtttgctgcgcgtatacccccgtttgctttcgttatcgaatttgtagatacagagcgaatgacatgtgtcattgaatatgccaacgtatgatgaactactcttgcgtatattagacggtagaaccagttcgggtttccgttgaaataatgtagtagtttcacagtgttccaaacgactcgatcggggcggatgatctcccggcggctgagttggcttaagcgctcggctaagcgtccgggcaagcgaaagtccaacgtcaactgtcggcgaccgcaacctggctccttctcctgctcttatctccagcccagccgttcaccaccgccatttggcccattttgcaccctgcctcgtgctgctacccgatccgcaaatccatagtctgaggttctgagtcgattttcaccatgtggctcattaactggtgtaggtagtctcctgttttgccatccgccgacttggccccgatcaggtggtctgcagacctgccctgcacgctcttggatccattggatcctcatcgtttctcttctgttcacagtgtctctcgtatgccaatttactgatttatcttttccgaatagtctacgatctcctggcctcccttggcctgctcaacaagcacgccaagctcctgttcctcggtctcgataatgccggaaagacgaccctcctgcacatgctgaaggtatgtgagcttcctttagtcgcaggcaagctctgctttgatggcaacaatggtggatatggtatcgcctgggatcgactccgatcgcaagggaatgccaccacggcagggatagagccgcgagagatgtggacgataagctaacatctgtgtttgataatagaacgaccgggttgccatcctccagcccactgctcacccgagtacgtatcacccgcacgaacatgccagcgagggactattcgacagcgaccgaggagaatcgattttcatgaacatgggctaaccgcactccttgaatacagcatccgaagaactcgccatcggcaacaaccgcttcacgaccttcgacctgggtggtcaccagcagggtgagtaacacacctcgtagccccgtggtatagatcgaaacaagaaaactaaatgtagcaattcttgttaaatagctcgtcgtctgtggaaggactacttccccgaagttagcggtatcgtcttcctcgttgacgccaaggaccacgagcgtttccccgagtccaaggccgagctcgacgctctccttgccatggaggagctggctaaggttcctttcctgatcctcggaaacaagatcgaccacccggatgctgttagcgaggatgagctgcgccaccagcttggattgtaccagaccacgggtaagggcaaggttcctctcgagggaatccggcccattgaggtgttcatgtgcagtgttgtcatgagacagggtgagtgggatttttcatatccaaaccaatgtcgaccaggagctaatcgttctgtgccttgtaggatacggtgaaggtatcagatggctgtctcaatacgtctaagtcagctagctcgcttgctagccagctgttgactttattgttgcgatatatcccgactactctatttttgttctcctatccctctactcccgacgatctccctcttaaacgcaatcctctcatcttcctccgaaccctccttggagggtgtaggaattccatatatcccaatccaatccaatccaatgcagttcaatgagatgaactccactccgtccaatcagacaggccatcacaactgcctggaagaaagtactcgctaggcataatagtcccatgacccatctacaatatatctcgattgttcaaccatttaaatggtcatgtcacctacactgattcatactatgatgttgtgtgctttttttttcggagtttgatcttttgacgatgtttcgatcagttcttggtgctttatcacgctgtccctttcatctcgttgtagccacctttcctcttgttctctctgcgttcgccttccaagaccaaacaatcaaccaacaaagcaaataaaaaaaacaaagacatatccttccccctgactttctccctttttcttcacctatactgtaacaatctagttcagtcaccccctttcaccgcttgcttgcttctgttctctagatacgaccgagtacgcagaaacgagaattccaaatatacaaaacccctagaatacattcatccatccatctcaccacaggcagtagtagtgtatgaagagttactactattcggacatgtttcctactacttcagtcatgagtcccaatccactactactatttctggcaaatccacatactacacacaagtactcagtacatctgatagtaaagacagatggctgactagatagtagataatcgatagaaaggagtcccgagttccatacgaagaaacgaaaagtctaattactaacttagttaacaattactatgcatatagtcagcctactaatactttactaattaattttaccattcatcccgggttcccgactggtaggagaatctagggaaaaaaatacggagaaatagagaccaaggttagatagatagatagaccggataggataggatagttggtacaaataatacacacgcacacacgtatacacacacgatgtcacacgagacgaatacaataccccggcgagagagaaaaaaacaagacgtcattcaggcacaacgataacccctttcccgatctgtacattcccatacatccttccattccattccagtttgatttggtttgtatccttctcccccgcttttccgctcattgaggtccacttccgtgataggtaggtagtagtttgctgcgtagtttgaatgttgggttggcggattgtcgtttgtttgtcgattgcattgatttccattgacaagctagctgaatgcaatttcacggatcggtgtctgctgggtagggtaggggtatagacagtgtggctagatgggcgaagggaaaaaggaagaggacggggaggaggatcttggttttggacgctcgaaagaaacgggcgtgtcgttgcttatttggttggcattacactcacaggaagattttgaataaaaaacgcacttggaaaacaccagatgcagcccgtcgcttccccttcctgtcaaatgaattcggacaacacaagttggacaatgggaagaaaaagaaaaggaaaaggagtaaaaaaaaaagggaagttgaagaatgaagatcaacaagaatgagaaaacaccaacccctacttggagcagaaactaccttccatatagaaatgaaacacattcagcgggaaatcaatgactgggggagtcgctggagtctggtatgcgcggagggaaaaattgagacgttctgcgtgtcgtgaggttctcgggcggctggggtgtactgctgctgccgatcgtctaatgtatggccatcgaatgtcgttgggatttgggtctctcgttgtagtgtgacattgtgtgggagttatgacgtttttatctccgcccgaacctgctgcacatggaaaagctcgtatgattccttacttcttcttttgctttcgcggaggagtgatgggcctgcctgagctcatgcccccgtaaacgtacttttgtttcttttctgctggcttcaagatctattgcgagaaaaaatacccgttagttccaaaaccaatcccttcactaaagtacaaagtagtttggttgggacctacctggaaggaacaaagtaggctctcgtcgacgctcatcatcgcaccagcgttgtcgaactcgccacagtagttgggagcactgaatagcgtaaccagctgtctcttggagaagaactcatagccatcctcgacgacctggtgtgcgcgacatatcaggtccatatcatgcttctggaggaaccgcgacacgacgtccggaccaaatgtgaaggatacaccccgatcgttctcgctccagccagtaatgtccttatcgggatcggaccagagcaagtcgcaaagaagaccgcagtcgggaatctatcgtcgttagcaggcgaagctcaaggcttcagggagcccggcagagatttttaaacgttcccaggacccttatgataacaaacgaaaggagtcccccctgctgcttgtgcccctgcctgtcatgttcgcctcttatgtcatggtgcatgtgctgcatatgtgatgatcattaccgcaatcacagtaaaatagctacgtagctagctgccaagtaagaaggtggatagttgccacatgatatgacaggaagcggggaagtaagtactacgtactaggaagggacttgacagggtaagagatggtcatttgcacagatacataattcctacctacttgcatgcaggtcatgcggtatgctttctttgtaagtagctagaagtagctaaggatggacaaagtacgtgcatatgctgatggaggtctgagtcctaggtactctatccgcgtccgtgagtgtgcattagcagagcatccacccatccatccctaattgcttcgcggcattagtggttgaactaaacaattagttaagtcgttatgtacagtcactaagtatgggtacatggtacaggtgacctccggggatcaatggttcgccactagaattctcttgactaaatcaccagccatttggccgtgaccttctgggctgattgataatcgccgttcagggcatagataatctgcagcgccaccgccgcttcgcgcgaaaagtcctctacgaaaggggcttgcgcttctagccctgtatcgcccatgacgacatcgctgccatctttcgggtgcgggatcgtttgttgggattgcgcttggatctgtgcgccgagatctagcacgagctggtagccttctattgctagatgggctatccctaagctatgccagacgcgagcaaagttgaattccatttcttgccgttccgataggagacttcctggtcgttcacggacgcgtcgatactcctgcatgaacgacagcccctgcatgatgaggtagtgtcggttttcggactggcgcttgagtgagtgatggatgtagcagagggcgatggagagcaggacggctgggttctgatcgtccagtgcataggcgcggaataagtaattcagggctgggtagaaactgtttcccgagtaaaggatgtggccgtatagcacaagcagggcaacgtccatttcatctgccgggatggcttcaccagtcgtctcgtcccgcgtagacaaggatgcgcgttccttgtaagctgactcgcgcacgaaccgatttggtcgttctcctgtaacctcgtccggtacagtaaagtccatggccttgatctggcgcagcatgaacttcatgtttggtgacgagtggaacaaagaccggtgaggatcaccgacgagccggctcaacatggcaaacaagcgataagtatcagttacgaattgatattccttgataaaccatcgtgcttcatttgcaagcgtctcttcatcctgcatccgaagcgcacaagctgggaaggtcagtatctcatgcagaatacgatacggcaaaggagactcactgaaccagcaaacatgaatcatgcgggtgtcggctttggagtgataccagacgctggcatccgcagcggctgcgagcgtgtcgtacgcttcgtcggattctccttgcgtcgctacagtgagggcatactgcaagaaaaggtcgagccattcattgaagctgatcccatagtagtcagttggtatagccccttgaagtggctcgtcaggaatactccctggataacagtcagctatgctccaatgacacaaaagggtatgaatcacctaaagactcctggagacgcccagccatttcttgcatctcatcgatgaagttgcggcccttgtgtctccccgcctttctctgtgcttcgcgcgaatatcccaagaaggttatgttgcgttgaatgggatagaatactcgatttgaccgaaattcacgcagcaaagcgtctgctatatccagccagtcctccgtggcttctgcgttgccttctttcgcttgcggaagcagctgcattaacttgtcatagagatattgcacatttgctatcctttgttcttcatttatctccgtatcctttgcagctgaggtagtagtagtagtcagagcagccggcaggtcagcgcttgggggctgaggcgcgattgacctcaaggcagcgtcttcacgagccgcatcagctgccttgaactccaccgccagctgttccagccttgtgtccttgcgccggcggttactacggctctcctgccttcctagcagaaccgcttcattgacgtatttcagagcctcttccgacatgccaatgccctcataaagctttgccagctgcacgcgggattccacgtgccgtgcatcgtgctccgcaaccgtaagaaagcagttctcggcgtcttcgagcttgcccaatacactgcaacattctcccattgccatgaagaagccgacatctgcgtactcgtttgtttgttggaggggcatgtagaaccgcagtgcctcttcgaaaagcccaacgtctttgagcgcatcagcggcctctcggaaaaggtcgccataatcgtacaaccgagcatgttcggacgtatcctccgggttcaaccactcgaggtgatgctgtagtttctgtgtcagagaataggccggctactattcgtatactaaagcacttaccagagcttcgttcttgtgctcataacccatcctcaaccgaaagagtgccagcttgatccgcaactccaggggtagaccgagaccgtacgaatctcgaggccaccttcgaggttcgtatccatcagccttgatgcgtcgaggagaatcatccgcatcccattcccggtcgtcttcatgaaaatcctcccacatcgtatcatccttccggcctagaagccatctcgagacagacttgagggccttgaggccctcaaacggccggcccagatagctgtacagttcggcgtagatgttgacatcggaccaagaaaattcgggagcatcttccggttctagagacgtgaagtatttcacgctcacccgccactgatccacggctttctggacatcgttgaggtcgatgtaggtttctgccaggtgtcgaagcgccctagcgttgtgtgggacttctttcaagatgcgctcatactctgtcgctgctcgtccattgtagcccaattctctgtagatcgctgctcgctggaatcgggcattgtaattcttcggatctagctcaatgatacggctatagcagtagataacgtcattcagtgcaccttgacgttcctccccggcgcgttcgaggatcatccttgctactttagcccatactgtaggatctttgggccgcgtgtgagcgccgctgaacaacgcggtcaatgctttgtctttctcgccttgggccaagaagatttcggacaagagcgaatgcgccgcgaacatctcggggttaacctgaatggcacgctttgttagatcaatggcacggtcatagtcaccatcgatgaaggcagaggttgcctccgaatgcaagatcttgaactcggggctcggttctagtggtttgcgcggtcctctcctgatgccctttccaccgcgcgcaccgtaccgaccagagaaggggcctgtgcccctgcgacgtctccgaccgtaggcttcgtcgtcttcatcagcctggttagagaactcttcctcactgtgtgcggtcagcaacagacagaagactcaagaacactcgcatgacgtcgtgatactagccttgaactctcctctgaagacaatgtatagagggactcgtccgagtcgtccgcatcatgatacgcctctgcatcctcatccaaggaagcctcatcttgagcctgtgaggcgttacctgtaaaaaggtccttatacaggcgcggatccagaacggagtgaatggaggcctctccttgcgtggttggctgatttccctgccatgggtaatgtatcgtctcatcaatatcgggatagacgtactcctgcgagggaggttggtgatgtgggtgatggtcgtccgggtaatccattttgggatacaagtattcaggtgactttactaatacggactttgtgtagcaagactttgcccggccactggcccctagaatgcaaagactggctggaaactaaacacagacctcccttgaggagcagatcaccaagtaagcagacagactatccgaggtgtcgtctcagtcgtctcaaggatatcggggagcgttgtgcaagactatgcgacaaagaagcgatcatcattgggttgtagtggagccacagcaaacagacaagcaattggggcttgtatccgaaaacacggttggatggcgttgcaatagcgtctagagaaggtagtttagaatcattcgagaaccgtagggaggcgcacaagacaaagggtaaggcggagcgataaaggaaggccggatcacggacctggagggagggtttattcatagcaacatgtaagcgccgccaatcccagactaaacttgccgatgcagaaaaccggccagaccggccgactgggacgcgtcggaggcagtgggatatagaagtcagataggtcagatgaaaggagaagatatagtcagatcttgatcgatgggattgtcgatatagtcaatgttacaaaagatatagaatgtagatgaatgatgttctagagtatctgagctgaagaagaagaagcaagtaaagaagaagaggttcggcggagaacaaattaagccaaacataacccaaaccagccaatccggtgactttttcttacgcccgccacggcaaagtgtcgttttttcgtttcgcttcttgtttctttcgttcttgacttgttctgttgcttctctccatcgtcttttccgcctttcttcgtctccctctgtctcggtctctctccctcttccttctcttccccccatctacttactctctctctctctctcttcccccccatcttccctcacctccctcgccatcaagtttctgcttcttcgcttcccccccctttttttttcttttcactttcctttttatttgatgctctaggtatcttgcttgctgtgtttgacacactattgcagataaccctgacatcctttcgttaaaaaagaagaaaaaaaagaaaaagaaaagtcaaaaaaagcgcaacccacacttcccctacactaattccacccgggaagtcgccgcgtttctctcgccatccaccgaggattttcttccggccatctgtcttttctcgttctctctccaatcgattgatcaaaacacctcctttgatgctcttgcgattcgcttgattcctccatcctagaatccgaatcgggcagtgcagccactggactggtctgtgccccaaacgtcattgtccagaaccaacacagttgggtttctcacctcttccaaccgaaaaaaaaagtgtctccgtccttagagagatttctcgcttttgatcctttgcctcttgggtgattcgctatctcccagcctgcgaccaaaataagaaagacctcctgttccgaccaaccctcacgacacgcaaactcagcaggtgctgcaggtgttttgcagtaattcttctctttttgtatttattttccatccgggcctcgcataaagggagaccgacttaaaaagaggaaagacattcgagaaaagaaagtcccattccgagactttcctttgaccctccttgttccagaatactaccctcattcaatctctacttatggccagccatatcatcggcaaccgcaacagcacgcctgaagcctccaagtccagtcttcgtcctccatcgtcgtctcgtaatctaggatcgcaccagcttcgtgcatcggccgatatgtcgggcttcccatctcctctgtcatcccgcagcatccgtccttcctcggaagtctacttcaatcagcagtcgcaggcgtcgaacaacgcggaggatccgttggaccgtgcggctcagcagtggctcgcggatattgatcagtacgagactacattggaagaaatggccgctgccacgctggaccaggatttcaaggatgagcttagcgccatcgagcagtggttccgggttcttagcgaggcggagaggactgctgccctttacgctctgttgcagcagaccactcaggtgcagattcgtttcttcattcaggtcttgcagcagatggccaagagccatcccatgtcgggactgttgtctccggccaactttggcgagaagggtgagttgcatatcaatccagacaagcgtgacaggtattaacaatgttcttttggcagatgccatgtctaaccgcctgaatgatgccatgtccaagttgaacgtggacagctcccggagctccctcggtcgccccccgccgtcccccggtgccaagcgcaactccgggctcgactcgtccaccatcaatgccatgttccctgatgctgctgcggcaattgcaaagaagaaggctgagttcacccagcaaacgggcaatgctcctccttcgaaccggaacagcgctgttttcgatcggacttcctttgtggcacccaccatttcggccccagacaacagcaacgacaccttgggccagcctccggtttcgccctgggcccagcgcggatctgagccgcaaccccctatcgcccgtcccaagtcttcgtccggtcatcagcccatgggccaattcagccagactccttcgagcctgcgctctccgctccctacccaaaccgccacgatccctgcccccgagattgatgctcctttgctctcgccttacaatgttggaaatgccagctgggcctccatgaccaacacccccatgacggcgacctttggccagcagccgcagcagccccagcagaattcgcaggccgatatggtggccaacgcgactgcgatgaagctggccgcactgtcgaccgtcaacaaccgtattgcacttgatgatgctcgcaagtaccgtcgggctcgctccaacgatggccagggtaagaactcggccaacagccacgccatgtctcagggtggcctggccagcccgggcctcccgggccacagtcaccttgttgccggacagctgttgaacactcagcagctggcggctttgcaggcacagcaacaggctgcgatggcgggtcgtcgctcccgcccgacgtcgcctggaatcgccatgcagggtgctggcggacttggtccgatgggcttcacttcgccgcagaacaacggcttcttggcagcatatgacccgaacaacccgctcatgggtaacggcctgggtgcacttggtatcgggcagtttggcctgggaggtcctgagggctacctctcagaccactcggaagtggctcgcggccggtccccgcgtggtcgtcgcggtagctcgaagccgccggaggaccccacggaccctaacctcttgaaggacattcccagctggctgagatcgctgcggctgcacaagtacacggaaaacctgaaggacttgaaatggacggagctggtcgaattgaacgacaaggcgctggaagaccgcggcgtcaatgctcttggtgccagaaacaaaatgctcaaggtgagttacataaactctcccaggagtgttgagacatcatgctaatctttgtaggtttttgaacaagtcagagaagccaaagccgagggcaagctcgacaacattgcgtgatgaagtgcagccattcattcattcgacttgacttaacgtttctgcttacattctctctattgcattaattgactagattggctttgggcataagtggcaggatccgaaatgaacctatgagcgatctcatcggaaatgaatcttgggaggaagttgtctagtaatgggattcgaacgccattggggcagttgaatgagtgaccgacttgagtgacttattgacttattgtttgtatggatgtattcacatgttcatgtagacgtgcgtggggctgtgtctcagcatgtcgtgttatgacggctaggatgttaatggtataatcatcatggctttggtaaatataattgtttgcagattaaacagacctacagagtagacctacttctagttccttttcttcgtagtctaccacagtaataataataatgagtagaaagtagtaacccaccaaaggcggaaccaaccggcaatatactccaactccgacatcatgctacctacctacctagctatctaccaacttatcaccacaaccaacaccatcatccatccacccacagtccaccatccaaaaccacacaatcaaaaacaatcaaaatgccacccacaaaacaagaactctctctcctcatcaaccccctcgtcccggaatctctccaacacaacaacagggtgcgttaaaccctcccccaaaccaaccaacctcctacgaaccctctcactaacaataccacctattttaatcccacagacattatcttcattacactccctaacctccttcctcctcggcctcacagccggaatcctctccctgcaatccgccaccggattcctcttctacctcctcggcacggtcttcgtgtccgcgctgttccacgccctgctactctatcgctccgggggattaggcgcggggatgtattttgcgggtgcgaatggagaagttgaggggatggatgagaggggtgtggtcagtggtaagggtactaagggaggtggtatgttgagacgcgcggcctggagggatgtttggtttgggggtggtgtgctgagtgaggcgctgagtgggtttatcttggggtgggcgggtgttgggggggttttgaggtgatttttcctttcccttgggaggatgcagggggaaatgataaaaagggtggggaggggggaggtgtggtaatggggagggaggagacctaggtgtatttattattgatgtgtgtatgtatgtataattctatgggtttatgctatctatctatggtgtctatgctgtgctgtgttgtagggtgggttgacggagtggtgatggtggctgtgtgttgcttgagatgggcttgctgatgcgcttgtgggtgtttatggtgccctgtggtgtgtgtttgattagcattctctctggtaaggatgtaggaagaggcgatataccttggcaagagcccataaataaggaacgtgaatgacttcgctccgtccctcgccatcgtcttccccgacgtgctctccgtcgttctttcctcgaacgtttacccagacgttgcccatgaatgtagtcgttaagagactcagtcctactatggggatgatcgagatgaatgcccacatgatggcattcttagcagccatgcggatgctgtcttgcactgctgcgggcagattgtcgagaaatgctaacgagtcggtatcatggacgttcagcgagctgcccgtcccctctaggccccttaaggcagaggagcggccgaacttgttattgaagacactggtcatgatggtcaagccgagcgtgcccccaaagggaagcgagacctgcatcaaagacatcgctggtgctatccgctccggccagatgcccactgtgtggagcgaggatggcatcaggcgcagtccgactccagcgccggtgatgaccagcattccgcttagcaggctggtctcttgtgcgctgatggcgtaagccactactgagagaccgacggtgctaagcactgctcccatgaggaggggaaaaaaggtttggcgagggaagccgttgcaaaagtatattgctaggtagacaccagctatacgcatgacggttagtcagttgcaggtctcgattggcaagcgtcttacctcctagtccggggatgtagtataagagttctaggcctgcctttgaggtagagtaacctgcaaccaagatgtagtaaatgctgataaagtagaagatggagtatgaggctaagacagtgagcggttgtgcgtgtagcatggatggctaagtttcacatacctacgccagtggaaaagttcactatggcaagccagattgtgtctgttcgttcgaaaaggccgtatggaagcatcgccacgtgcttcgggaagatgcgtgcgaacaatctacctggttcaaggaggtactcgtacacaaagaatgcgatgaagcagattgcaccgatgatcaatggtgccagcacctgaggagacgaccaggagtaagtggcgccaccccatgtagtgcctaggatgatgaggccaacaccaaatatgaaaaggatcgatcctccaagatctatggtagcaagtgctgggagtatcgaggaccatcttgagcccttcttgaacatggttccttcgacaaggtcattccgcagcagcacaaagatcatgatgtggctgaggacagcaatctaatctgatcagcctttgcatagagtaaagcaccgtcaaacttacaggaataggcacaacgaagcaatatcgccaattgctctatcatctcgttagtaacagtatagagcgtgcaaccaggctacccacatcagtaagatacctacaatgcaatcattagcagtgtacatagcattctcagataggccacttaccctccgataaccgggcccacagcatatcccactcctccaaagatggtgaatatagacttattccttgcattctccttcaaggacaccttgtcggcaagaataatcataatgatattgttcagacccgcagagccgacaccctgcaaagccctacccagcagcagcataccccatgtctgcgcagctgcacacaggacactcccaataagcatgaaaaacaacgccgtctgcagtacaatatgacgcccaaagacatcggcaagctgaccgaatatgggaatgaaggtggttgatgtgagactaaaggcggttatgatccaattcagctcatcgaactggtctagaaacagcgtacatggtcaggaaagaacaatcaggcgcaagagtcttctgtcttactaaagtgagatgcgatagtcgaggtcgcagtagcaacgatagttaagtccagtgtggagagagtaaacggcagcgtaagaccagcaatgagcttaacgcgatacactcgcgcattgtgcttttgctccttacacagcctgcatttatcagtacctgtagcaggactcaatccttttgtggagccagacataggcctttccaaggactcggagtcttcgcggttcgtcgactctagttggtaccattgcgagcgatgtgcacaaagtggctttggtgcgggagacttggagtctttcgtcttctgcgatatgtacttgtaagctttaatcatgtcgctagtcccatcagtctccaggtaggattaagagaaataaagtattctggtggggaggaatggttgcacaagctgctgatagaattcaatgtactacaggatgccattgtgtagttatatatggaggctacaacttcagtttggccttatatcatgccaagtcaaatgcaactgaggctgtgtagtctagacatatctccttcgagacatcaatgcgaggcacgaaggatatcaacatgatcgatgtcaagtgcatcccatcactgcagtcaagttttgggccgtttcgagcaagtaatgcgcgcccgtctgattggccgggaatggtgcctatccgcaagccctaccgaatgcggtaaggactgcgaggagcctgtcaggctggctgtgactctgccaactcagcctctaacaactataatttaactactatgaatcttgagctcaaaggatgatttctaggcatctaatctatataggacgtagttcggataacatgaacgcattaaacaatatatgtacgtcttcaacgagtctatctatatacacatagcgagacatcaggggtatagcttcaatcgacagtaaataaaatcgtaaatccgactcgctccaaagcaaaaccccgggtaaggaaaaccatgaaaagtaaatcatctcgaaactccagccagggaggatcgttcatcttctataccgatcgtggatcaactcatgcgcttggctcctcaataggctcttccggaggcgaattggccaaggcactctcgagcgcacttgtcaagtcaatgtggaagaatggccggttgatgccctgcaccaccgccgccttgcgccgattgcggtatgccttgctgtccttgagatcgcgcgccaacttgtcgtccggcgtgctgctgttgtcggacgacgcttcgatatcgattccggaggcctcgcgctcggtcatgtgagtttcgtgcttgagtccctcctcgatgtcacgcttgatggcgttctgatgggcatgctcattgttgatcatctccgcatgagccgcagcagatgctcgtccttcgatctcagccacactgaagattggcttccaccggtggaacccatcatcagaggtaggtgtcgggtagccgaaacctgcggccgccagtgctcgtttcgtccagcggttgttgatatgagcgaagtgccactgaacagtgcgaggagaagcatagagatcgagctggttgcgaacatcgatcaggttttggatagaagtcacatcaacattgttaaccgatgagaaatcgaggatgatggagcggaggatgggccgttgcgagcggttctcttccttgcccttccgagagccggggtcgttccatggcctatcaccgggacgagcgtaagagaacgggttggtgcgacgcgtctggcggaagattgcctgaaccaagtagtcggtgtagtggttggcgttggggtagttgaagccctccgagaaacggtaaatgaagataccagggtatggctgttccacctcaacctcggggttcgagccatcggtatggttaagagggaggaagatagaccgacgggacccgccctcatcatcgttgggggcatcagggaaaccacccggtccatacttgccatcaccttgcaccagatgatcgccaacaacggagtgaatggtgactcggcccaggaactgaccgcgggccttggcaacacggaaaagcaggacagccacggacacacagatagtgcagtagataccatcctcgatcgaggtgaaaacagttacgataacaccaatgaagaagatgattgcatcaaggggcgagacgcgccagaattatacacagtgaagggcgaattcgtttaaacctgcaggaccaaaagccgaagaccagacccccaaaatatcgataggaaaagagcacttacatcagtggggcgcatcacacgacggatctgttccatcgagttcaagtcgggactcagacctccgtgcatggtgaagatcttctcatcgatgatagccgcaatggggagacagttgaagcagtccgtgaaagtcttccacagcttaatgttgtaccgccgcttgcactcatcgtagaaaccatagatacgattgatggaggcgcactcgtggttaccacggagaacgaagaagttctcggggtacttgatcttgtaagccaaaaggaggcagatggtctccagcgactgcttgccacggtcaacgtagtcacccaagaacaggtagttggcctcgggcgggaagccaccgtattcgaaaagacgtaggagatcgtagtactggccgtggatatcaccgcagatctaataagcgccatcggattagtttccccgcgagagatagacgcgatgacccggacctctgccgggacaaacgagggatggcgttataccttgatgggtgcctccaattccagcagtatgggctgcgagatgaaaatttccctagccttggtgcaaagataacggatctccgactccagaagctgaacctgcttgccaggccggctgcccctcacctccaacaatctatcaatgatcgagtccaaatccacgtcttgatcggccatgtttgagcgactccaacgagagacgacgcaggaagaaaacggaaaagtgcgaaccgaaaaaaaagaacgaaaaaagaaaaagagaaaaagaaaaagaaaggatcaattaacacaagtgttgggcaacggaagaagaaaagaaagggcgcgaaaagggaagctttgcggaggactcggtaggcgatacgatttgatgacgcggcgtctataggctgtggcagcgaaaatatagagattagaaatattccagaaagttcagagcagactttgaaataaggtctagcaaaaggcgaggagagaaacgcgtgatcaatgcgcccgggaaattttttcttttcttcaagctggttgatcttggatggcgggtgaaacggggcgagacggggagaggaggggtgagaagttggcaagtagtaagagttaagaagtcggcttaccaaacagaatctaaaagagacaaggggaagttaaaagcggcaacaggccaaatggccttggggacactgagaagatctgacagcgatgccagacgccgatgagaaaagcaagcgggcttggataaatttttcacacgggagggaggatgaaggcgaagcgcgttgataacggcgagatgcggctagcagggtttgagaggagaaagatatcgctgggcgaaagactgcttctggacggggcggttgcaaaaaatagcagccggcggcgggagagaaacggggtgggttggggagaaaaacaagggccaacaagcgaagccgagattggaggcgagctctttttttccttcgaagatgggtggaagaagagcgctggggaagtgggaacgaatcctatttcttctgcacctgatgtggcgtgaggggtgtgtaaaagaaccgatcaaagtcacgtagaagggggaagagaaaagatggaagagagggaagagggagggagggagggagaagtgtaagagggtgagggtgtcagtgacaagagagagtgagagtgagagagagaaagggcgcgcgagcagctgggattgattgtgtttggttgccggcaatcaagggatcgatcgatctcttcctttctttcttttgcaaggcttctgggaaaaccgtccgaggctgaagaaagattttcgcgccaaattccacgagaaacaggagaaccacgagcagacagaatgcgaagaaagcaagcaagatagagatagatgatagcaagatttggggggggaggaaatggggaagggggaagagaggacggcagtaacgaaggaggacaagctcaccagttgagacgcgcgcgagaggaccagcagcaacctggactgggcgagagagggaagatgagagaccaaagcaaagcaaagcaaagcaaagccaaagcaacgcaacgcaaagggaggaggaactcttgatgagagtcccggatggcaaaacggaagggccccggcctcactgttgattcttttgattggctcatcgcccgggcggcgggcggcgcgccattcagtaaacagtaaagccttcatcttcatggtgtgtgtcttctctactaatactaaaacagtagatactactaactctctccttccaacggtctgtcaacgtctcgactctcgtctcttaactctctttcgcatacccctccttcttcaggggactacatctccgcttcatcctccaccgtacttttgtcaaaaactctacatccttactaactactactatttgaccttacaaccccagatcttctttctcttcactctacggcaccacctccctgctgcaagggagcaccgccaatcgatgccgcatttcccccctctttgcagcagtccagcttcttctaccctctcaaacaacgattcccatggcgctgaaaccgtgtgtggattctcgacatgcctgccggtgatctacctacctgatgtacatatacattatgtacatccatacttcggacctacttacgtatgcccatgatccccctccctgttgtcgcacgagcacttgcatgcttcgcttcaacgcctcaacctcccttgggttcctccatctaaaaatccccggggtgtacctgacaagcacttatctatggcaaatctacctcggattctacaccagtgggggcttccttctttactggcccccccaccacccttcttcaactctacgtgtgacacacctgatccgaaagcgcccatggcgcattgcatttcaactattggcgctaccgcggggaagagagaacatctgatctgactcgtcacaacatcttcgtgtctcatgcattagatccgaatctcatcatgggccatggcggtcccagaaaataatccgtagaaaacggcagcacgccaaaaggaagaaaagaaaacgtgaagaggagaaacaacttgagtatacatcctgaaggatcatcgcgtgcgcggaatgtcatgtgcaagcagtagaaacgggtaacagtcaagacacaacgagcagtaccgaaaaagcgaagcatcacgtcgtatataaatcaagacaccagttgaactccgggacacccgcactcctgcccaaaatacagtacaagccgtctagaacaaataacaacaaaaagtaatcctatcagatggaccagccgggaacggtcggatgcgggccgtaggtggtgtataaccgcggcgaagcaagagaggagtgggagaaggaggagaaagatgaaggaggaaagaagaatcaatcgtgtgttccacgcatccgggccgtaagctctgaaagatcacctaacgccgtgaatgatgcagttcagcaaccagctgccgtaagcatgtcgttaaaaggtttgcgtgaatgaggtcgagtgtagtcaaaaaccggaaggtatcgtggaagaactgcgtttttcgaagccaaaccgaacttttctctggggtgtgaaaggtgtaaaccgaaattccagacttaggaacgaccatggatgaggtcaagatgttctttgctcccttgttccttcgatctctctctttgtcctcttgtcttttctttcctatttttctcttcgttgttttcaactttttttccatcgatttttctctcttttttttataacttaatggccctttcgactgtcgtctttctgcagtcaatttagggcatggccaccactcaggatgacctggggattcaccctggtcagggggtccactgggatcctcgtgggatcagcataatcagctgcagtacaggacacattgatgtctgtctgcacatccttccacctgtgttcctcgagcgtcctgagccagctatttccaagttcttgcctgagagcctctagttgccgtttgtagaaatctccgtctacactccagtctttaccctggagtgcacgctggaggccaagctgctggtcttgggtctgaagagcggatgagtcgcgtccaatctcagtcctttccgggatcttgggacttgcgggtctggcctgaggtccaccatcagatttccattgacggtcgggtgttgccgtgacaaacggatcaacaggtaattgcacaggctgaacagaaggaatagaaggcaccaccgcacctgaatcacgattaacatcagcggaaggcttatcttttgggcgatcggaaatcttccgccgtgtacccttcttccgacgagtagatccaacatcgactccattttggcccactcgtccgactggtccaatttgctcgtaaggcagcgaaggctcctgggggactgtgtgcaggggcttgctgaccacggtagaaagatctgccgcagcagatcgtatgacgggtgcagcctcgggttccgcagctcgctccaccagttgctttcgctcggtgtatcctggtcccgacccatcgatgatgatgtcctcggagtaacccggagtgcgtcggaacaagttgaaaatcacaacacggtagttcggatgtgttttcacaaaggggttgccagaaacccaaatctcccgtatctcagggagattggtgagtctagcaatctcagtaggatccgtaaggttgttgtctcggaggtccagccgttccaacgaaagcagcctctcaattcccgcgagagaacggagacggttcccacggaggttgagtgcggttatggcgggaagagggttccgcgataaggagtggagggattcgatcatgcaatgagagaggttcaaagctctcaaggcaaccagggatgcaagactgtcgggtacttcggtgaaaagattcgacgatagatcgagcgattgtagagtattggccactggggcaaggccggcggcagtgatggaggtcaaggagttgtcggggaggccaaggtgtcgcaagaaccgccacttgtgtgccggcaagacaccggagagtagattggaagagcttgcgctgcggtgacccgaggtttcgctggagttggaactacctgagccagtacgtcttattcgggaggcggttccacgaccatgacggtaagttgagtgtttcgagctggtgggacgtgtgggggaagtgcttccggtgcgtggtcgagctttggacccctctgatgccatcctgatcatcgaagctgcttgggggctagcgctggatccaaaggtgcatcagcaaccggcgacccgggagcagagagcgacccagacagctccgacttgttgactggctgggggtttgcattcccactccatcccatcatcggtgagtggtgatgctttgacgaacgccgccgacgtttgtcaatgtcatccagcacaatgcctgtgagcaattctgctgggtcctcgatattagccctcttgactgtcagcgtccgcaactgctcggacagcctatcccagccgaagaacgagcgaaagtctatatcaataatctctaacgcgctcaaattcttaaaggaatgcagtggaacggcggtgtcaaaagggaattcttcgtaaccacggatcaaccgggcacggcggtcaggggctaaacgcaggcagggaatcttggtaaaggcagagtataggtatttggtatccgcttctagagctgctttggccttctcggatttggaagccgagtccttggaaaccaaaccaaatgaagaccaaagtgaactcataccagacatgacgctacggacactggacacggagtggatagagtcccggtcacccctggatcgctgaggcttattcaggaatgacacataggactgcgatccatccgtgtggatattctccagcctaacattcaggggaccaacggcaatagaaagttcttcaaagcgggacaaaaggtaaaagaggtgatggggggtgagggtaagtttggcaggtttaacattctgcgaggtgaatttcagtgccccgaaggacagggccgctgcaagagtggaggaagccgagctcgacgagcccgactgggtatgggaggattgcgcatttttggttggttggcgctttaattgcagcgcatttgcaagggccttttcgtgtgtacgaacaaaactagcgagattctagacgaagaggttagagttagcaaacaagcaagcgtagcagactagaaaagagacagaagggcccaaatgaatgggcatgagggggcgcacgaacttttatgaagagctgtccatcttcagtgttcagcttctccattacggaaattgcttcgcccaacgagaacaaaactctatctggttaggcggactctgaagaggaacgctcaagtactcgtagtagggacggcgagagtcgacatcttgctggcaagacaaaaagcgaaagaaaaagacgacctgcaggataggagagcgagcaagaattagccgtgactcacaacaacaactcaaaattagatagctaagcccaaggcgctatgcctcgtaactattgtcaagaggaaggagacaaggctgggatgtacctcgaagatataggggggttgcacaataacgataaactaagcgtcgaacaaaatcacgaagccgcccaccacaactatgctagacacgaggaagagggagggatgggggagttggagacgaaagggacggtctccaatgtcagttgagaagagaagcctgtcaccgggacgaagctgagggaggaggaagaggcgagctgaagcaggagtgatcaccgaaaaaggagaagatgaatgggctggatagaaaaaagaaaaggaccgggggagctaatatgcaaagcaccacggaccttcgactagtggacgatacgtgacgggggggtggtttgtagtggaggattgagagggagggaggagtgggtatggatgagcaccggagcaatcagctgagggggggaggggcgtaggggggtgtggtaagtgtggtaagcccgggtcaagaagtaattgttgttggctgacaaggtatgccttcgaaattactgtcgggaagaagagggagggagggagggcagctcggtcagaagagaaaccaagagaaaccacaagatgatgcgacacagtctcgagataagtgcaggtgttttgttgggttgaacaaaaatatgtcagttctggtagagacggagggaaaggagggaagaggcaaaaaaaggacgggctggcgatactgggactaatataatttattatcatatagaaatcttcgcctgttatcatgtcctgctctccctttggtcagggagccgctgcaccgggcgtcgtccagaggtacatgcgtacttgcatacgtatcgtacggtacgctaagaccacggcgggtacgggaataccaccccatagtcaagtcaagtaaaaaaacaaaaagatgtaatcgacttgggtctttttgactttctattcgccttaattttgtccgcattgttgttttagccctttttttacatccatcaaatcatcgtggtatccatgaaccagtcggtggcgaccgtcgggaagggtccgttgttaaatccagttgttcgtcaactcagcttcgttcccttgtctaccgggtcctatcaagaaagaactgaaagcgcccagatacaattgataaatacggacccatacctcaaatgactggttagccttctccggaaactctatctagcggggtactctggattactcagttggacaaggccatgatgaattgataagcgatctctcaaaattttggcatttctcatagtaggagtagttcttatcgcgtttcccctctcagtaccaatggatatccaaaagttactttactgatatcagtcaacatcggtttcaggatggagcatacagtatcactgcaacggtcaaccaaggagtgccattcttcggctctggcgaagagtggagcaatctttccgaatccctcgaagcgggtatcccgatcgccgacccttggacttggctgatgcagtaacggaggactagtagtatgcaactacaacaataatagtaataataatgtttaagtaggaaaggaaaactcagtacgcacatacttttcgtttgaagggcggaaggatttctgggccaatctggaggtcgtagaacgcacacaccatgttgatcagattgtgccaagtaactaggaaacgtaagtaggctatactattttgttttcttttcttaattcttttttcccttgaccatttcgaagccactgcaagcccggctccagtatgctgcaggtcgggtgaaaagtttttttttgtttggttgtgtatgctggatggaggaaggaggggggggtaagaaacggaatgaagcgcagtgtttggttgaaccgggcggtgcttgaaggaggacccgcctcttgagcggatgcaactgtgccggcggtaactggacggacgatgtcaagtcgccccgtgattggcggtgggtccccaaacgtgcagctgatagcgccctggcggacattcatgtacttgccttttcgacaaatcacaggcgtttctccagcacctgcatgacgctttactcgagaagctctagaggatggatttttagcgacttcctcgagggccaaaaaggaagcaggaggacaccggcgagagccaaaataacatcacggacatttctagggggctttctaggatgttactaaaagtattccgaccgggatgaggcagctttagatacctactaatacttactaaaagttcgtacctgggactatacgtatataccagaaatgaccatacagtagcggcttcgagataattaaaaagaggaatcggacacatcgcaacttttggaaacttctcgccttgtccggatggagactcgccctgcatccatccattcctcccatccatccatccatccatcggtcattgcctgaaactcggaaagacgtctctctcttccgaggcagcagaacaattttatggagcaactgtcgtctatctatctacgtggttagttactcccttcagtaagactactaactatgacgattgattagacacttacttaacttttagtttagtattcattaacctaagtacctgggttagatatctcgcactgacctttaacattcttgagaggctcaagtggaggtctcagtctcatctttatgatcaactgaccaccacccattaccgtctactggatgatcgggtcatcggtcatcggccatggcgaagtgatcgctcgtcttgcttcttcgtagtccaacctctccccccagcgaatcatgctcccacattcctgagcttcgggaaacgctacgcgtacataaagctgctgggagcgatgatgtactgtgtggttatctcgattgcgaaacctaaacctccgtcgtgtcgcctacaggtccagttccagttccatttcaccatttcactgcttcccatccctccccccttcccgctgtcagtcacaccgcttaccgaccatggtccatcatcacaccacattctttcttccggtgcccacttcccatccctcctttgcaataacatcattcgatccatggttaccctgcccctctgctatctaggtgggtttcatcatttgccggcctcgtctatgcatccatacagaatgcccacgttcctgtgatctccgacaatatcgatcgcgacgaggggtaggtctttgaactctgttcgatgacgtccatggtagtggaccagatggtccgtgatcgttgccttaaactgatagccataaaaatttggcagacggtttccgtgccgtggaagagatttctccaatcccttccagtacacaacgccagttggtacgtatctccatgacagcggggggttggaaaaaaaaggaacctttcggtagcgagttcatgtttcatgataatacattcgcgacgcctccgttccttactttcgtcgcaaattactgttgagggtcgggaccttttattctcttggcttctggtgtctcgccccccgatcgatttagatgacaaggcaccatcattgcagtagcaggattacacacagatgcctacatggaaggaaacctccaggtgcgtcctagatcggacgttgtttatcctgccgcctatagatgaaaggagcggtattgccaatcagaaactttctttcctcggcgttgtgggcgaaggccgcatgcttcttcaatttgccatgcgctgggaaaacgcacgctaggagtggtgttccaggtcttgttcccttttttttttttcttttcctgatcgattatcatgcgaggagtactggaagtggctcatccttgtttacccgtatccctgcttgaatggtgtctcacatactggggttgaaccctgtcggcgacaacgttggttacagggcaaaacatccgagcaggctccgatgtaggaatgctaggctggggtgttgtttttttttttccttcgggaggcaaatagtgtgtcctggtgctgtagatggttggaatggagacccgggtttggtgtttattgcgggtctccaatgaatctcagcaatgggggagtgcacatgacctttatgacatctgatctgcccgctcgctggtggaggaatggagtcattgtttagtctgaatgatggagaccgttcctttcaaccattgattgactgatagtagagtagcaacgaaaacacaagaaagcccgggccgggagtggaaaaccgagtgtggatacggggtcactccagtgggatctgacgactcgaaaggcgggtctccactgcagtcaaccgctcgaatgatcagcagtcgttcgcgattgtcgtcgccaatcaaagccgacatcgctgtccattggcaaaaaaattgccttccccggtaacttttgtgtcctactatactagtgactaaccaactgcagggagagaacgccaaggctgtgggaggaagagagacagacagggaaatgaatagtgaccagggctgtctgtctgttccgtctctgcggactctccgtacttacgtaccgcactacatcctgtatgtatggtgcatacaggaccaaggaagtaaaaaacaccgaggcgcgatcttcatgcattagttgaaaaggtgggaagaaacacgggcgcagctggtggttgagttcagtgatggaatgatagtggaaaattaggattgaccctgatgcatcccaccacttcgggaaacctaagcattcaactaggttaatgatagatagaagacaaacggcagaggcttggttcatgaaccgtggacggtactcgctagagggatagtttgttgtggctaaggttcaacgttaaccggatcccagtgtccagggcggaaaagcggctaccgcgcaacgggagaaaaataataacattagaaacatcagttatctatgtctgctgcgttgccctgttcagctgaagaattccggtttcgtggtgaacaagatgcatgatgtataaaaggtgtggaagcaaacctgatgctgtctgctggacagaaggaacaagaacaatcgaacggaaaaagcaagttacctatggaggtgggtgagtttagtccgcatggcatgatgcgatcggaggatgagtgaatgtgatactaaaagcgagttggctaaattcagcatccaaacccaccactagtacgacaccagatcagcaacatgcaagaagaaccttccagtgctggctaaaccctatgagtctacaacattggcggggtactaaaagtatttacgactaggaaggtttagtccgtagcgccagccagtataatccgcagtatctgcaaatcattcgtttaactggattcctccagcctccgtatcagtcatagttggtggtgataaccaattatctaccacgacgcgcgctgtcccctttgaccaaccccagcattctcacagaccacccggtagaagtctccgattgttgttgaacacttggagagtcggtaaatttaccccgcaatgtctagttgcgaacgccatcgcatcaggaagtccgacaagggttgttctgcgaatagcactccaatcgaacccatgcttatagccatgcctcgtgccgcttgccacaccgatattttcatccagacgggcggcaatattgagattcaggcggctaatgtacgtaggactgtgcttttggaggggaggggcgacggtactctctccggctggtgggcaggcagaaacctatcatggagctacgggcgcgcagctgagcgactcagcttcgcaactctactgaccacctatgccacactcatcggtgacctgtttatatcgtagtcctgcgataggttgtgaggagcaatttcctgtgcctatctcaccccccaagtcatgccgacagtctgtttttgcttgccgatcccgcgtgttcatccagcgtgtgcgtgcgcgatacacattccaatgctccccagatttcagcggcagggcgtgctcatggcagacatcttatcacgtaatccggtgtttatacatatccgatgatcatagtcactcgggaagtgatttgcaggcttctttgtctgcaatgtcgatctatcaatcctacacgggccacccggacgaacaagacagatagatagacttcaatgaacgcgtactggaaagagggtgtgctggcacttcggtgattgcgtgtcccaagtgcatgtgtgagtacacagtacagaagacacggtggatgtatagctaagccgatgctttctgacataacaatatgatggagcagatattgcttcttacgcagtatggttcagcttcagccgaattctaggcctcaccgggtcgagcattaccgtattgcttattgcagtcacggatgtttgcgcaaagaaggctgagccctacatccctgggcaatagtatgccgccaatgaagtatgcaggctcttcgtctcgaccaccggtgaggctggaagcaagcaagtaagtaagcaagcaagcaagcaagcaccacgaggttgcttagagagaatgccgtcgggaactctccgccatgactatctcccagatgggactagtgtatatttcatccttgattcctgaggctagtccacatttgtaagcctggtcaaagtgcccagccccacagacccagccacacccactcgacgtcacgagacctaacaaagtaattagtggcaccagtgacttgaggcggtgtcagtcaactctctctgacgtcgatgtcttgtccagtgcgcgtcactgattctcgtcacaaggattatctttactcccaccccaccacacatatcccgacctctaacccaacatgcattattatcatcaatcatgaacggggcggaaaagtctgcagctggtgacacctacgatcccagtacgataccggattacgaccgagaattcatccatcccgatgacttgcgccaattcgagcttgccttgacggaccagggcgcgtcaccgctggttgccctcaacgactggcgccccatctaccaacgggtcaggcgcgaacgtgggcgccgcaaagagcctaggcggaccaaggatgagaccagagaaggtgtgctatacacagttctgaagtggccctttttgttcaccgtctttggttggatcacggccctcgcctttgcctacacactcacccgcgtttacatcttcctgtatgagcagtgggtaacatggcggggcagaagacaaagcctcagaaggcaattacacgcgcagaccaattaccccgactggcagaaagccgcacgagccctcgatgatcatctggggaatcagaggtggaaggagatcgacgaatacgcctactacgatcatcttacaataagcaacctagtgaaacagctgaagaaggtgaggcgggaggtggaacgtgaaaggcgtgagaaacgtcgcggctcaggccagtcgcctgcagctgaagaattatgcacgctactggaagcgtgtgtcaagaacaactttgctggagtggagaatccccgactctacagtgaggcttactccggtaccaaaaacttggtacaggaatacatcgatgagctgcatgcgtgcatacaactggtcgcagactcgaagggcatcactagcgaggagaaattacagcatttcaagcatttggacaccaacttcggacgaaccgccctttgcctgtctgggggcgctacattcgcttattaccactttggagtagtgcgagcgctactggataatggggttctgccggaaataatcacgggcacgtcaggaggagcgctggtcgctgcactggttgctaccaggaccgacgaggagttgaagcagctgctggtgcctgctctagcgcatcgcattagggcatgccaggagagcttcccgacttgggtatggcgatggtggcggacaggagcgcgatttgatactctggattgggcccgacaatgtagctggttctgcaggggctcaaccacatttcgggaggcatacgagcgaacagggcgcattctgaatgtatcttgtgtgccatctgaccctcactcgcctacaatcttggccaactacctaacttcacctaattgcgtaatatggagcgcagtgctcgcgtctgctgcagtccccggtatcttgaacccagtcgtcttgatgacgaagaaacgcgatgggacactggcgccgtactcgttcggacacaaatggaaggatggcagcttgcgcaccgacatccctatcaaagcgttaaacctccactttaacgtcaatttcaccatcgtttcacaggtagagaaccccttttattatacccaacactgagaacatcgaactaacaccacccctctcgactaggtaaacccacacatcaacctctttttcttcagctcccgaggcacagtaggccgaccagtcacgcaccgcaaaggccgcggctggcgcggaggcttcctcggctctgcgatagaacaatacatcaaactagacatgaacaaatggctccgagtcctgcggcaccttgaactcctcccgcggcccatgggccaagactggagcgagatctggctgcaaaagttcagcggtacggtaaccatctggcccaagaccattccctcggacttctaccacattctctcagaccccaacccggagcgcctcgcccgcatgctccgcgtgggccagcaaagcgcattccccaaactccaatttatcaaaaacagactaaagatcgaaatcgccgtcgtcaaaagcctacagaaattcgcgcacgccggcggcagaccgatctctccggcgccgtctcgctggcgccaaaataacgacccggataaccactacaatccaagcccccgcaccgatcccctgaacgaacgcctggaccacaaccttcccgaacgacgcggggacaacgttaacatcacattcggcgagggcggcggcagagaagatacgcatttactggacggatcgctgtcggagaattcatcgaacgaatctgccgcgcggccgtcttcttcgtcttcgtcttctcggctgctgcgggtcccggaacaccgtcggggtagtacggggagtagtatctttgaggaggtgaggcgacagtcggcggttttctttgatgatgtggatatgtacggcgatgatgaggcgcttaggcccggatgagagtttatatttcttatctctgcctgcctggtctagtatggtctggtcctttttgatgcgcttttttagcttgcttgctattgatccatcttctggcgtattaatctcttttagtttggtcctccttggaagacattagatcttgatactacttgtactttattattatacattactttcacttactagcaggtatgaaagggggtggtgccagtaatttcatcttcttagttgctcatgcatgtcagatagaggtatcaaggagcacagactgcttagtagtactaatatagattaactgaagtgttctgctgcattttccatctgcttgcttgatcatgatagcaaatctaagcgtgtcaggaaattaagagttgttttgaattaaaaaaactaatacatgtcccactcgatcactcaatatatgtcggcggtaatgtacacccccgctttcgtagagacaactatttcccccatctcagaactaagcatttttctcggtcccgatacaatcatgattccatatagtatacaccaactaacctcatgcaagctcttgaaaagcatacaaaacaacaattccagacacaaccatcatcccctaccgctccatccaaacccccgcctcaaacagcgccgacaacaaattactttatcaatcatcagacgcaaatgaaaagagattggagtccaaaaaagccgtattttaagaaccaagagggctcggcatagtccaccgtacatcccagtcgtagccggcaagatcctgctggccggtgggggagaatcgtggcattgcttccgtctctgttatctttattacagtcgctgctacgtgcacattaccccagcattacttcagataggttagaatttgtctgtgcaaccatctgcaactgcagccatggtagcaccgcgcatgcaataacacagcatgcttgggcagagggggttgcgtgcctgcagtttgccatcaatctctaatgtatatatgcgatcttgctctcaatatcttcgatatgaacggtcagagggacatttcaggtacatcaccgtaatgttaccccgatcgataacggagtataggaagtggcttttatcccagtaggctcgcatcaggccgttggcaagatcccgcggcaaaaacaaggaataacgccggctcttcatagcctgatgaagatgctttagtctctaactgtgcgtctgactctttgtatcagccggcgttgcgtcgatattcatcatcactcagggggaaaaaaagggaactccgtcatagcaggagcaagtggctgggttattcaaggaggtcagggatgatcactgagggactactggtagaaccgaagtactactactactactaggtatatcaccgttcagttcggaatgactgggtctggcggactaaaccctgtttggcaaagtattgtcctccgattctatgactgcattgattgtatatttctactggtaatcaagtagtgtatcttttgtggttttacgtgcagcgggaggatcaagtcatactagtatcaggtaggaagaaacggagcgactgactcgacaatcttggagacttagcttagtactaagcatgctgctatcaaagagtgaaaggtatataaattggcgttgctctgattctggcattcttcgaatgtaaagtactaaaagaagagaacactactgctataaaaagtatagacgcgtgttatataccacacgagactatatatgctagttgaacaagttgtaatgtgagaggatataactatgactatcatccattctaaggtgcgcaaagtgctccatataacaaacttggcttgtagatggaatttagtgtcgtatcactgacttcctcctcctcatctatcattaccccgtggaaaccaagcatctagatccactactttgactgcactacatcgcgccaattccaatccaatctatcttaggactatatgatactaaccatgcccactaataaatacctagtgattttatactctcaaaacagtatcgcagtattactagatacacgaggtagtgtatttcagacatactaagcgtaacaacaaaacttttcttcctattcacacgaaatcatgtaccggtaacttactactcgataaaaccagctggctgtttgcgccagaattcgccacgcagacattaccacacaaacaaacacaaaccccatgtttgctgccgacgatgatgttactctgcataaggcacacacatacatactatgcaatcatgtgtatggggtggcgccccccaccccgggacgagtacgcgccagtaattgatacacagtgttggggggcgtgatcaaatcgccgacagcgtgaatgataacaccagaaagggcagcttgggggatatagaagaagacggcggtcagggcgtagatggcgagcaacacaacaatggcggtgatacagccggccaagggagtacgaacacccgccttcgacttgatggcggtccgggaaaaggatccggtagcagggtacgcgcccaggaaaggaccaagaaggttggtcacaccaataccgaccaattcttgggacggctcgatggtatagttgttgacacggccgaatgacttggaaatggcgatgtgctcgataaggaggacgatgacgcaagcagggagctgactggcgaaaaccttgatgatcctggcgttgacaacaggaacagccgcattttggaaacctgaggggcacgaatattaagttagtttcctatcctcagagacagatatatcaggtatcaaacgcacctcttgggacactgcccagaagatcaaacatcgggttatccttgcggtgaaggttgacagctgcactgatcatggtgtagaacaggatgacaaagacagttcgcagcgtcgacgcgaagaaccacactttagcgtggcgagggtactttcgagcaccataattgcaacccgaacggataatgtacagcatggccaaggctgtgacaccaagggcagcatcaatacccgcagtaggaaggtacttcagcgagttgattatgatcatataggtcgagcctctggtggagaaatctgccgattctcccagcagcttcttgacttgaccggcagcgatgtttagagcggatcccgtcatgaatgccgaaattgcaggaaggggaatgaagtcaacgatgaagccgagccgaaggagaccgagggcacagacgatggcaccacagatgatagccaggcaagatgcaacgatatgccctgggacatccgggatctctttctgagcctgaagcacaatcgttccgaccagcgtggacattacagcgacgggctagaaggcatattgttagaaggtttgactcgaaagcggcaggtattagaagaggacacctaccccgatagtgatatccttggaagtggcaaagaaccaataaaccagtacacccatgaacgatgagtagagaccatactgcactggtagttcggcgagtttggcataggccattccctgagggacaacgacagcaccgacagtcacacctggtgaataaagtcagatcctttcgccacacatacacacagagcaccaggacccgatgtagcaacttaccagcaacaagatcaccgaagaaccattgcaggttatacttcgtgatccatgagaggaaggggaacagtctgtaaaagtacataaggacatcatgccaggttggacagatttctttgagccattcggcagtggtcggttccggctccaaataagagtatgtatcaacggtgccgtatgagaaggtcgattcgccacgagtgacggggtcggagtgagctccaaggggatcccgataaggcaatttgatacccaggactttggccaggccgtggccagtcttggtcatgaggtcttgcgacatggttgtcacgaaggcctcggatggaaggacgggactgattctagggcaagacggtgccccgagccacttggacagtggaaatttggcgttgacgaccggagctgctcaacgacaatgctcgagtgattgaaaaagagaattccagattcctccaaggtaatatatcttccaggggtgtatttaggcaagccccatggcaaggttgatggcaaacgatataaaagtggaggcggcaggtagtgtggttttaaaatgaatatccgaagccaagcgccgatgtcgtgatcgggagctatgaacgcgaaatatcaaaatgcccactcgaccctcttttcaacgtcaggatccaggctacacgagcaagatgaactcaaaaagatctatcagataaatatggaaatgatagaagcagatgaaagaacaaaagtccaagcaaagcacacgcggctttctgagttccgctaggaaatataatgtagatgtggcgcacggggaaaaatgtggtcgagcggaagatgagaccagcagatccgtcccacgcaagtgtttcaacaacacaaatagccacagaagcaaaaatgagaagaaggataataatgaacaagcagtgaaagtagttcgaggggagtcagtccagagagttttaaagtgattagacttgtcagaaggagtaaggtgacacgggtctccgtgggggagagcggacgtcgcaacgggagttgatgcaagccgatcaatgagtattctacgccaaaatggcattgacaacgacgaccatgatacgactattattaaccgggaagggagcatcagcaagaaacgcgcagtgatggggcagctgatccaccagggatcgtcaagggcaaaagcacgccgtctggaatattcacaggcccgtcgtcaacacgcagctaaggaaaaattccctagcctgcagggaggccaagctcgtcagagaaagctggcgtaagagcgccgtttaggtgggtttggccgggggtctggaagcgaaagatgacgatgagccgtggagccggtgcccgcccactggccggggcccatggtttgcgcattgcatatgagggagtgtgtatcaagtgtgcaagtcgagcatccgggacaggattaacctccggctggttcactgatttggtattcatcattatgataatatggttcactactcgaaaagagccgaacggatggagttctgtctcggtagtcgcaacccaccatgacgattgaaaaagggaatgtttctctccagaatggatccagttggaattgtccgacgttcgcagaggggaggagccaaaagggaaagtaagttggagtggactccatccgccatattgccaaggcacaccgcccaccggaattgggtcagcattagggtatgggccaatgagaatggtccctgactactggagagcagcatccgcggcgggcaggcggcgaccaatgggaatagtgcgagaacacgccatcgctccgactgatggtgaaagatggccggtccacgtgtgggcggcgcggtttcgtccaagtatcggctgggccgttctgttaggttccctcttcccatttccccccttgttgagaagatggaacttctccgtaacttcctggtccccctcctcgtttttccctctgtttgcctcctggactgacttgccgccaataatctccttttttttttttttttttttttctattttttcccactttatttccttagtaatctatctccgatgcccggatgacgagtacacatctcgtatcggcctggacttccagaatcggtttctttctggagagctacgatgtagatctggataaatgaattttcagggtcatcgaagatgactctacatactccatcctactcattgtaatccgatataaattaaatataatttccacatgtccatggcagcaatatgtctggaagtcacaaacctactcctacgcctgctaagcaagcggcagtagtacaagcgaacgggacagtcttgactacgtaccaccgtttatttactctgtaactgtggatgcaacagatggaatttgaatggacggacaagaccaagattgcctttcactttttccaacgagactttgccgacctggcttggcagcatcgtggtcttggaattgctgggaaccaaacttcctttcccatcagataaacatggaagcccgacaagacagcttacctgctgcttgctgatctacaatcccatagtctgtctcgcacggctcacccaaccccaaatggaaagagatattctgtctctaacaggtcatgttgacggcggcttcaggccgtatgcaccatcacttctgaaccttgttggcttttccattagcaactgcattggttctaaaaatcatccaacccaacgctgcatctataaaatttatgcgaccaggatgtctcctcggagcagctaccttccaaccaatcaaacagatcgtgctgaccagggagtgtctcagaaggattgcccggcttagctggtgcatatgtacctaaaaaatagctgcgagctaaggaggttccccagaattgcgccatcgatcttatcactacgtgatgcggctgtcgagggaaaccattggaagattaatttgatgtggtttgatgcatgccgacggagtatagacatcgaacgattcggtgagcagcacgtccttcggtccgaccgtgtccaaaatgaagagccacttttgtagattaatctctcattactctgactaaacagcgggatcctcttccgcaatagttgccttgtcccttggctgcgcggagatacctctccaactagtctactacacccctgcagctgcggcatctccgtgctatggacaattccatcgaacgatgagcccaaccattcacattcctaccttcgtgtgccgatacctccatttcctcgcagacctatcagcgcaaggacaaatcagacagaacgccgctgcaaatcctacctcctaaataacttaacatatgcgacgttctcgtggccgaacttgatcaacaaaaagtccggtctgctgacaagaattcacagcacatgcgaacattagagcctcctccatctagcggaaatgtgctcattatacatgaagttgatcgagtcgcctcataagaacaaccatagaaggagctaagtgagacatacggttctggcacagacccagactaactgccaacaacaatgatctgcaaaccttgatcctatccatcgaagtcatccatctaaagttcaataactgtcttgcgtgacagccgtcaactttagttcaaccatgtagccatctcccacataccccgctaccatgggttcgatagcttaacgtgcttaactgtccgtgtgactatattgcattcatctgaatcagttctaatattctcctctgatgtttggcgtctcactgcggagaaggtcacgagatacaactgacctgcaagtgctttgttgtctgggtccttgcagagcacatgaccgagcttgggtgtacccctccaatggagcgtaatactacgtttgagttaatctggcatctacaagtcatctaaccagcaacccgctgatatacgatactaaccggcatcatctacgtaaatcttcttgggtccaactttttatcatctgctcaacaataaccatgacagatgaaatggactgcgcagcttacacttttctcgactgcatcctgcacttgaaggattctgcagggttacagtgcagataggttactaccatgctgtgagagggtctagcaacatcagctgccgtatgatgcagcccgattctgaatttctgactcctggtatagcactacagcatcctattcaggtagcgcatggggagcgggggaggaagacctcgcttagacagatatactttgaattgaagttcacgggatcaaatattgaggacagctgaatcttatgcatagagtattcatcattaaagcaagcataacgcatgttgtagtgctctatgatgccatgacgagggtgaacatcgaagcattaggaacgatggtagagtatgtgcccatgagatagaatacatacccaccactgctccatcttgtccaggaatttcaccgtatagctagttcctcgctgtactaattacttctcttatattgatgttgaaagtaacggttgaaagaaaaggcactgcatagacgctagcaaaaccgaagcattccaataactcgttgacggctggcaggtatatacattcctcacgacgagtatattatctattcgcaaaaaaccaaaccttttactctattttccctgttcactcatcttcacccttcctcttccgaagatgccccaatccatatagcgagtcgttcagttccttgcgttgcttctcctctgtggttgctggaacttcttccgtgccggtggagttgatcttgtcggtcacggatgccgcggtcggctcccattccaagctatcagtgcctgacttgatgtggaatgcttcaattagggtggagggggaggaggggctggttctccattcttgagttgagtccggctggcggatagagtcgacggagacaaggatagtgttgtctttctcgacgggggtaagatcgaggacgttgccggaaagttggatggaggcttgcgttttcaagctgccgtcagattccagcgtgaagcattgcagacgggaggatctactccggttagaacatgtacttgggtaatgaataaatgggaggcgtaaagaagactcacccgtgaagcgcgacgaggatgatacgcaagttccccagcgatgtcgcccagataccttgcactgcaacctccgtagattctgatgcctcgtctaccaaagaaaccttctggaggattcggccttcagcccatttccaaacgagcaggtagttgtcacctccaccggatacgagatactggggtgcccactggggcacgcaaagcttgctgatgaatgctgtgtggcccaagcagtagttttcaatgacgtgggcctggggaggaccacgggagacacggatatgttcatctcggtccgcagtcaggatgtagctgcgctttttgttttcatccaccggaagggagacataagccatatccgtaagcagcgacacatggccaagcaagattttgtgttcaaaagtcgggccagaggacttctcatccctctttccttcactagctagacgcaattgttgttccaaagctcttcggttgcccttcgtgtgcacggtcaggtttgttgccgccgggtggctgagttttgcgctcctgagggattttgtgatcgcaggaagcttgtcacttggaatcagtggcaatgagtagacgtctccgaatttgtcaccacacaggatagtgtcgtcgtcatcagtgagggtaatggcggagggtcgcttgggcataactctgtataaagcatgagtttctgaatggtgtatcggagtaaatgaactgcggtttcactcacctctggctcaattgaacaaaggaaccatcttcctgaagctggaatacacgcacgcacttatcttcggcggtaagcgcaattatgtgctctccgctcgcagtgccagttactatggggatgtttgaccaagcaggcttctcaattgttggggaatctgatgaagaaaccttccgcttcttctctgggggtccctgctcgggagcggactctgcgtcaacaggcttggtttcactcgaagcgacatcttctggccaaaccgccagccgctggccagtttctgcggagtaggagtagagcttggagcccgctgaccctatcagcaggttcgcagttgacctctgcaccaagcggaggcattgcaagggatgttgaaagtgcgcagacatcttggaagaattcactgatagtgtaactcaaggatatatagaagcacgtagcaaggcctcttctccgccgtcgcagtagatcgccgtaaaaagtcgatgtcccgccgcaatcaaggccgcatctccgcgcgcctgaccgccttcctgactgagccggaggaaagtgggccacacgtgactggaaaacaagcgaggccacaactaagaatttcctaaaatcgacgcgaccttccgtacttttcgaacttcatcgtcacgattcagatcggacaaccacgaaagtcgaaacatttcacttgcccttaaacatcctatcttcagcgaattaaggagacatggggggcaagtctgctaccaaggccgcttacttcgagaagctcaaggcccttctcgatgagtacaagacggtcttcattgtcggtgtcgacaatgtcagctctcagcagatgcacgagattcgtctgagtctccgtggcgagggtgtcgtcctgatgggtaagaacaccatggtatgatgatcctctgaaaccaccggtgcccgttccgcatgctgatgagttgtccaggttcgccgtgccatcaagggcttcgtcaacgacaaccccgagtacgagcgtctgctccccttcgttaagggtaagtgaagttgcttccagagtctgcggcgatgtcaattggctaacatttgccttccgcacaggtaacgttggtttcatcttcaccaacggtgacctcaaggccaccaaggagaagatcctggccaaccgtgtcgctgctcccgctcgtgccggtgccatcgctcctggcgatgtctgggtccccgccggtaacaccggtatggaacccggtaagacctctttcttccaggctcttggtgtccccaccaagattgctcgtggtaccattgaaattaccaccgacctcaagctcgttgaggctggaagcaaggtcggtccctccgaggccaccctgctcaacatgctgaacatctctcccttcacctatggtatgaccatccagcaggtctacgaccagggtcagtgcttcagctctgctgtcctggacattgaggagtctcagctcctcgaggccttctccagcgccattaacaccatcaccaccatctccctggctgtcagctaccccactatccccgctgtcatgcactccctcgtcaacagctacaagaaggttcttgccgttgctgttgagaccgagtacagctggcccgagattgaggagctcaaggaccgtattgccaaccctgacgcttacgcctccgctgctcctgccgctgccgctgcccctgctgccggtggtgctcccgccgctgaggctcccaaggaggaagaggaggagtccgatgaggacatgggcttcggcctcttcgactaaacgtctcgtgtcaatgctgcacgggatacgactgccatgtattagatacttttcttgccggtcttgacgattgggtaaatgaaaatgattgtcatggtcatgaaacaatgatcttctttcatctagatagggacgtagtcgcgttccctgatctgatgaactgaaaaaggtgagcttcaatcatttggttttccttgcttcgcatacatgcccactccccggtgatatgatgatacatttttaacccagagctacttgctttgacgaacaaaaacagcaacaacaaacactctaattttttgctgacaccattccattcaacttgccatttgtcacgcattactttcaatggtctgatagctaacagctttcaggttcacagattcaatgtagccccggacgtaaggccgtcgcgctgttcattacctcagaggcttgtcctggggtttgtgttcaagtagcgactagaagagcgtagtacttgaggctgttgtttgttgcgaaggatttgtggggcattgtattggtcgtcgctgtcgggacgcgagggaggaatattctcggtacttaatagcacatacatgtcaataaaatcaacatcgcattgcctcatagttattctcgagctgcgtaaattatgccatcttaatcgaagtagagtaagcagatgttccagacttgcgaacggcttgaagcttacctgagccacggacgaccagtcgagttccggcccgaggccgcgaacggtggcaggacttgcatgtcgaaggcccctcctccgcaaggtcccctccatcactcacacatcccacatcaaaatgcagcatcaattcgagccattgaagaacgacctcttgctgagggctgctaggggtaattctgattttaaaccattatattcaaagagatgggactgatatcattgcaggcgagaaagtccagcgtcctccgatatgggttatgcggcaaggtacgcctctctctacaaactactctcttcgcactcttacgagtcccggatccaagtatgtctctcttataactgaccacattgtgcttcttatatagctggccgttatctccccgaataccatgaagccaaagccggccgcgactttttcgaatgctgccgcgaccccgaagtcgcatcgacgttgacgatccagcccatcgaccgctacgccggactcatcgatgctgcgatcatcttctccgatattctggtcattccccaggccatgggaatgcaggttgagatggtcgacaagaagggaccccacttccccgagccgctccagtcgcccgatgatggacagtacgagaaagtgatgcagaaggatgtggatgtcaagtcggagctcgactacgtctacaaggccattaccctcacccgccacaagctgcagggtcgtgtgccgttgatcggcttttgcggtgccccgtggactctgctgtgctacatggtagagggaggcggcacgaaactgttcgtccagtcgaagaagtggatctacaagtaccccaaggagtcgcaggctctcctgcagaagatcgccgagatctgtgttgaatacctggcgcttcaggttgctgctggtgctcagctggtacaggtcttcgattcctgggcgggtgagctgtctccggccgctttcaagtcattctctcttccctacctgcgtcacatttcggcgaatctgccgaagaagttgaaggagatgggtctggagcctgttccgatgacagtcttcgcgaagggtgcgtggtttggtcttgaggatctctgcgagtcgggctacaatgttgttggcttggactggctgcacgaccccgctgaggctaggcggattgccaatggtcgtgtgacgatccagggtaatgctgaccctggtgttctctatggaggacgcgaggctatcacggaggctgtggagactatggttcggggattcgagaagggcaagcaaggctggattgccaacttgggtcacggtgagcactgccacagctgggttattcaataaatgctaatgtatcacaggtgtgactcctttcgtcaacccggatgatctcaagttcttcttcgaagagatccaccgtctgacggtctaaattgggtgctcaatgcgaccagaactagctttcaattctttattatgtacatgagagcctagccagcaatatagttgacaccttcacgaattcaaaagctcagacggaaatgtcctcattcctgcaaagacatcgtacagtcagcgtacattccaacaaaagactagaccagtccagtgagatgcatgggaaacctaccaaagctccggcttctccttcatgaacttctccatcagctgcttacactctgcattatccaaaaccacaacctccttcccacggctcttaagatagtcctcgccacccatgaagctcttgttctcgcccacaacaacgcgcttaaccttgtagaggatgcaggcaccggtgcacatgtcgcatggcgacagggtcgtgtacatagtagcgccttcgtaggccgaagcgggcagacgaccggagttctcgagcgcggacatctcagcctatgacggtagagattagaattagaaccccagacgaccctcagaaggcaagggatgggatcaacgaacatgcaacacgggactacccttctggacgcgcatattgtggccgcggcctagaatcttgccatccttggagaccaaacaagctccaatgggcacaccaccctcagcagcgccttgcttggcttcttccacagcagcgatgaatccgggatcggtctccatgatggtatgtgcttgttgtatgctgtattgagatatgaaatatagagcgattggaggggtaattgggagagagatagaaagatggggtagcatcaagacggagcaaactctgtgtggttaactgccggactgacccgcatcgggctggacgtgcggagctccatgataacaagatagctgctgtcattgagactgatagaggacgttgttacattcgtattgaatagtattttcatggataatgtgtgcatgtgatagactttcttgggttatggtatgcataaagtgcttctttggtgtgcttggggatcgacatgcataagcgtaagaaagatgcttaatatttcatgccttgtatacaactataactgaatacaaattgagctgattgtatatgagacatccgatctagatgcatagagcccgatggtaacgtccttatcacttgtaaccattaattcacagtttcacaatttacaagatcaaactggcagtggctgataaactcggggttcatctcgcgcagaccccatgccacgcactatttactagtatatcttcttatcgcagagattgttctctgaacctctgatccacgatcatggcaagaaccacagaagccaatttctgtctggtactccggaattgaaccattaattgcctctgcagcagcagaagaacagtagagtacaccaggcatgagccagttgaaccgaagccagccggcaattggggatcgcgacgaatctccaggtggggaatcccgacaggcttttttcttcccctccttccgcatcgagctaatcgcctctccttatcgataagccggcaatcaaccaccgcccgccacaattccaagtgcctgaggcaaatggcgctgtgtgccaggaagaaaagaatctgacttgggagacaaaggcagatccgggcggctacatcaaactttaattttacagtttccttattttctttttctttttttgtgcttggagtttccgggtgtaatatactgggtaggtattttatacatgtaagatgatgagtagtgatggtggatggagggatgctacacaatacaccgcagtaagtagtagtacttagtagtagtagtatgaagacgaggatccccgtgaatggtgtatgattggaccgtaatacccaggtagaccttgccgcatcctaccgaggcatgaaagaactagcttacttaggaccacccctccctactgtagtatcgaacaagatagaaaagtcccggtgatacatttggtcagacatccagaaatgggatgcaaccaacgctctccgtggtcacgaaccggtaattaccagggcgattgtcagcgatggaaagggtgcgaaagcggtggaaggacacggaatcgcatcgaagcagtcggaagccacgctcgggccatcaaggctgcgggtgacggggcttgtcgaagcaaagagaacaactccattcagcctgagacgttgtcatcgtggacatgccaatttgttcaaaagcatacgacgatctctcctttcatgttaagatctgatcttttcagaaccactatccacctttttctatataattccagttccagccagttgaagcgcggtcgctcatcttctccagcatttctatactcccggagtttcgccccatcgtatctccggtatttgatacgcccatcttgaaactcttggcgagtcttcactgcgctcgtgcggcaaatcaaaggtcgattggtgcctggtcctggtaatcagattacacatacgataccctctcacttgtctcagccgccgccctgtcgccgctttctctcttctctctctcgctctcctggctttgattatcacccggacggaccctctctctctccaactcttccttcttccttccacctcttacttgtcccccctcacgccttcgagactcctctcccctcgtctcctcaaactcctccctctttttcaaggatttctctacactccttggtttcgagccctctttgtttcgcctgttccataccccggtgtaaggttttctaggatcggattgccccgtctcgtccctccgaaaagttcttgtttcttctatattttccctcggcttctccccgtcgcccaactttcgcctttcgatttttttctctcttctagacacagatcacaatggtcaaggaaactaagttctacgacatcctgggggtatgttctgggttttcgccaagtttggctggttttgcacgtcacagaaactaacggtgaggcggttaggttcccccgacggcctctgaggcccaactcaagactgcctacaagaagggtgccctgaagtaccaccctggtaagtcaacttgaatcgcgaaagcggtgcttttcacgaaagatctaggggtctttactaacgcgatatctttacagacaagaacacaaacaaccccgaagccgctgagaagttcaaggaattgtctgccgcttacgagaccctctccgatccccagaagcgtagcctctacgaccagctcggtgaggagggtcttgagcatggcggtgctggcggtggcatgggcgccgaggacctctttgctcagttcttcggcggcggcggtggtttcggtggcatgttcggtggtggcatgcgtgaccagggccccaagaaggctcgtaccatccaccacgttcacaaggtcaacctcgaggatatctaccgcggtaaggtctcgaagctggctctgcagaagtcagtcatttgcccgggttgtgatggtcgcggtggtaaggagggtgctgtcaagtcgtgtaccggctgcaatggttccggtatgaagaccatgatgcgccagatgggtcccatgatccagcgcttccagacggtttgccccgactgcaatggtgagggcgagatcatccgtgagaaggaccgctgcaagcgctgtaacggcaagaagaccaccgtggagcgcaaggttctccacgtccacgttgaccgtggtgtgaagaacggccacaagattgaattccgcggcgagggtgaccagatgcctggtgttctgcccggcgacgttgttttcgagattgagcagaagccccacccccgcttccagcgcaaggacgacgacctcttctaccaggccgagatcgacctgctcactgctcttggcggtggtaccatcaacattgagcaccttgatgaccggtggttgaccgtgaccgtcgctccgggcgaggtcatcactcctggtatgtgcttcccccttccagcctcgacttcagcgcatcagtctaacgttatctctgcaggtgctatcaaggttatcaagggtcagggtatgccttcctaccgccaccacgacttcggcaacctctacatccaattcgatgtcaagttccccgagaaggatcagctcaagaacctcgagttgctcgagcaggtcctgcctcctcgtatggagcagtcccagcccccgcaggacgccatgatcgaggactttgagctggaggacattgatggcagcgagtcgtctcaggctcgcgcacacggtgccgccagcgccatggacgaggatgacgaggatgttcctcctggcgctgagcgtgtgcagtgcgcatcgcagtaaacggggggtttagatgaggagtgatgatgttgtgctggggcttgatgaaattcgcttatgataccatgtgaggggtttcggccccggtactgctcggttctgttatgttcgcgcgatgacttatttctgcgatggcgtttgcactaagattcgggagatgaaatggagattcctttttcgttggatgcgttttccaccatcatcatcctcatcacgcagtggttacccatactataatgttctcttttcctttttctgtcattgggaatgggggcttctgggacttgatgagtgatgagacgatgttatatgagtcagcttctttttccctttcttgactccgggaaaacatgtcggagggttgagcgtttcttagtttatagactacacagcacggcttgggtatatcatgcttctgggttcagacctccgtgtagcgatatagagtaatcttgagaccaatggctatacaccccctatgccaacatctaactacctcatggtatccgtaaataaattgcgatattcaaactacctccctcgcttcgccatgcaatcgttcatacacgacaccaaggcaaaaatgaaaaaatgaaaacaaaaccaaaaataaaaaatacctccacacacaacactcaaaatctaccaaacaatacacaccagcatagtattttatttacctgccccatctcggcccgcataaccaccacccccactacccctccaccacgaaaattcttcaaatcaaaagaagaaaaaagaactgtcctcagggaggttcgaactcccggccttgggatatccaggaaatgtatgtttcctagtcatattcaatgattgatatgagacccacgtgataaccaactacaccatgaagacagaggttatgtcagccggtcgaagaattcggtatatgtcctcagatcgtgggtagggaggagttacattggacgggtagttactacttaacttgggttgttttgggtagggataacttacgatttagctggcttgctagatacttagttaataagggtataggaaggagccgaaagcggctggatatgagtacattactatgtatatagtggtgtattgataggattgtgggcgttattcgtactagggttcattatcaagtttgagttgatgctagaagtaagactcggggttttggtaattttctatgaaatgagtggtggtaatgggtagaagtaaccagaaaatgggctttcggcctcaaacggtggtcttgatgtatgatattagaatagagctacgaagcgaatgggtaatatagatacaaaacgatggtcaaatacacatgatatatgctattcgctaagaagggtgtaaaatatacataaaaagtagtatcaattgccatcatcaccactccgtccaaacctgcctccaaacccaccgagatcacgacggaagaatttcccaatattcttcagattctcgttcaggttcccagcggcggtcgtgctttccccgccttggggttgtgcctgtcctaacggcccaggggtagaggccgggctggtcaaggcgccggatatggcgctgccacctggggtcaggttggtcgtgttggctgagctcatcggcgtcccgaatcgatctacaccgtctttggcggcggagatgatggcggacccaagcatggtagggtcgaagcgggtggaggcgccaatggatgctgcggccgtgccgaggccgagaccctgcgagacggtgccggatgaaggtgttgcggaggcctgcatggcggtcaggatagggttgctctgctggaggtttgctgcatagcgatcagatgcgcggtggatttggaaaagttctatgaggtggttctggtcctggcgactgcgaatgcccttaaggtcgaggattttgcggaaattggcgttgttttggtctgcgatgtggaccagataggcctggacaagggcctcgggaggagacggttgaacttggagggtcttgaggagggcttcaatcttcgcaaagctggcgttgacgcgctttacgaaacccgctggcgcggggctggggaggagcgacgagaggccagtcttgagggtgtaggcatccagaagcatctaataacatctgttagtttcaatgaatgtcacgatgtcagctatgacagtgagcccacctgctctgcaccggtctccgcaaccggcttgcattggaagatagtcgcaatgaatacgttcgatatcagctccacaacatggtctgcgaatgcacgggcatactgctgcttatgcagcagctgcaacagttcagagcatcttgtctgtgtcttggacatcagctcgccgacataggagctttgatcgcttacgccctccagccggttccagggtgtgttgcgcatttcccgccagcagggctccaggtcaatctcgaccttacgaaccagccctcgaacagctgcagatgcaatgcccatgaatgagtccgcttgactttgtaggtccaccgactgtttgagatttttgtccagcctacccttgatcttttcctctaactggttgcaggtcgtatagcaatagtccgcggtgttgagcactaggataaggtcctcggtacctggcacctttgagggagtgtgacctgtaggccgttcactaatgtaataaagcaggacctgtgcatactgatcgagatacttcgcgaataccttagccagctccgcaaggctggcgccagtagatagcttcgcgcattgctgcaacgagtgccgatagaacgtgaaaagatcggtggaagaggatataacgatgtgcgagtcgaattcttcatccggtggcttcgcgggttgttgccggtatttagggataagcgcagccagctgcttgtcctgggcttctacccagacgctcaggtagggctcgaacgcctctgagatggcttgaccgaagactggtgcctcactcgaggcgaacgtatccgttgaaggccgggatggactgacaaaccgccgctcgagagaatgctcaaagtccaatgtttcttgtagacaagacagtagcagattaacatcgatggtctggccattgcgcaccgatcgagagagaatgcccttgaagtcctctcgcgtgccctcgcagaaaatgttcgccagaatctcgttgaccctccaggatgcgggaaagatgggcgcatattcctcatcgtagttcttcaagatccgcctaaaccaggcataccgccgcgagatgttgtccagtgaaccggcctcttcgttgttcctgaaaacctgacgatattcacgtagctggaagttgcaataccaagtcaccaacctggacttcgcgtgatcacctagcgcatccatgaccaagcagccctccgagagcacgtgcctcttttggccaacttcccctttcgcgaacgccaactcgaagtcctcgcagacctgctccagaagctcccgttgtatatccgcaacgtttcgactaagcagcgcaatctgatcgatcgagcgatacgacttgaaatgcgccatcagctgtatgaccgcctgtagcagctgagcacagtcgcggtactgccgcgtccggcccagagaacgtaattggtcgtaggctgtcgttagcatctgcagtctcttcaggaccgtcatcgacagcgtgaggttcttcttcgcattatccagctgtttgatatccgccgtcatctccgtaatggccagctccgtcctggacgcgcggtcgcgcacatcgtcaatcttcttgaacagttcggtcaagtcggccttggcggcctggatgcgctcgacgctctccgcattggaagtgacctggtcctctaccagtgcgccgatatcgttgtcgagctcgtcctcatattcgcggagggactgggacacctgggacaccgacgacaatgtggaggggtgggaaaagattgcgttcaaatggtcgatcggatcatagtccgctgtgacattgggtctattagcaagctccccgatgggataggttgtcaatggcagccctcacctgcatccaaaggatcgagggggacctctccgttggagggcatttggccgggggtggtggtggtagtagtggcggacattccattagctcctgagcgtcaacgccagacacatgctgcaatgccagctaaggggcatccgccaattcaacatgtaaacatagacccaagagcaagggctgccaaaggagcgaaaagaacctgaaaatgacaagctgtaaggaccgcggggaggttgttgacgccggagccgcaggtcgggaagttggcgacaactcagtccggctccgtcaatcagtcagtcacgggcagctcttagtcttagcgctttgcccgcgccgccgggcctcgtcatcgcctcttgtttgttcgtcggaaccaggacaggcgcaagataatcctacgattttataaaagccaagtctacaagctactcagacagatagatggataggtcaagtggtatcaatttggaggccattcctccccctagaatcgaccctaggtttctgttatgattaaaccaccccttgtactgcaggtctcgtctatatggacatgaaaatggtcgtagtcttttagtgtacaacgaaagaaaattaaagcaattgtaacgagctccgaagccattcgcccaagccatgcatcagcaaatcacaaataaagagacagttgactccgatcaaacaccaccaggaacctcccgacgagagtcggggatgcgaagaccagacaagtctgggagagagtcgctcgagaagttgttccccgtccatttggtatatcttcttatttttatttttatttttcttttgttcttttcgtatttggccctgtcctccttggtcaaactacactgctgcgggtagaaaagcctccggaggcaatgttccctgcgcctgcaaaagcttgttagcgcatgatcgtagacggagaatacacttcgaacttaccttaagttcctcaaagttcttcagtgcagcctccatattccagccgtttccagacaaagccatctcagagtactggagggtcattcgagtattagagctcatctgaagtactagctgctcttgctggacttgtgcgtctgcttttccaggcgctggcatgccgtagccttcgggagcacccggaatggctactggtagtgccgcaggggctgcaggggctgcgggtgctggtgctggtgcagctggaggtgcagcttggggtacggctggtggaacctcaggaatccatgcctcgtgtccaccataggctcgcaagcagagaatatcactgacgaccctgattccgcccataccaccaccgggcccgatgatgaatgtcctatcgaaactgcgagtttcaaccttggccccattaatctcgtcgaacttcccgtgcaccatgatgagaagtccaccaacacccgtggagctctgcccggaaatatcaggaagacccgggatagggtagcactcgataagccattcttccgggcgcgtcgcaatgtcaggatgtctagtcgcgggaagactagtccacaactcgcggattttctccgcaccggtgtataccctagacatgcgtgcaggaagatggctgatcttgagaaggtttctgcttttcttgatatacgcatcccagggcgctgtttctgtttgttgggccctgggagccgatgtattcacattgagagtgaacgtcgtgtggttgtcgtagacactgttgagaatgccgcttcggtcgttgtcgtagcccgcgaagaaagccctaacaaagttctctgcgatctgagagtcgtcctggaagtgcggtggttgcacaggaatcggcgtcttcttctgcgccgctatttcttctgcggtacggacttcgacattgttcaggaaccggagcttgggataccacttcaacatggtatccttgaaagtagggtcggcgctgaacggagtgtttgagagatcgagaaactcgagattgcggaatttccagcgccatccaatcaaggattgcgcatctttgaattcattgttggaaagatccagatttttcaggtctggaattgtcgatgctagtgccgtcacagctgtgatgttggcaagctgattatgagcgagactgacactctccactgcctctcgacgcgcagtggcattgtcgaaattcagctcccaaaccttcatcagtgccgggaagaatttcgactcggtggatgtgctgccaaagattcccatagccaagagatccggatcggttcccaatttcgaaagatcgagtaattttgtctgctgggtgtagcgcttgccgagaattgtcgtcattttcgccttggtctcggcagcagaggatgtgccgccattttgtgccatagcagacagcataggctggtccagcaacccaccagtagacgggtcatacttttcggtggtaagaggggcacctgcaaaactaaacccattgagctgaagcatcctttccaacaactctggccgaatagagacgataagagcgtcgccttcaacccgcgactaatgaacgttagtaaggcataagggaccttgcgagccgcgccattcatccaaaagaacaaacgccaggagagactaagaaagtgccgatcgtcgttctgaacgcaccacccctgcaaacgagagcacatcggagaggacgaagctgataattgatgtcggtgaccgccagttctggtgttgcacatacctttgtaatccttgcgcgtgtgccagctttcgagtcgggtgggctgagttttttctcgaggaaggcgatgagggattcgagaccgccgtcgcggttagatgctgccttgctttgtttccagccacgaacaataacctgttccagaccacttccccgtcctccttgtcggatgttcgcttgagtgtctgagttgctggagatggccttctggatcgcatccatggctttgttcgctgcctgcgaccggccagaatcgccacgaaccttctttccacggtttcgtgcagagccagcatccatcatcagatcaccttctcggtcgacccgggtcgtagcaccccgcttgcggatgcccccacgatccgaaccccccgagcgaccgcgagatccttttccgcccttcatgctgatagaggcgagattttttttcgtagtaaggtttcgtaagaagacagagggcgaaggagagaatggtagaagttgagtgttgtggaggcgaaacgagcgctgctcgcctttagtagttcgagatcggatcaataaaacatacaacgatcgattcgaagaggtttcgtaggaaggaataggaagaaggagtgtaagcgagagagatactcgatgcgataatcgagaaatcgagaacggtcccagttaagcaactgcgaacctcgatgtggaggaggagtgttatgagagggaaggaagagaagcaagaagatggagtcagcgcagaaaaagtgacgttgaaccaccaaaagcagtgcccgcgaagctgtgcatagtcacgtgggcggccaagcgcaggcccaccacgtgattgtgcaccaggcaccgggcgattggccaatcagaggctgtagtctgtcctttggcacgggcggtaatacacaataccgatgcaccaaagtgggcagagacaattacgcggctagtcccgatctggtagtggcatccatcggaggagtggctgtttctccgcttcattaacaggacagctggagcttccatcggcctgtttccccaaggactgtctgcttgttgatcgtcctaagtcgtgcgcaaatcgcgacttcccgtccttgttcattctctcaatccgacttggtccgcgtatgtttgccctcgtcttcattcttccctatccattgatccttcctcgaactattcagcttacatacggttctctccaacaggcttcattcccgcgggcactagctggtctttagtcggaccaacgatcctttgtctatatccccaaacactccttcgtattcatgtcgatcaattagagaaatgccggcgaaatcgcgattcacaaggctagatgcctttgctaaaacagtggaggatgcgcgcgtccgtaccacatccggaggtgtcatcaccatagcctcgttgctggtcatcctgtggcttgtgtggggtgaatgggcggattacaggcgggtggttgttatgcccgaattggtggttgataaatcaagaggtaagaatggcttagcgattgctggacggccaggcacgactcgatggctaatgaacccttcgtacaggcgagaagatggagattcacctaaacgtgaccttccctcgtcttccctgtgagctcctgactctggacgttatggatgtctctggcgagcaacagaccggtgttgtccacggtatcaacaaggtgcgccttacttctgccgcagaaggaggccgcgtcatcgacgtcaaggccctggagctgtaagttgcaatctcaatccgctcttgtcaatgccaattgcaccgctaacgctgaatcccctagtcactccaaggatgagagtgccaagcacctcgaccccgattactgtggtgaatgttacggcgcgactgctcccgccggtgcaagcaaacctggatgctgcaacacctgcgacgaagttcgtgaggcctacgcacagcagcaatgggcattcggaaagggcgaaaacgttgagcagtgtgagcttgagggctacgcggagcgcatcgatgcgcaacgccgcgagggctgccgccttgagggtgtcctccgtgtgaacaaggtggtcggcaacttccacattgctccgggtcgcagtttcaccagcggaaacatgcacgtccatgacctcgcgaacttcttcgacgccgatctacctgatgctgagaaacacaccatgactcacgagatccaccagctgcggttcggacctcagcttcctgacgagctctctgatcgctggcaatggactgaccaccaccacaccaaccctctggacggtaccaagcaggagacaaacgagcccggatacaactacatgtacttcgtgaaggtggtgtcgacctcttacctccccctgggctgggatccgctgttctcgtcctccatccactccgcttacgaccaggcccctcttggctcccatggcattgcctacggtgcggagggcagcatcgaaacccaccaatactctgtgacctcgcacaagcgctcgctgatgggcggagacgcctccgacgagggccacaaggagcgtctgcacgctgccaacggcattccaggcgtcttcgtcaactacgacatctcccccatgaaagtcatcaaccgcgaggcccgtcccaagaccttcactggtttcttgactggggtgtgcgccatcatcggtggtaccctgaccgtcgcggcagccctagaccgtggtctctacgagggtgtcagtaggatgaagaagctccactcgaactgagcgtagagcaagcaaatacccgaaaaaaaaatagtgaaacagaacaaataaaaccacaacccgctaaacacaaaagaaaatacaaagaaagaaaacaaacagacagaacccatggagagcgttgtatggagtacagggaaagaagacagacagacagacaggggacgaaagggcaagaaaggacggatgaaagggagaactccggaagttcaggcgttacatttttcagtcacctacattgattgcattttttgacccattttatttttggtcgggggaaaactcattgatacaccttttcatctacatcattggatttttggtttacttggtgtttcaataagccatagcacgtataacagcacgcgagatctagccattgcatgggtactacctacctacagacagtgtattggttgatttaattgattgataagttgctactaagtatgctggtccttggaaaacgccactgcactaagtagtactacttagctctagctattgttggatttgattggttctgattaactactagtacgacttagtaaccattgtgccctaagaacattgttattcaagtcttggaaggaagatcaaaggaactatattttacgttcattggtcggatcaaactcttttaacctatggtttcttttaatttatcattggacatctgcttgagaaagaaagaaaaattcttaacttgagcatgagatatggccacccaatgccaggagtgcaatggcactctttggaaagcgataaatacaacctaactatgccatgctcgcaagagaaggaacgttcccgaacatactccgtagacccaatgaaaatgatcgctttcacccaaccaagtccaagatatagagcaggtagcctttcaggtgtggaaacgtctaattctaatatgtagagaaagctcacggggctaatgcaagtgaagtaaagcaaagaagggattagatcatgaaattacgccaaagagagtaaaatgcgataggatagacaataggagatgagatcagaaggaggggctgaaagtaaccggctcagtaatgcagggtgctggcattgccagagtagccgggatgttggccataaggcgggttttgctggtagattggaggagtctgcgcctgctgtgatgcgaactgtccgtaccaagactggcgtcggggctcgtctggccggtaaggctggttgagggcatcccacgtgcggttcgcagtgggcatattgtagagactataatggctgccctgattgtaggcagctgcggaagcattggaagccatctgctgttgttgccaattttgctggcgttgcacaattgcatgctgtaccatttggttggacaggccttctcggatggtctttttctcgcgctcacgagcatcaatcgctcccaccagacccatagggtttaccggagtcggctgggctttgttgacgttggatatgtcgagtagaggtgcaccggtcatacgagccacatgttcctgttcacgagctgagaggtgtgacgacagttcattatagttcatgatgctgttggcgccgcgggaacgtgggcgaggcggtgcatctcggctgccagacaagtgtgactgaggccgagagttattcgtccagtccccggaaacaggccgagggggcggcggtgtagaggaaagggttcggttatgcgtggcgattgggggacttggggctgatcgttgttgcacgaattgctccgctgtaagcctgcctggagtggtgggacggggtgcagtcatacccggctgccacatcacgttgctacttggagatcttgagtgctgtcgctctgcctggtaagagaactgcttttctgttgcatttgagtcgctcctttggtgcatggatttcttcaaagtatcgcccgtattgggacgtccagttgtaggtagataagttaaggtcggcccgaagtcgatgctggggatttcggcactgagttccagttttggttcatcaacggtgtaatgcgcatcgccgatgaccaagtcttgtctcgggggacccgatcccacggttttcatgactcccattctgggcctagtgactgacctaaccgagcgcttgctgtagacagacccccgagtactggcataatctggagaatttgcagacgcgtcatcatagatgctttcctcatcctgatggctctctatatcaggcgaagtgagcgaaaattggcgagagccgacccaattcaggacctcttcatcaacagtatgacgtaggtcatcgtagctaggctcccctgcaacacttgcggcatcggattctcggatctgttgcgcaggcagaggcttccgtttcacggccttggttgtatccaaacgaagactcgatctcttcggcaaagtgagcggtgggccgaagtcactcgaacgatcctcaggggttggtgggccttgttcctgaagggtaactctcttctcgcttgtatctgataagagcgatggcgcaccctgttgatcagagccagtgttaggtgttagcggactaggctggttggattccctgatcgtttcatggctgcctgaagggaaagaagcgccaagtagattcatgcttccagaggcagcgagaagctgtgtcagggtagcgtcagacatcctattatttgcttttctcaaatccggtgaaggctgaggtcgcattgcgggcatttctcccggtgcgtgtgtgaaggctggcggctggattacgggagatggaggagaggttgaacggaagtgatgtccaagcggctcatcgtcggggtcaagtcgctggttcctgtcgctcccggtgcttctatgatcgtctaccccgctagtaccagggcgttcgctgccacgtgccacaagttcctgagcggaggatgctggggacacttcggcggcttgcgcttgtctcctgatggaagcaaatccggcagtgtccgaagaggccctgctatgatgaattggagagatggaagcatcacggggggcaccaggcgcgacagcgtcgttggactggttggaatccagctggttaactggggaagtgcagttgcgttgatgcgtcatggtgcggccgttgggttgtctgttcggcattgtagccctgaagcgtggcttactcgcagagatactgctcgtcctgcttccagcagccgccatgcgacgcgctgtagcctccttgagttgctgtctccattccgcctcgttccaatcctgacttcctggtgtctgcattagactagagatgtctaaaatatcaagatagccatagcgcctttgattggggaaggcaaacataatgctcttgatatggttggtggcggcaataaggcgggtgggccgcccataaaggttgaacgtgtcaaaagtagggacgagaaaccggagcatcatttcaaacccagaaaccgcaggatggacttcgggcatgacaaagacaaacccgtctgttgtcgactctgtttgtccgtggaccgtaatctttccttcaatcttgaccaaggtcgactgttcgatcaacgccctcgactgaggatagatggcgtaagcggcgtaagcatcagtgatggtcgcaataggcttcgctttcttagtcttcttcgtatcatagaatttgatgtcgccagttatgagtcggggcgctcgatcgtatgccgacttcttctttattgatttctgcgctttctggaattccttctcgttcgggggagtaatcacaaaccagcaccgtctccagggcgtgcctgccccaaacctcacgcgggcccaatcctcgtgtttgtaacggtggcgatccaagatggttctaatactgttgagacctttacctttgcccgcaatgatcgaacccgtatatgcctcatataaggatgtatgttcgaacaaggccagtcgtatggctgcggtccactgggtcagagagtggaaagaattaaagtgcagaaggtatctgttttggccagcggaacatatactcaagatgttcttcagagactgtgctccttggtttctcgttggtagtgtttcaagctagaccggcgacagtcaataatcaaaagcaagagccgcaacatctgagattgcattatctcaccatctttattgaagcatcagctaagttaatgaaagtagggcagacgtcttccgactcttctgcggcgtccagcgctgcggcatcccataaagaaagagcggttccgacaagctgcgcatagcattcaacccactggcgatcagcacagggacgaccatctgcgataatctgtaattaatatgacattggactataacaaaacccatgggatacgcacgaatgtccaaatcgttcaacttgaggaaatagccttcatggtatagcttgttggcatggctgttcagatatccgaagattggttggagctccggaggggtatcctgcgaaaactccagcaacggaggattgtgagagaacagcgtcgactccggccgcgatgttacccgtcgttcgacatgtggagtcccggttatcggcgaagcatcgagaggcgagggggtatccgaagaaggcgtgtctactcttcgcggaggattgttcagtgtgagagaggccgaggatgtccggtgatgctggctgaggttgtctttacgggacgatcccccgaagaccgacatgagagaaagcactggtagcgcaaggggtgtcaatcaccgtcatctgtagttcgtaggggaagtataagaggatatgctaatgacctaccacgcgagcgacccatgatggccaaacttggttatagcccaaagagataacagaactgaagaccggcttccagctcactcggaaaaagtaggatttgtgttatctgtgttacacaacgaacatgcagtctgcgcggaagggttggggccgaatagtgctgctacggaaataaatggggagagaacgagaggcgaaagagtaggcgaagaagaaagaagtgtgtactgagtccagctcctccgcacggagatagcgacgatgtgtccggacccgccaatactagatcaggaagtttgattccatcaagttcccggtgggaattgggggaggcgcccaaacgaaagacaggagcggaagggcaaataagaccgcggcaatgctggaacaagtgccaagatagcggatgatggcgcaaagtcagctttgcaagcgcctgactaggccacttgatgtctcaggactcgatggcggagaaagcggaggggaatgagtcggaaagcgaaggaaaggagaggcagggggagagatatagagcgagtgaggcgacagagagggaaacaaaatagaaaaaaaaagggcaagctggacagaaggaagcatagaggatcagtgaaaggaagcacaagccgacgagcgttggaggacgatcaacttacttacccagtctaagacgtgggtcttgaatgttgtgagtgtaacaagtgttaccggacttatagtagggtcggctgcttgttttcttctttcctcctttgagactgaaggagagtggatctgggtgttatttgttgctattgtttgtcaacattccgaatggaggtgccacataaaacaccctcgtagtaattgggtataggaagtcacggcgtgagagggaagacattccctttgaaagagccggtcagatggtgaagacgaagccgcagaataactccatccgtcatgctggatggacctgcgggtcaatacttgggtaagtatggttgtgtgttatgtgttacggtaccgcgaagtggttctggcccggcttgtctgcctggcggctggcgtcatcgcatgtggctacaatccgacttgaaactaatgtgcctcctttacactaaagatggtcccagacggacgggccagtctcgcatttcgtttttattattgcccttttcttttcctttcctctttttaaactccgatcccctgcccctgctgcttgaatctcccttcccccaagagtcatctcagtgcgatcggcatggatcatagaaaaataactgcaggtcacctaacaaagtacggggtaatacccgggatattagttattgcctggcttgctgcaagagatgaattgacaataaatgggtcactagtaggaccagcgaaccgaatcgctagtaatcaaaaggaaacagtgctaataaaatgatattataatgataataaaaataatcaccataatattcattagaaaagaaataagaaatggacacctatgtggtattattgagtcagtatttactgtcattccccgtcagtcagccatccgagcaacccatgggtggcctggtggattatcccagtttatcccactaaaaaagcacgccccccgcgtaactgactctggcactgcctccaatcagctcatgctgtgaataaaaataagaggccaatccaatggttgcatcccaccatctcgccaaatatagaaacgtaggcctgcatgtcttaactacgactgccacttcccagccaattccaccggcggtcctttgcttttgcctctgctcatcaattcatgtttctcgcccacgaggtgaggagaggagacaacgtacacgccaagcacagcctaaccagtcatcgtatctgctggtctcttatctagcagccagaaaaaacttagactgaccctcgtaatgcgaaagtattagtcctcgagcgagggtatatcatggtacgattggatggatggatggggagggaaaggcgtcgtcgtgtcccttgtcccttgtggacggaagaatgcaaggcgacagtcagaaagaggaatggtccgggagtcaataatccactggcgcactgccacaggcccgccgtgccacacggcatcagatgatcttggcgggaagcttcactgaatacttctttagcagctcatcgatagttagtccgctgtgctccttgtttcccaacttgattttcacactataaataaccgggatgccataaatgtccaaaattgcctgcagtgattggaatggatctccaagtcgcagctcagaccaagcctataaagataagaatagttccggaagcatatacccctgctgaggtacgaggctaagattaaggtgaacttgtttagtttgaatctaaaatcataagcggctggggttggatattgttagtcgtatgtcggtaccctgctatccgagcaaagcaattaattagcaagggtccttcctctgctgcggacattgcagagtagccatccgcaattttagcctcgcctaaagtggctgcggcatttgctcttggaagaccttagagattgggttgagcaaagagcatcaactttattcttgatgctgcaggttatgtaaccttaacgcaggcggtaatcaggatttgccccgttgataagacgccttattattgctcagcatcctctcccctcgaccaaagccaccgataaaataaattgttagtttactgtggctggtcagcaccacgagtgatcaaatcatatccttttctagaagcacgtacttctactctgaggtgttcaacagggtgtacgcactctgtagtgcaaaccccagcccgtgacccaccagccagggtgtttcccctcttagtctgctcaagactgcggagctccccaaagatgatcgcaggcttgacgcgcaaactcctagcagcgatcattgctggttaggagataatttcggcaacatgacctcagctgtagggacccagcgcgggaaaagcttctcctaccacgtaggcatatcctgtgctcgccagtaatttcgatgatccaaccagttttcctccatcatgtttccccgcttacgaaaatttactcacttgatcttcgttcccttggagcgtatcattgggacacgattgcaggatcagccttgcggttgtcatgatgcaatcaatcttgactagggtggtacgacggctttctctcctggccttaccgcagactaagactcagttttgaagaaggggcgatacaacgtacaaactacaaagaaggagatgatgatgaaagagtgaagatcccccaagtccgaagcgatcttctgccacatgagtcttgctctgtttcacttttgacggaggccctccctgtctccacttgctttagcacaccccgactcggtggagtctgctgcaattgagtttcggcttatggacaagctcagtgataggtttaccctcggtgagcgtgtttcacgtatagtcattttaactgcatacagaaggtagtggcagttcggttgcttgctgtcaatatatttaccagtatatttctagtagagggcatacagtacgagccccactcagggggaggggaacctgtacctgttccttcgcagacatcctgcagggtcctatggactggagtgactgtcggaaccccaaatatcgataatcgaaactgcgacattgccatgcttctcaccttgtcagatatctgtgcctgccaaggccatatctgtcggctgtcatgtgccttttagtgttctcatgggtcaaagggtcttctgacctacaacatcgtaatatagccctgacgaaaatgacatgtctaggcaaatgcatttccaaatacttcgaattcatcacatttgtacgttggctggatgcaaatttcatcagtcttgagtttgagaccctcccccccaccagtatcggacgtataaggctacataaagcttccgcagaatgtaaaaaccaggaaaacacatcgtggtgtttgtcaagctaaagcagtcgggcttttgcaatctaaatcggaggggctaatatgagtacctgatcatcttagtgttctcccgtatctgacatttggtcatctgcccatcacgtctcataccctggtgactcgtgggtatgggtcgacggtattgaatcatgtcgtgaagactatctttgctgcaactccatgttacctcaggcataaactgtcaccggatcctagactgggtcgcgcagtcatctttgattactagcgtcaggtccgatttcgtgatctgaagaggtcgacttttcgattgtgttgtcactcttcatgttcatgtggattcgtacaagcttccctgctcgaacctagttgtggatgcacttatcagggatatcccgtgatatggaggatactcggcataaatcgtagggtctcagtcgtaagtactaactccactgaccagtctggacggtgaggttcgtgggagtccgacaggtctcgctttgctcaacttacatcaataccgttctttagcatcgtatagccgtctgcaaatacttatctcatctgcgattttcccaagagaaggtatactggagtgttatctaagatgacacacctgaaaatgaaggaaaggacttgaatatctctgccagtccttcatggcatcctatggctatggtattctcaccttatgggtaagctgacgctggtactaaccaaggcaaaagagtcctggtacatccatttatattgctggcattagtgggactaagtgatgggcagagtgtgtctttccctaccgtcaatgcaactctctggttttcactgggcctttcattcactgcgcgtgtcaggacttgcttctgctcctcttcactcccctctcgcttgaccttgtgttcgcttgtatacttgctactcgaatctcatttcgcttcctttgttgaatccttccaaaaccaacttttcgagattccctaatcgcgtcttcatatcatcaactcatctccctctcccccaagcatacctgaagtgtgtgaacacttttagaaagcacatcctggtctgcagggcagactgtcaaaggattggaaaatccgcagtgccttcgacaataacaggtagtctcttggtgtgttattcttcctccctttcatattctctttcaatctcaaacctaaccaacgtcgaatataaggtcaaaatttggtatgccttgatcggactgtcgccatggatctcatctgctcttctccggtcgtccctgcaccgattcaggagatggtcgccgagccgatcgacatcatacttgatgagcctacggacacctgtgcgatggtggaagagaaagctgaggagattatcgaggctgagaatgagaggcttgaccaactgatgatagaatttaccagaggttttgatcctggaactttcgtcgatgaggtctctaactcgctccccggtatcctcaaagatatattcccaggttcctacgagcatcttctgagcatgctgttcgaaagtgatgacaagatgcacgctacccagatgaaactagaggaatggcttttgaaacgatatcctcaggttctcaacaagatcgacaccgaacgtcaagaaacgaacataaccgatgagacgtatttcggggctgagattgagatcttgaggaagatgttagcattcctgcgcaaggaatctgataagccggtgttctggctcaactctcggcgtgcaagtcctagcaaagctcgtgagcagcttgaagcatccatcagggtcatcgaattgttcaaaagcgatgtcatggttgcgatgaaactggacacggaggacagtgagtgacaatcccaagttgaacctgtgaaaacccatcagtctaaagcagcataggaaaaatctacaatcctcttcccgtgtccacagaacgcaccgctctgctgagtatcaaacaacttcggattgacgcatgcaaggcctcactttcttgggaaggctatatggactctgccatcgtactcacttctttctttcacgcttacaaggcctatacctgcgcacacaagccggacaaagcccgtgcatggggctggctcccaccccagggacttgcgccgccacgcttgtccgcagagatagctcaggtaggcgacttggtaagatgggagttcgagcatgagaacggagccttcgatcttttactcaagactgcactttggctgggtttggcgagaggcctcccagctgtgcatctgttctgtgacgtcgctcgacttttcacgactcataagccctccccaacggcaaacgagccatatatccgatttctgcggcatctggcccagacaagagtctccattgccggaatcaagtccacgccgtccactcctgtcccattcaagcagtccgacgaaaataccaatcgcggttacttcgaagacgtagttgattcagacaaaaacctggagaaggacctaacaaagaccctttcattgcttcgcatcaacacggccagggatataaagctaactgctacgcctcccaaatgctcgtttcgcaagaaggcgaagatgatcgagaaggcttgtgctgtggaagagaaccacacggagaagtggccccagaaggatccggcaagtcaagggaattcctttagttaggtcactttgcattcctttgctaacattgcgtcctcccagcttcctgtgaaatctccttctccgattcctgaggaacctgaaccggctacgccccctcaagagacgcagcctgattttcttgatcagatcgaatacgtctcagtctgtccttggtgactaaacatcttgggctttcaggatttacgagccatatcagaacaccctcacccatatgtcagctgcgatctgaacaacatactttacgaacgtctttgatcgatctcacatgagaattgaaactcaaaagaaaatctctccactctgtcgaaagcaagaagaaggtatggtaatcaaagttcagtccattgattggcaaacgcgagccatgcttcagaaaacccacaaaaccccatcagttgttatggattcctctcatttccttcaatagccatcccaatctccagggtgcaccagtttcgacactatgacacttaccgtacgcccatgtcattgccaaattgctctaactctggcagtcaagagcagtaggcgaagaccgtgggccggagaagctgacattatcgtcgaaacaggggccaatccaggatcgatgaagaagatgcaaactcgctatcccatctcctttctttcccactttatgtattaggcaaaatgacaaaaaagcaaagtcatatcacctcacctcacagtggttcaccactatagctcatttgttgacgtttttcctgattcacgctcacttcacatcacccaccgtctgtatgtgcaatcgtaagctgactttactatctacagggcaaccctcttttttcacctcctagggagatcgccgcggcaaccgtgcaacgtttgtgaaaagggtctgatgacatcgtttgggacccgcctctttattgttcttgttcgtgattgtattactttaactcattcattcattacccttgctggccaaggtgcctgcatgcattgttgtgtatactactgactacccattttttgcttgactctctatttgaaaatctcctctctcgacttgatgccgcttcgccggccggacggctggcggcttgactatacatgatgctgacgacactgatgacattgcatggaatgtcaaaatgacttactgatgtattcccctatccttcatttctccttgtctattatgcatgttgaaactggtgcagcgcatcttggggcctgatggtgtgggagacctgttgcatttcgcatttaactcatctagaggcactacctagctagaggctcgatcattcgagacaaaaccatggatagagaggagggtaggagtcaaaagggagagtgtgaaaaccaaaaatagacactagagatgattcattatatttattttacgtatcttctgctcgtgaagtaacgttatgtagcccgaaattgtgacaaaacaaacgtaggtagaccggatatggtagtaagagaaaagaatgcccctatgaatccgccatattatacgccaacaaaggatcaatcatcgccatatcatcagcactgggtatcttagaagaagaagaaacatcgacatcgacatcttgaatcatggcatcagcaaagttgctggggaagtcgccggggttgttttcattatttgtggggtcaccaccactgcccatcgtatatagaccagcttttgaatctgcatgtatgatatacggttcatatggggcggaggagtcatcgttatcgaactcgagtccatagataccaaacatatcgccggtaacgggctcattgctgtccgccaatagcgcgcgctgcatgaacatatcgcgaatctcgtcctcggtgcatccgtgcttactccccatatggacccacagatcgtaattccggtggaaccggtgcggacagccttcgatgaagcaggtgatctgtcggccggtttcttcggcataaccctcacctgtgagagcggccaatgcggaaggagcggtttgctgagggttcggtgtcttgttcagaccaagacgctgtcgacgctcagccttggcgttgggaaagccgaggtgcgcggtgcgaatgtgctcctccagggcgagtttactcccgtagcgttttccgcagccgtcggctcccgtccagccgacgactcgcttggacatggaaaggtcggtctcgccgcagacgaagcgcttctcgccttggtggacggtgcggatgtgcacagttaggtttccctttttggtgaagctgctatcgcaacctggtatggtgcaggggaagacttttcgctcttccagactcacgttaccgtggctgacctccagatgacggcggagctctcgggccgtggaacaggtcaggttgcaattgggacattgtggggggtggacagttcggatgtgagcttggaggagggcgtaagtcgggaatgttactgtagtgagagcgggagtctcggatgatgatgggttggcctgctcggcctgctgagtacactccgtgcaggtgaatcgtttctcggtgtggatgcgactctcatgagctcgaaggtgtcctgcggtatcaaatgccattggacatttctggccggtagttgcgtcgatgtgcgggcaagagaagggtttctgtttcagatgcacgctcatgatgtgtttttggagcgttgagtgttttcggaaggtctcatcacaaggcggaaactctgtgcagcggtacttgtctcttccatcatgagcagctatatgtcgacgaagccgtgagccagttacaaagctcttcccacatcccggacggtcgcatacgtaatctctgattccggtatgggcgctcttgatgtgatggctcagatgcgatgctcggagaaacgtcttatcgcaatcgtcgtgggtacaacggaatagtcgttcattgttgtgtgagcgcaagtgttcctgtaagcgtgctggacggttgaaggccttcgtgcaaccgtcgaaagggcagcggtgagttttcagctctgaaggatatctagcggagatagtcgacatcggagtagctggagtctcatgaagactaccgctagcgacactggagtcatccgaaaagtcatactcggggtcggagtgcttttcttcatatattgggtctggagtatatgaaagacatttagtatcagccggaatctagactcggtctctaggcatatcttaccgacatcgtccagcgttgtccggctttgtacccgcttcgggttggggaggtcccccgaggcttttcgcttctgagccatagctccgcggtccttcagaccatccaagcctgactaatgagcactggactggcgacaggaaggaaagaagattgaaggaaaaagtgatggctgcacgacgacatccagaaattttgccgaggcggtgaacagcggcacccaaagaagactagcgccggacgagcgacaggaactttttccggattctgagggtcgcgacttcgatttcttcacgaggaagaaaagcccgtcgcaacagtttatcgtctcgtccccaacccggcccggtcgcggtgctgccattgtcttcattgctgtcatattcgattggtgtttcatcccaattttgttcaacttaatccgccaccatgtctgactacggagaccacgacgctgaggaaacgtaagagaccggtaccccatgagagcttgagcttgcgcaggtcaatgctgcgcgtctgcgttacatatcgatggccgtcatttttgctaggtggaaattccgatgttctgactaggattgtcttatagttacgactacgagccggagcaggagtacgatgacaacgagcccgaggacttcttaaaccccgaggatgtcgacgtcgcagaaggaggagccgatgaatatggcgaaggctcatacgcgcctgctgtcaacggaaaccacattgtcgcttcaggcgacccgaatgcggggtatgcgggcaaggtcatggaacagacacgggagaagaaggtcccgaacgaccagcgccagacaactccatacatgaccaagtacgagcgcgcgcgtgtcctgggtactcgggcgctgcagatcaggttcgtctcggcaatcgatgcagcatcaagcatgggctgaggagcgcaatcggatgctgaccatgtttttagtatgaacgccccggtgctcgtcgatcttgagggcgagacggatcctctacagatcgccatcaaggagttgaaccagaagaagatcccactgattgtgcggagatatcttcccgacggatggtaagcggaccttctccatgtgtgtttaacgatttgacgtattcgatctaatcactatttctgtggtacaggtacgaggactggacttgcgaagaattactctagacgcggagacgacataggtggttgtatttttccaaatggcttcttcttactttattgtgtatgtgtttggtctaaggatctttccctctgggcagcatagcgtttggagtttcggagtagggtagcgggccatactggcctaggcagccactgggacactgggaagacaaagaaaactcaaaagaataacgcactgcagtctatatatcagtaaaattcaaaaaagtttgatgttgacattgtttcgtttggcacagtctaggccttttgttcgcaatctactgctttggaagcaaaacgacgtcttcacatctgagccagacagagcgctccacagaggtggactcggatgtagaatcaacatcgacgggtctgttttcgtgtcctgattgggatggtgactccaaattggagatgaaggaggtagcagaaaaggtactttgtgtttggcactgttgcagatggatgctttggggctctgatgcaactgcaagtatggcgtcaactcctcacatggcaccgttcccacattcccggtagataagttgtctcgcgagcattcctctctgagatatgacatgctccagatgctcgcatcaggctgcgacgggtccttgtagcacatgatggcctatcctgtattcgcctcattcttattgaccacgtcataaagtcgtttgacttgttaagtgcttcgacatccctgctcttgaaaacctccacagaacacgtaggaatcataagagagatgcttagcccaatgtgttgctcatgaatacttgctaagagtcatcggtaagttgatctaggcgacacaaatgcctcattcggagtataaatgggacgagtaggatcgcttgctcgatagacattatttgtacggacttcggtccgcgcttctctgaccgccagtgaatcggctgaaacagccgagtcggagagcacagttcgaacatcgtggcttgtctcgcattgccgaactgcacgaaaagcactaatgcaagatgacatcccgtgattggcggcatgtggtcagcccattattgagcaacacaacttctctcttctgctcggtttcaaggcatggatagcctggtatgaattcttttcatgctttctcgaatcggtcagccactttctcttgcgcagtcactggttatattcggtctacgtatcaagcagatcagcaagtgctcaccgatccgtggtttgctcacctttttttctgccagccgatcttcatcggcgacgacgccgtcttgtttcgggacccagacccggagcgaagaccgataactccgaggtatttcaatcccgcattttctggcttacgagtaagtgcttcgaggggtctcgaatcaagcatcttccttgttgctgctgatacttctcggtgggccagtccagtgcgcagtaggcattgctatcattattttctctatcgccagatacactgttcttcaaggttaactggactagagatggatagaccgacccttgacctgtcaagcctggacgatgtgatatattcgtgtttcaggaattcgaaccagcgttgcattcgccaagaatgagcaggtcaacggaccaggtacaggatggactaaaaagaagtgatatgcagttcggccctccgcctggataaatcggcacgctgtcacactaaaagcccactatctgcagtcatcctccaatcgtgcttatgcagagcatacctgcaataaccgtagttgtgaagcgcagggcgtccctttgctttccccaatttctcatgctcgtgttctcacttctccaactccccgacaacacatcaagacatgttcctggggaaaagaaagagctctgtggctccgtccctcggcaagtgactccatcgcttacccggaacccgctcgttgctggtccagtaggctctcttcccacaatggggcatcagccagagcctggttcacttgactgtctccattcccactcccaggggatcagtcaacatgaatggccacctgagagtggacccccctactcagtcttggttgagtctgcttttctagctcccaagcttagtcttagccggggcttggaggcactaccttaataaatttttactgtgtgccgctatgattcatttctaatcacagtatatagtgtgagcctgacctccacctgggctcgacctcctccttgctcctagtcccccggtcctaaggaatctatcttacgtagctactcaagctctctgtgagtgctgtttgggctgtgttcacgtcgactgccacggggattatctgatccgctgtctgtttcgccctccaacccttacctttatcgtccactccaccagacggtccgtctgatcgcttattatcggggtggaaaatgggaaccaatgctgattacgacgagaaggctgttgcgggatccctcgctgcaaacaacaatggcgatgtccatgagcttcctaccccgtcagatgagaaacccttagaagaaccgatatttgataccggctttaagtcatggatccaagtgctaggttctttcttccttttcttcaactcatggtatgtgaggccctatactcaagtatcatgtagggcatcaactgacgaaggatgacggccaggggtgtcattaacacctggggtgctttccaaacgtattatgaacagaacttgttgtcgaacatgtcatcgtccaacatcgcctggattggctcactccaggctttcctactcatgctttttggtgtggtaacaggacctctcttcgatgcaggctacttccgtgctctgctcacgtttggaagcattatgcttccctttgggttgatgatgaccagtcttgctaccaagttctggcagctgatcctggcccagggtatctgtattggcctggctgccggatgcctgttcgttccatccgtcgccattctgccccagtacttcaagaagagacgcggcctggccaatggtcttgccgcttcgggcagcagtatcggaggtgtgatctacccgatcatgtttgaccagttgcagcacaaggtgggctttccctgggcgactcgagctattggcttcctctgtttcgggacctgttgcatttcatacagcatcatgcgtatgcgcttccagccgacagagaagcgcaagctggtccagttggctgccttcaaggagccgcatttcgtgatgttctgcattggcatgttcttgggtttccttggattctacaacttccttttctacatccaatcctacgccatcgataccggaattgtcggttccaccctcggattctacctgctgtccatgttgaatgcggggtccaccgttggacgtatctgtccgaatttcattgccgaccacacgggtcccttgaacgtcctcactcctgcagccaccgctaccgccatcctcgcctttgcttggatcggagttcacaatgctccgggcatcatcgttctttccgtgctgtatggtctctgctccggcggtttcgtgtcacttccgccggtcgtgatggtgactttgaccaaggacatacgggacctgggaactcgtcttggcatggtgttcgcaatcacctctgtcggattgctgatcggtacacctatcggcggagccattctgagcaactcgggcagctaccttggagtgcagctcttcacagcctgctgtctcattacgtctgcctccgtctttgccgcgctgagattctctcgctcgggtatgagacttgccgcgcgtgtgtgagcgcgatctgacaacacactactcctattccctcttcaactacgccgcgaccacatcgacccgcctcgatgaggaccgataccttaatacttgatgacccaaaaggattgcatattccattcaagcattgcatttgcatcatgcatcatgggagaaccggtttttctttttctgggatgataaaagtttgatcttttgatacgatagataagattcaagactagactagaacatattgcttaatgtattacgatccatattggttgattgaaagtatttgacagcatggataccatccccaagcctgtttggatttagtgactacaattctcataagaaatctattcaagccgtctccctagtcccactcaacatgcatagcacgacatggcatgatacgtccgttcatcaacccagcatagaaataatagtaatggaaacgcccaaacaccaaatgctcgaaacaaccgaccgacaagccatttttctcttatataattcctcaacctttgttgccggcctcacttccatcatatgtatatatacctagacccgtccgatccatccatcatcactccccaagcgaagcgtagagagaggaactcctctacgaaacatgaatcggatccaccaagaactcctccccattgtcccgaatatgctgaagtttcttatcgcgactgcatggcttgcgcatatcaaaggcatcttcacctgaatccgagaagcctgttgggtcgtcgctgtagtaatttactactcggcggaagacagagtatctgcgtgaaacacccctattagcaccatcatcatctctatgtggagaaccatagaaaagagaacagaagaaattctggacaggggaagctcaaaaaagaaaaagtagaaaggagggtataaactcaccccatgcccttatacatccccacggcaactttattccccgctcgcacatagagatcgacaaaccaggcatcgttgatatcggagccttgttccagacgttcggtgagacgacgcgcgtggccgagacggcgccatgcgggcgcaacggttaaaacggtaatgtggccgtgccagggcgtgtagtgttcggaatggcgcatcgaggcgggttgttcttcaagcttgcccatgactgagtattcgtattagtcgtgatccttgcaatacggagggtctatatcatgtgttgttcagggtgtggttggaaagaactcactgtaacccacgatgccttcctggcgatcttgaacgctgctaaagagggacggccatcgcataaggtaattgaggtagaatccgaggtcgtagttttcggtcaatgggtcgaggttggtgaggttgagggacaggaggtccgttggggacatgcgccggatggagctcattgtgggtgtggtgttttgcgggagaagtgagcggtggttttcaagaagatagtctaataaatggaggggaagatgaagcaatttgggggagttgatcggcgagtcaatcggggcttgggcggtcacggggaggagatctttttgagggtcgggcttctttctccctctccttctgtgcccccctcattattattattattgttggtgtctctgctattttctctctctctctctgtctctctctttctctttccggctcattctctatttctttttcgactctttcgttctcgggatagccggtctcgattcttcgttcctttaccttttcctcctttctccccgtcctttagaactgactgcgtggaaaagcatcctggtgatgcggtcggcgatccaccattgatttccgttcccctgttcgttatttgcttcgcggcagccacttaacgatttgcaaagaatctacaacaaaccaccccctgtttcgcttgtttagaccgtcgaagtctttccgtcaaactatccccttgactctcaaacgagcacaccgcatcctcgtccttctcctttcccctcctttaatcctgcaacatgccgtccatcccacctcccctgactatatctcaccgccatactcggagtcgctcctccaacatcgacatcgaccccatttctcctggcacctacgctcccaacggcttctcctaccggtcgcctcggtcgcctcatacgcctcgttcatccatcccctcttctccggtggatgtccgccctcaccacactcaatcattcaatggctcccatagaatgtcgggcgacttcggcggtgcaggaaacgaaggcggcggactaggaaacttggcagatgagcttgcagatgcatgggaggaggaggaaggtggttacggatacacgtcgggccaggatactggggcccctgacgcacagtacgtggaccgcagtgacgatgaagatgcataccaccgcatgggcaccggggcccgcacaccctcatcgggctactcgtcggaacggaattcttccctgcagcctccgaggcccaaaacccgtaatggtgcccatcggcaccggcgacacgagtcgcaatatgatggctccgattatgggaatgactcggatttcgaggaagcggatatgccgcctagcctagagatgcagatggcggagattgagagtctggctcgtcgcggattagagaacaatggcagcgagaatgacttcgttattcaacgggcggtggaagctctccgggatcttggcgggcagagtgggattgaaaataacgccatgaggtaggtggatctgttgtggtctgtgacttggcaggctgttctgtctgctcggaatcatagctggctaacacatctttctttacattcagactcatcaccgcacactcatccatcacctcacatcttacccatcagacccgggcacttcagaccctcacccaccctctccttttctcgccatttccgctcctttcctcagacgctatagatgcgctcattcctctcatcgacgaagaactcctgcctaacctcccctatcctttcccggaacagccacgtcactcctcgagacccactaccccctcccagtcaccggccctgaaccctcttgtctcgctgcagacccttgtgtcgcagacatccgacatcaccctgtcgctccgaggcctgagcgatacgttgtatgagtcgcggcagctaacgtccactgcatcacgacgactccggtctgctcgcgaactcgtagccgacctccgccgcgaggaagaaggtgttgaagaggggactcggtggatcgaacgaggcgactgggaccgccgacttcgggatcgcgaagccggccgagtctgcggagacgtagtcagtggcttcgaggcggtgtgcggtgaatggcgtgagaagctctttggagcagctgctggagccgaagtggctgctgcttgagatgactattccctaaaggtaaaggggagggataatggatatagacaaggacggatgctaccagtttctttcttctcatgggataaatttttttttgtctttttcctttttgttgcccttgacaccccagatataatgtctcgagtactactgccagagatagcggccatacccccttttgcaattttcctttctagtatatagattatttcatctgggttcatcctgttcatgttcacccacctacatattccagaacttcatccatcgaatccaagcaaagcatgatcatattgagtgtcaaaatctctcatcgataatatctcaagatccgcacatccaaacctccaatttccaatttgacaccatagaagtacatacaattaaattccccacatccctggtatctttcttatcaaacgttatcgcaatttccaagcgaacttcatagatcctgaagaatgactgatacatcttcacctttcccttttacgtactctggtctgcgtaccaattcgtgttaccaaacccctaacaaatccccgagtaatctgtcacaggtacagtttcaccaactgcacggtctgtttcaggtattgatgacaagacagatacccttttccctgtctacctaccaacctacctatttcttgtattggaatcaagctagagcattgggggggaataaaaaagaaaagaaaaatgtagatggtcacactgaactgaggaaattatagcaacgaacggcactgccagtctggggattagtaattagaggtataactctgtattcacatatggtaaggaatggaagcaaggtggagagggcattatttttttgggggtgcgggggaaaagggtttatagacgatatgtaggtatgtaggtagtatgaaatagttactactatgcacttagtgggttctgaaacgaatcaccagtggttttcatgacgatcatactctatctacttattgtgtaacatgattactgtgtagtgattctcacactacaattcaaatatcaacgtaaagaacgaaagaaaatactatgcatttggtaagaaaccatgagatcgggtaatgtaagaacaaatcaatcaatcaattgacatggcatgcccagaaaaagaaaattaaaatcaagcagtggggggaggaggcaaagagctttaactacaacctcatggtaaaaaaaacccccgatgtctttctctgtctctctcctcacaaaggttcatacctcatcgactaaaacaactaaaagacgtagtaggaacaggttggaggaagaagaaaagaaaaaaatcgtaccgggtttgaggctaaggaggaaaaaggtactatgcgaacatgaagatggggaggcggggcggaaaagtgtttgaaggtggatgagagttgtgtgttataccacaaggatgaaagagagagagaaaaaagagaaaagaggaaggttgactcaaatcacgcgccctttcatcaaacatcccaagaactttttcatgtcatcatgcgatttactggccaccctgctgctgcttccatctgggcacccacttgccagcggcaggcttggactcctcgggcttgtcggagctggagccgggggtctgcgtgcgggaggggggctgggaagagccggcctcgcgcatggcacggggaacgtagcgctccgtggaaggagcaggagcaggggcagcaggggtagcactggcacccgagcgcaggtgaggaggcacgtagccaccagttctgcgcacaggagcgggctcctcgcgggcaggctcgggagcagcagcagcaggagcagcaggagtgccaccagcagcctccttggcagcctgacgctctctccagctgggaccagcaccaccggtgcggggagccaggttgagacgaggagcagtgcgttcagtaggagcagcacgctcaggagctgcctcgggctcagcaccaccggtccggcgagcggcacggcgagcttcggcttcctcttcacgctgcttctgcttggcagcaagttcatcgagtctcctgtaaggcgggttagcaaccagtggttttgcgcggattgagtgatggttgagatggaatgggggaatactgactttctctcttcctcacgcttggccttctcctcagccaggacgcggcggcgctcctcctccttggcggttctctcctcttcctcgcgacggatgcgctcctcctcttccttgcggcggcgctcttcctcctcacgctcggcccgctcacggcgtctgcgctcctggacctccttgatacgctgcatcttcttggcctcgaagtcacgctcagcagccttgcggcgcttctcgaactcctcgtggcgcttctccgacacctccttgcggaagctgttgaattgaggcaccaggcggctgagacggtgcttgagggcaacggcctccttgtgcttgtcctcggcctccttgagggcctcggccttggtggcctcgtagatctccatgtcgcgctgcttctgcttctcatagtcctcggggacgtgcttcagttcctcacgacggaaggcacgctccaggtggtcaatgcgcttggcggtggtgcggatgcggtcgttgagctcgttcttctccttctccagctgagccagcttcatggcacggaggcggttggcatccagctcgttcaggtcaagctcgctgatgtcaatgcccttgacgccagtcttgagctcctccagctgcttcttcagctcctgctggcggatgcggtcctgctcatccttgatgcgcttcttctcacgctcgcggtgctcatccaacagacgctgcttctcggcttcctgaagctgctgggtgcggatgcgcttgcgagtctcctcctcgcgctgcttgcgctgcagagcatcggtggcagcctccttcttcttctcgatgatgacgcggcgagccagagtctcctcgtgctccttggcggcaccagcctcggcgcgagcgagggcggcacgcttggcctgcaggcgggcctcgttgtacgaggggtcgacgtacatgcaggtcacatgcagggtcttggccaggcgggtgagctgcaggcgggcaatctcagcgggggtgttctgcaggcgctggacggagccaacctcgctctcggcggagccagcggcgctgccggggtgcagagccttggccgaggagaagacgtcggtgtcgaaggtgaggacaccggagatgtggtcgacgcggatggcgagatcgcccttcttgcagccgttcatgatgaacttctcgatcatggagggggtgatctggaaggggtcggggaactgagccagctcgtagacgaatttgagctcgaccgactcatagacctgagacagctgctggaagagacgggtcaggatgacctgctgcagaggcaggacgtacttctccatctcggggtcggcaccgatctgcttgaggatgggggtgatcttcttgcagatggacagggggtggaagtccacctccaggatgttgtagaggtcacggatctcggggcgggcgcgcttgagcagacccttgttcagggcatccttgaacagcacagcacgagtggggggagaggccatacccaacaggttggtgagacgggtgttcttgttcttgcggacctcatccacatcgaccagggcaccgcgggagcgggaagtgctgatgacggggatggacagggcggacagcaggacgaaggaggcggccttggtcatgtcggcctcggtgacggaggggttctccttcttggtgccctggccagcagccaaagcggcagcggactggcggaggaggttgtagtaacggctgaaggccgcggcgtggaagaggtaattctcgctaaccaggaagatacgggccagcttctcgtagtagttggccatcatgacgttcttggcgggacgcttgctgaggctgaggagggtgtggatatcctcaatgctgcggaaggcctcctgccacagctccagctcgacggcaacgttcagctgctggaaacgggtgtccaggtggcgctggagagtgtccgggtcgctgaggttgatggcgtgcatctgagcggagtacttggcggcattctggacgtggttgcggagcagctcgcacagacggcggaactcggtcttgcgggtgtacttgagacagaactggaaggcctgcagggcggtggtctggtacataacctcaagacgggcattgttcttgaggatttcgagcacggtgcggtaggtctcccagaggaacttgagccaaggggtgacaacagcacggtcagtgcggtcgcgggactgctcaccggagacggtggcgagcaggatggtctcgggggtctcgatggcttccagatcgtccacgttggacgaaggggcagcggactcgagagaagactgaatctcatcggccttggcctgggcctcggtgaccttcttctcggcgagttcgatgaacttcttgagaacaacctataccggtgcagggttagatgctgttggtcgggggagcatgaaagggggatgtagtgtgtaaaagaaaaatttctcctacctcgatcgttccgacgttggtgttctgggcgatgttcttgtactggtagagaccatccttggcggccttgcccttgcgaagatcaacacacagctcaacgaagaggagcatcaccggctccagagaggcgatggggctgctgcgcgtccgcttggaggtgacatgttcgtgaaggacgttgagggcggcgggggcctggcccacggcgatgagttcctgagccctctgcggacagaataccggtcagcatgaattttccatcaccatatggtttcccatcccattcccacgacgacacatcacttcgacattataatcgagatagtattcggaagaagtaaccgggctggcgtaccttgaggacattttcaggcttgatgtgaggcggaggcggcatggtgggcgagatagcgggttgggataagcgatcacaatatggtggatgaggacgacgatgctatccttcgactgggagaaggtcgagagggaagaaaaggcacgtcggatcgcacaacgacgggcgggcagcaggggagtcgagggcgaaaagagccttgaggatagaaaggctgccacgcgacggtcggcgagaaagacccagacaagaaaacgtcaggcagtcaatcttgttgagaaagacagacaagggcgactctctcttctcgctctctgactctctcgttgtgcgaaccgcgaaaattccggccgccgccgttcccactttgggttaagcgatgcgggtcacgtggtatccccgtgtttatggcttgggattcacggagttgccccatggaatgaatcgtagtagtcatatatttctttccattccattgaagacatacctctattttggtcgatattccccattttgagagtggcggttgtgctcctcagccacctcggggagctgttctcattcctccctcgtctcgcctccgtaactcggcagtgggggacactgtttggcccgtttgagacgatcacttggaaggaaggaagaacaggttgtaatgaacgcgtccaagcttctgaaccatcgactagtgtgtctagatagaaataaaacatacgattgacagggttgcgacagcaaacgagagtgctgctgctgctgctgatgaagaagggggcgggagtataatcaggagccacggagtactagtatgggggggaaagagtgctcagggattggatggtatggatcaagcagtgatccatccacgtgaggctaatgagcctcctccataaaatcatgctacaacaaacaattcaattcatggctataataagaatcagaggtgcaaagaaagctgcatgagggagggtgcaaccttgacgcaaaacggaaaaacgcctgttagaaagccttttgtgctgactgcatccgagctatccagttagttagttatccagctaccaactaaagtgactagttcagttcagggggggaagaagaagaattatggattccagtgggaaatgaacggattgcccctgcgactcacagaccacctcttctctcgctcgctcgctctctctctttctctttctccaatatactgctactgccagtaattcctcccccccaaactactactaaccaaactcaactaatactaagactaaactaacttcccattttccctctcttttccctccttcccccccccctcttttttcccttttttccctttttccctccggtccagcagtagtcgttcgctttcctttttgcccagcaaatcctcctggttcttcctgctctccctaattcttcttcttcttcctcttcttacttactttgtctgattcttactcacgttcaatatcgtgaagtcgagttcagcctctcttcccccttccattcattctttagaaatcaattcctcggagaccccctctctcttcttcaggttccctccctcctccggtcgctgttcccacttacattccctcttccctccctccctcataatcgtctccatccccaaagttcctcctcccaccaccaccacctcctcccttttcgcgtccgcccgccgttcccgcccggctttgcttttccccttacttcctgccggctcgacgcgcaaaaaagaaccttaagctgagccgcccgaccgatcctgctgaatccaccaccccccgtcgcgttttatccaggttgatcaactactgcaacaacacgcgcgatttcatggtaccatccgtatggggtcaggtatgcgatatcatctccgccattttcggttgtgcaagaataacggcaggttactgacggtcgcgcaggtcgacaagcgtgaggacccatacgcccctcagcagcagggaggatgctgcacggtcatgtaatggtttcatgacatttccacgtcttttgattcggacggactgagggtcgccgtcagtccgtcggcgcttttatatcccctcttgcgatgacaattactatttctcaccacttcttttttttaacttctcgaccctttctttttctttctatatctaattctctgtcaccataccttggacctatggacagcccatccgctttgttgctccgaatggtgagcattgtcagcgacgaaaagaagaaaagtgaccacggagaagcggatgcgaggctctggccctcgagggagcgcgctggacctgcatgaactgggagggactgagcggtcacaccattggaccagttcatgatctgtttttttcgccttgaaacgcgacacgcctccccgtgggcttccagttacaccttttttcccttactttttttcctttctcattttgtgttgggcgtgagagagtgctcgacaggagtcatttcccttctagtgattttattggacatctttcctttgttttagcagtgatattggaaacgggatggggaaaacaaaatcggacgcccggtttgtagtatagatgggctagttaatatagttgaagcaactgctcatacttataccacatagtaattgcagcaacccagaggatgtgcagaaagaaaaggtagatcacagaatggatcatatgcaacgacccggacttcggagaatacttttttaagattgacacctgcactggccgtacattagacattatagttgacaagttattaacttaagtagttaaaacccaccaccaccaccaccacctacccacccgctgacatcatccaatcatccccctcctcctcttcttcacacaattaactcccccgttccctcttcagcttcaccacaaccaccaccaccaccaccaccaaagatataaacaaaagagagagagaaaagaaaagaaaatgacctctcccctcccaccccacacccaacccaccaccgccacaaccacaaccacaacaacaacaacaccacaaggaaatatgcacaaccacctcccccgcatcaccatcaaatactgcacccaatgtaaatggttactgcgcgctgcatacgtgagtttcccacccccctgcgtaccttacatgtccatccgtatacatacatacatacacacgcacacacacatatatatatatatatatacactaatgtaaattgattaattaattgatatgtggaacagttcgcccaagaactcctctccacattcagcacccaactcggcgaagtagctctcgttcctgctaccgggggtgtgtttactgttacgatgtatcattcttcttctacttctacttcttcgacgggtacgcaaggggaagaggtaggtacaggtacaggtactggaggtgaggatgttgatatcactgggactattctctgggataggaagacgaatggggggtttcctggtatgtatctttcctttttttgtaattctattgtatgggtagagatgggattgggtaggtgactaatgggcaattggctatttctgtagaagtcaaagtgctgaaaagtctggtgaggaatgtcgtcgatccgagtagggatttgggacatacggatcgggctttgagggctgcgaatgtgccggtgcagagtcgggatggggatgaaaaggtcgtggggaagagtcaggagcaggagtctactactgctgctgctgctactgctacgaaaggagaagagaagtgtgaggagtgtcagtgaccgtctacttccgtcaatgatagaagaatcatgtaaatgcaaacaagcatatatgctcaagtccatttaaaaaaagatagaaaatataaaacccatacaaatatcaagtacagtcctgcctgagccacctccagaacgccagtccacgccccgtctctagttgccccgtcctgtccgcctctgtatggtgacaaatgaaaatgaaaatggtcaatgtgtaaaatgaataaagtgaagtgaaaaatgtaaaaagatcggaagaagagaatgaaagaaagaagagtatcgaagaagtaaagtgctatgccagccagaccagacaatgtctggctgagcatcatcgtcaaaaagctcagatatagctatatccaccgagccggtcgtcaaatcatgcaattccatcataaaatccagagtcgtcaccagaatgtttcccattcatatgtgcccatgtaatcccaaccctcgttttgctcactcgcgaaaatccaacctgccaggaacaccgtgaatcatcccaaccgagaaaacaagagaaaactgaaatccaatcaactttccgtgccatcacgtctctccgctcacctcgtgctgatgcgagtgatgtgtgcgccgcttccagaacgccagccgcagtcggcttcgtcgcttcggcaacttgcgcggaggtgcgtgctccttggacccgtgctcgtcccaccggggcccacgcccctcgtgcttcatgcttccagtcgttgtcgtggattgtgccgagctgctcgttccataccccaccggcgacgtcaccttggcagcatcgtaattgtgcggatcggaagcccggcgggtgctcgggtatgcagcgttgaccgatggatggttcgatgtggccggtcgcgtgttggcccggtcccattcgccgtcactccggctgatgctttcgcgggggaagcccttctcgtcgctgtccacgctgaggaagctagtggcattcgtagacggggagatcggagtcatgttattgctgtaggtgctgacgctgtgggtgcgagtgcaactgttccgctgtgaattcgagggccccgatgtgcgtcccgacgaggctgtattcgcgtgctggcgtcgaccactgggcggcccatgtcgcgagctactcggtcttccttccacggagctgttacgagcgctggagcgacccgacgtgtcgccgttgcctgcagcagatccattggcaaagagaacagccgccaggacagtggggtcactcgaagcacgaatcgcgtcggagcagccgtccatattatcgctcagacgggcagaaggcgagttggtctgcccctcagggatgacccccgaagatctccgggaggcggcctcatctggcgacggcatcgaacaaccggtgatgtccataggcgggcccggggtgtccggcgaaacaactgggctaatggtattctcattgtagtcgctgggagaatcatccgaggccagcggggtagaagcagtaccaaagtaatcatctgcggttgaccgctgactcacaggttcactggtcggaagggctggtttgatgggcattttcggactattgatggctagcggcgcgtggaggcccctcaaactcgggatgggactctgagtgcggggcgacaccagatcgtccgggcgaagatcaatctgcaaggtttgccggttcttctccatgtcggcgaggaagtgccatttggactgattgctgcggatgtgctcgaccgtgaacttcaggtcgggcaggatatcagagacgccctcgaacagcggcagagcgaaaatcgacatgaatccaatctggccggtggcgagcttgtaaatattccccaattccggtgggccgccgaatagtgcagtctccatcccaacctccttctccatctcgccctgattggcgaattcctcctgcaggatctgggtccacttctccgcaacatcccacgggcgcgccacgttactgatatcagcgcacttgatcagcagcccacacagcagtgtcttataaagctccaagtcctggggcttccacccgtccacggtccggttgttttcgtggaacttctcctggagcgatccgagccgttccatgaatttctggtgcactcccatgtcggtagcgaggatggagctgatcagaagcttgcgaagttgtcgatccttgaacgcggtcggccagtagcgacgcaggatctgtgaaaaggcagcacagtggaatgcctccaggactgaattgtcgttgtatagctgtgccagcggggcattcagcttgactaggaaaaagttgttcacgcccggatggccgacatcatggccaatggcggagatcagaagggtaagggtatcgaacggtgtgaggagggaggccatcggacatttgtcgtcaatcgtcgggctattgggcccataggggggaagagcgccgatgtgcaacaggaagcagaaaaccgactgcaacacatcgatcgcgtgtcggaagttatggtagaggacgaatgaattatatgaggcgcgacaggccaggagaaacgtccgaagttcacctagcaaaggaagttcaatcgtcagttgacctagactaaaatgatatgtgcggcaaatttacttacctggtgtcagctgccactgctccagttccgggtactgcagagcatgctgcagcatttcgaatgcagccaagaccaattcgtcgtccgaaaactcatgggcggtaaaaccccattgtgcaatgtgttctcttacaaaatccgcacggtcgggacgaacgtccagttcccggtcctgaaactcttcgataacctcttcgggattgcagatgcctcgcataagcttggagaccatggcttctcgaagatacgcataaggctgctcgtcgttaacgcccacccaagagtgcttccgcagtttctttcgggagaggaagcgcgactgttcccggagagccgttttacgagtccggtacgcctggacaaccagagcttgagctctacagctatccagcggagttactaacacgtccacggcaccggcatccaggcacttggagatatgctggggatcagggaaagacggaatacggggctggtcggccggagaggcgctagtgggatcggcgaagggagggcgcagaacagcgaccggaacgatcacattggggccatcttgaacctggatgtccgcggacaatcccgacaacaacttcaggtcgtacgccccttcccactgtgaggtgaatgtaaagccgcgacgcagggaagccggcgacggaggcgatacatccggccacgaaccacggcttgctcggcggcgctgcagagcggcctcctcgccgtgaatatcgatatcgaagaaaacgaaaataggtgtgcagcgactctgagccccgtcgcttatctctgctaacttatttgcgatagctgtgccgacctgacagagatagatgcgtttacaaactcctaacagaacttggacgtcggacgacagcgactctggttcctcgattattcccgaatccgactccgcgcctgccggtgcctccggtgtaccttgatacacccagcgttctgatcggacgcggtggtcgatataaattgcagagcattcgatgccatccatggtgtcggttggatttgaaacacccatcacctagggggtctccactccgaaaatgtcaagtctcgggacagcaacagatgtgaaaggagaagagatagcagcctagccggtccgaactcgggttcatatggttgatggatatggtagtacaggtggagtgggagggtcgagatatctcagggagaaacgaacggccggtataagggtacaaagaggagcgaaggagcgttgagaaggtcgaagtaaaaaaaaaaaggagagacttgcgatcggtgacgttatacagttggattctaaattgggttctagactgggtcagcgaggttcagagactggacgcaacggtctgcagaagatgcgagcgacgacagaagcaggcgacaaatagagaaagaagagcgtgcagcgacgagcgaagcagatgagcgacggcgacaagccgccgtcgaggggggtgcgcgcagttgaacaatgagtttgttggctgcagctgtccagcaggagaatgagcgataatccttcttccctgtgggggggggggggggggggggggttttgaaaggaatgatggtaacgtgcaggaccagccaaaaccctttctgagacaaccgggttcttttgcaccggcaccgcatgcacgcctccagacggcggttggctgcgatcgccacacctgcatacacaggcagttgcccacgcaaacacacaggattgtttcactcacaagtgcggaagaggatcgacagaggtaagaagaagagcaagatggcgaagagattggtagaaattcggtcaatggtaggagaggtggtggtggtagaggtggtggtgaaggtgaaggtggtggtgtgtagtcagttcgtcacccacgggggggggaagggagatggcgcccgagtgaaatcgacccaacgggggaagacagagagatcgcgacacatgcgagaattcggctagatgaaagcgacgaaattcgcgacccaggaaagaccaaagacttagggcgtcatggtgggccaccgtgaggaccagacggagaaaagatgacacgagactttgaggaaagaagaagggtggagagggaaaagaagatcgatcgggaggagagggcgaaggggccgcacgggtgggcgaaggttggcttgggtggatggttcgaccgggtcgggtctgggctgggacgtgggttgtggcagagtaaaaaaaagaggatggattaggcaaaagcaaaagggcaaaaaataaaatatataaaaataaaatagatattttaagggatctgtaatttttttttacccccagtgaaccacttctcggaaatcgaggggaaggagaaacggggaataaaatatgaaatcagtagatcgtggtggtggtggtcgtggggaaatcaaggggaaaagggacccaaggatcagagagtgagaaagttggagataagagaggatgtcaagagaggagacacgggtgatgtcaaaggaacagtggatggagcagaaagtttttttgagttatgtaagaaagagtagaagatgataaggaaagggtgaagaaagagaaataagagagagagagagagaaagagagaccagagaaagaaggagagttgagagaatgaccgagggtggtaagtggtagtggtggtggtgaggaaccaagcaaaagggagagagaagaccgagaaggaagagaaagaagaggacgggagaggtgaggagaagaggaagaagaccttagagactagagggagaagaggttcgtggacaatgcgggcagaagatggagaattgaaatcactagcagaattccccagataaacccaagatgaagtcttgattgacagtcaggaagagagacaagacaagacaagacacagttttgactgacaggctactgacatgacatttcttatttacaaactaactagtagagagttcttcctaacagcaagttaaccaccaccacaagctcaacaaggttcgtacttcctgctgctggaaattcctgcggattctgccagtcttccagaagctctgcggcacggcaggcttgcgtcgtcgtcgtcagatccaattgaagtgagtgggtgggtttccgtatggtaatgtgattacaagatccggtgcacacacactcactcactcactcactcacacacaggccacccaacaaacaaacaacaatcaccaagtaagtaagtagttactacaagtagttactactagtagcctcgcgtctgcctctggtctgtcttcctcctccgactttccctcgagggtttcaggtttccgataggatggggacgatctgaccatgcaatcgactcctccgactagtgacgggggttgcctcggagctgaacagattaatcccggactagatacttactttgttactagagtcgagtcttgacctgagtcaagtctagctagataggtacgatcggctctgtgttcctccccacttccctgctctctctttctcggtggtgcatctggactcctcgtttgttgcctgtattcggctgaccgatgtaaggaatccgactagaacttcgatggaagttaccaggatgcagattcattgcaggagttgtgactaccattgcaccacccaggcatttccacattcatcaaccaacatcatgacaataaaaataaaatcaaatgaaaatagaatttattcaggcattattatgcccgaatattattataataataataataactattctaattatgattatgattactatttatgattctgttgccctgaacgagaaaaccacaagaaccagtggagagacctaaacacaggatacgtaaaccccccccctcagttgctgcccgtccagaaccaaagataaccacaaatgacaatacagggaaaggaaaagaacacaaaagggccaaaaagaaaacaagcaagccgaaaagagacagagcggactgagaggaaaggaaaacagaaagagaacgaaaaagaaaaaagtggagatgatgacgcttaagcaagcgatctcattagctccaggctggactctgttggttttctagaatttcccgggcggggcttggcgccttaaccgggcgctggaaggagggatgatttaatttcccttgtggtggtcaactattattattattattactacgacatactattattcattcacttggtgcatgcgcaccacactaactagtagtggttaacatacttgtcctctccatcatcatcaccggggaggaaatgattcggccatagttaaccaaattctattcacaatatcattcattacattatgagagtctagattagataccggctaaaatgacgatgagcgggtttgacccaaagtggctctgattcaaccctggaaagtgaaaccaggcaaatgacatcaacaagtcaatttccccattttccccatcatcttgggttgaggtacgtacacaggactctgcaatttattttacttaaccgttttaatccacatcataataatattattattttcttaggtgttgtacttcccttttaccctcaccgttaaactcacgaaccctgggggagagaagggttcatgtcccgtcgatcgccagccacaaaagcaacacaacgaaggacgtaccaacaggcaaagcaacgacaacgagtcagtgtaacagcctaaccacctaccttaacagtgactagttagttggtcagtgatgaatgaatggatgtggattgctgttctggccgccctgcccgcccgcttccttccttccttcggcagactgactgactgactgactgactccccctcccttccttttctctcacacgcacacacacatcatcttttattattattattattattattttctagaacttccatcttatcccttctgtccgcccgatcctttccgttcatccacacaactcccacactcacactcacacacccacacccattcattcattcccacatggcggtctgctcagctctcagcttgcagagtgcagcctagtctactggtcttggcactgcccgtattgcacttttatgcctttttcttttgacaacttaaaagtatatattctatattttgtttttcttttcttcttaattaggtggtcttttccgtggtcacagtacagcatgtcttatgtagatgtgattgcaccattcaatacatggatctagtcacaaaaagccaaagggaatgagttcatccctcccttaccctcctcctcctcctcctccttcttctctccccagcaagtggcaactgggcagctggcagattaactggcacagcagaatcagccacaagtgacgtcgactccctcctgcctcaaccacaaccagtcaataagtaactaccgttaggagggaggttgagtcacactgcttacctaaccactaaccaagccatgaaaaagatggatgatgtgatggctgacccatggttaagggaaacgagaaccctgtgcggcaaggctacgtacgagaatggcggaagcctcttacgactagtacgatatcagcctaactacacagcattaataatgagttattagaatgactactgtgcttattgtttccttgattgtaactctatgatatactgttaatgatacaaccaactctaaacagtctactgctgtacttcgtagtgggttctggtgattattaatacccagaactgaaggaatgcaaatcccgccttgccgattcgttcgcgaatgtcaccaatcagaatgcttgcatagaaaccgttcaaggttccccgaccggacggctggccggggaagatcacgggtcacctcagttactactaaagtatctacacatgcaaggagagaacactcgcctcggtagtatttgtattgttatcttcgttggaaccgagataaaatatcccatagcttgatgatggaggtttcgctcgaaagtttcatctatgtttggtagtacttgctcactactactcactagtatatatgatatatataatatgaaatggaaaagtacttccgagtatcttcacccgccaacctgaatattataaagaaggtcattcgaagtatactagtagtagatgcaatccacaccatccacgcatataacacactacatatatacatacatacaccaatatccaatactacttaccctgtccaccatcgtcatgatcaccatagtacatactaagtactatccccactaactaacaaccacgataaaccaaagtcacacccgcagcgtacttaaccactcacgacgatagtatactacacagcaatcatttctactactactctaaatgacactaatgcattgcacagcacacacacacacacacacacacacacacacacacacacacacaacacatccttatccactaccaaccaatcccctaacagatcaatccatcctttttccccaatgaagtcaaagataagtcaatactcatatccgtgtctcgtcacactactactaccaccaaccctgcagctaaattatctgtctcggtggtagtaatgataggcagcaggaaaaatcagggcaatcagggtacttctgtcttacatcagtacctacctaactcactgtttaccccgcattacttacaccttaatatccagggatatagttattctgccttgataggcagcagtccttgccactgcatgcatgcatgaataactatcgacttggattggtcaatgggacatgagtcgcgatgccggaggttggctgcagaatctgagtcagtttaactagttaggattattaactagccagcctaaccactttagattatccaaggctagtatagtataggtataatagagtatattattggacatgtgataactgggatttggtatattaatagtcaattgtattgagtgtttcttagcaaaaagcccatccgatcatgcaatatgcgatcctggttgtagccacggcattcaacaaaaaaacattcgagtatgcgccttctcatgattatcaagaaacatacaggagaagactttgatagccagatgatagatagatggttgacaaagggaaaatagaacattggaagacacataaagaaacaaacgcacttcataagtggaaatctaaaatcacgctgatgagaaagctcataatatcccaacccccacttttaaccatgccatgacagaaacagaccccaaatcaagaagcaagaagagaatgatgcagaagatgtgaaaagaaaggggacggaaaagaaaagcgctataatacacggagtgagtattctataccagtggcaggtaagaaatgatcgcggcctaggaaagcaaattcttcaaagacggactcgcactagcccctgacccgccattcgtcccgctggctgtggtatgcctggcagcactaggtattaccggtgtgtcctcgggcttaaccggaggcgtcggtcctcgtggatccatatgtgcctgcgagacgggcggcgactgtgctggcgctccaagcacgcgatccacagagtagacgcgtggcgggggtccaccattcaatgcgcttagcgaatgttgaggcgagtgccggaccatagtcgcatgtacatctggaggcgatgccgacggagcatacgggcgaggacctgccgcgtgagaaagatgaggcgagggcatcgaaacaggtccgtacgggctctggtgcgtcgggaatggctgcggcggagcgtgggatcccggagggtaatgggatagcggtggagcatggtgagaaggggtgggcgggaatccgttcatatggtgtgcaggcggtggtggcggcggcggtgctgctgcccgatagccaggaacaggtaatccgttgcgcagcttgttgtcaccgaaatcagccggacgctgttcatagctggggtgccactcagagccgccgtgagggagaccgatcggtctgggaagcactccagactgtggcgggtgcctatggtggttgccaaacgggtggttgtggtactcagtgagcttaggcgcaggcaggaccggccgttgtgccgagtagggagatggacgaggctcgggcgatggctgggcctgggtcaccggctttttaagatggcacttgtggcattcgtacagagtctgcggcccttcgctgttgattgccgacaaagcagtcttctctggactgtactccccgttcaggcgtggcaaagcatgctgggatggagtctgatggggatatggagggcttgcagaggctgtgctgaaccgagatcccacaggatcattcagaccaaccccgttaagcagaggcgtccggtggtcgactccggtcgtgcgtcgcgacttgtctaggggccaccatctggggctgaaggaactagagcagcgcgcacacttcctcgtcacatcattatcagcaacaggccgaggggcatggttctcagaatcgatcaccatctcatccggagcatcttctggcgttttgtgaccgtcctttggcgttgtcgaagctgcgggagctgcgggagccgccgagactaccgggggtgccgtgacgctgtggacagacgaaactcggcggttcgcggaaggtgtcgcagtctgatgtgagacattgatcaactgttgcacatatgccgcttttctaatagttcccgtcaaggtcaggtcggcttgtttgtatgcctcggcataccgccgcaaagcgttgacaccctcttcctctgtaggctcgccgatttcatggattgtcgccgacactggatgatgagagcaccagatccccgccgatgccgacccaacctcttctcccagccgtacgctgttcacggtatcccttctggagcttttgataggagtaatgtcaaacccaaacttgtactgcgcttggaatgcacaacccacgtggaagcgggcgttgcagttgttgaaatggcacggcacacatgcacctttatcgctcttgcagatcttgcacacatcacgccacttgtcccttggaatcaaaccgaacccctcagctggctcgagctcctttgcgttgccgaatttgatctccggcgtccacatggcacacgtgacgtgcacccagttgttgccggccgttcgcttcaacggctctcgaggaccgatgggtttgcccacggcctcttgcctttgtcggtacaacttgatagcctcgttgaccatttccttttccagccgctccttctcccggtctcgttcggtcttcttcttgtgcgtcgacctcggcgcctccatcaattcatgctccgtccaggtcaccggacacaagacacattcatacgtggtcgagatcatggggtcgcgatcgttcgagcacatatcgcaaagccacttgacgcagttacgcgacgggctgacaccgtagcagcttctatgcacggtcaggcggcagtctctgcaagacagatgctggtcgccttccggctccatcttgttgcagatggagcatgggagcgttttagccctcgggggatcagggacgattggtggaggttcagggatgcggtctgcagcgactttcttctttggcgctggctccacggaagtggctgtcgatgtcgcggcgctgtctttctcggtggtccgccctcccttcttcttcgtagtctcctgctgcacctgtgggttagcgttcacagggacgccgatggaagctgcagtcgctgcagtcgcactgttgatactgatgggagtttcggtggagacgaggagttgagtcaggagctcctcatctactcggcgacgccatgacttgttaccactttgcgcgatcttcttggccacttcatcgacactctcccactgaataccgtacttcctccatagcaaagcacagcgcaggcacagggccacagtcagctgtgatcccttgtccctttgctttgacgcaggctcgctcgaggtggtagttccgggcgcagtacctggggcgcgccgccactgacgggaggttcgcgtcgagcagaacttgcactggaagccacgcttcttttcggcggccttgtcgttatcgaacgccgagtcatcatgatcgtcggccacatcgtccactagcttcgccgcactgcttcgcttcgcttccttcttgccccgtctgccttcataagcgccccagatctgacgaccgcgcggcgttttcttccacatgtagtagaatctcacaatctggtagtgaggcacggtacccacgtacttggtaatattccgccactccgacccaaacttggaaactgcctgttcgaagagtttcagttcttctgggcgtagatgcggctctttgagatccttgtatttgttcatcgtcttcaactttgccagggccgcgtcggcgtcgaagctattagagtaaaggagttcgagagccttgtcgaggaaattagtggcatacttttcttccccaagttgaggggccaacgccttggcgcgctccatgtaatcgtccacaaacttttcccgttcggcggggctgagatgggaaccaggcgcgtcgtcttcgccccgagaggatggaacctggtctgcagtgggcatcttgaacattagctctgcagtgcggacttgcttcccgcccacggtgaccggttcatcttcgccgcgccgtacatatcccaggggctcgtccatgacccacttcggtcggttggccttctcctgtttggcggcttcgatggcggccacggtttccttggtaagtttcgaatccttgcgacctccagatcctcgcatatacttcttcttgatgtcgatgggcttgacatactccaccggctttcctggccaggcatttaccatagcctgatgccgaggtcccaatcgcgagctggcgcgcggataaatgcggtcgtcataatcgagggcgtcttcgacacggcagtggattcccaaatagcgatagggccacattctggcctgcgcaacctgttcttctgtagctgggcgcacctcttcctccacgggtgccggagtgctgcttgtggtgccattcgtcgcgccatggggttcttcttcctcctcttcgaccatctcctcatcagcctccggttgattttcacccaatatcggggtattccgtgcctcgagctttcgttcttgagcgcgactgcacgctgcgcaagcccaagcaaagccacgggccggcttcttcgtcagtaccggtcgaacacagtacatatgataagtgctgtgacagacggcacaatccaccgagtcattgctattccaaagttagtatgactgaatcagcccatcgcagagagtatggatcggtataccttgcggcgtacaagctacagcgcttgcaggtcttcacggcactggtgagttcctttcgtcgtccaatctcaaccaggacgaacttccagcgctcgtccagaacctttttgacgttactcgggacgttaatgaccttgcttgttgggattacgtcgtagtagcggtggatgtatcggtaaacatcttgtcgtaccagaaacaatcccgggtcttgcggtacgtgtcgaagtcggtaacctccgacaagtgctggatctggcattttccgcgtaaggatgtgagaggacatgtgtcggaatgcatggaggcaaagaccaaacgcgtgtcggcgaccttgcgttggatgtcacgtgggcgataataccagttcacccgcagtgcctcgatcgggccggagggggcatctttggaggggagaaattccatgatccgtgccagatagtacggttccccggggggttcacagatcaggtagacgtggtctagatgagagtactcagtataattttatgccacagcagcaatgctatcaagtaagaacacaatagaaaagtggagaaaaatgagggaggtagatctcaccattgacggcgtaggtggtgccgtcatcggctctgagtttgccatctttcagataggcgccacggctctcgaaactgaccatgttggtttcggccgggttgtacgccagtcctggggccgtcgtaaagatcttcttggctgcattcccactcacagcattggaggtggtggaactggccggctgtttccgtttcctggaagaagagttggctgaggcgggtgccgccccctcctcgaacttggcggaaaatgaagaagtgccaggaatcaagtctttggcagcagccgcgccattggcaccattgaccgccgttagactcttccgcgacgttgccgatgagacgggctcctcactgtcggctttgacgccattgacgaagctgccggaaacaccgctactccgtttggcggatttggaaactggttgggcgatctccaggtcgacatcgatgtcgcggtcttccgcataattggggcggggagcggcattgcgacctctggagcgagtcccatacggtgccggggtggtggacgcgctgggaggttccgtcgcggcgacgtctgaagcagacgcgctgacagccatgggttgagatgtgaggtcgttcccggtggcggcactttggggggtgggcgcctctaccgaccccgttcgggaagtctggccaggggtgggcattcgacgggatgtgccagatggcgatgatgagttgggtttcccaggattgagaggggacttttgggatggtgacctgtccggggccatggccaacccgctaaaggaattcccaaaatagcctcagataagaggggacggaataccgagagaaaagtgtagtgttgttgggggggaagttagagagaaaagagtgggcgatgcacctccggcgtggttggtttgcgtttggatgtccacaggataggaagagtaaagggaacaccaaactggatggggacgacgcggagatgcaaagctcagcaacgggccgggacggagagacgatccctcatgagaaatggggaactctgcagccgggtggaagggagagagaaagaaaaagaaaaagggaacacgaaaaaaaaagagaagaggaaaaagggaaaatggatcaggcctcgcgctgcaaatatttgcccgaagcaactggagaaccgtcaatcgatggtacccgccaaaacccagaaaagcgtaatgtaatggagaagtggcagcagcttgcttgtcgggattgattccctcagttcttcccgcaagggcgccgaaagggtcaagattggtgggtgttaaaatgggcaaaaattgggacacgcccacagggtgcggaatatcaagatcgacaggcttccggaaagtgataagaacaacaccaacccgaatggggcggaaggattacaaaagaacaacaagaagcaggaagaaagcagaccggcgggggggagggactaccgaactgcatgaacgacgaggcgaaaaggagaagagggaagaaagaatgtaggagggaagagggaaaaagaggaagagagaaaaggtaaagcaagagtgaaaggtgagagtgagtgagtgagggagggaagaaagaagggaaagggtcgctggaaacgtcggagtagtaaaatgaaggttagcggcggtggaagccaaacaagcagtagagccacttagggcgttgggagactcgtggggtgagcacaggataagatcagtacttgcaccagcagccagtcagatctctccagtcggcggaggtggcagaaaagtacgaccacaggaaagttatggaatcagtcagtcagtccgtaatgtgtaggagcaggtgctgcgagctagatacaagggccgtcgtttaatcggcactagtagtagtaacctgattgactgatgaaggatgatgtatgctgaaccgggactacccaagcatggaagcaaagcacaaatccatacagatgggggtgagttttgtgatgagagaggattgtaggagtgatagaagcagtttgtgttagaggcgtagtttagatcggaagggggaaggggatagataatttagagggtaatgggagggaagaaagggaagagggaagagggagaaagaagaaggatgagtgtggatgtcggggagagacagagagagagagagagagagagagagagagagagagagaggggaggcgaagatagcagccagcagctaaactggcaggtctttcgtaacccggaagggaacgcgagtcaaaagtcagaaaggaaaaaggacaggcaaatggaaatgcaacagcagccaagtagagtggaagaagagaaagagagcgagtgagagagaccagaaagaatcaggaaagccgtcgaggatcccgaccagtccacgtcctcgcccctagtcccgatgtgttaatatgacggatcctccatccactcccatgaaccagatgaatagttgctttccctcctttcctctcgcttttcctctctttgcgcacaagtcgctctatcggcccttcatcctatctgcgcatccccatcccggccatttctactcatgcttggctccaaccggccttgatacctggcccggacggtagtacccaggtttccctcccttcgctctctttactttttgcctcccactctttccaggaaatacctatgactgttggacctgctccaacagtttacaatggatgtattatgtaggatgcatgaatgtatgtatgtacgtatgaatggatatccgtgttctgggcttcggggtttatttttatagcaccttgctccccttgctcgtccaggcggcggcgtgtttgacccgttgggtgatctacgtcgggacgctgaattttagtggatttactttcgtactagtaaaagatctttccctcggatgttagtcgctggcctttggggggagaggggggggagaaaaaggaaaaaggaattgtgtgggccgaaagacccgaatgcgaaagaatgatgatgatatcgggaaagaggggccatggcgattggagaacggggagggaagagagagagggagagagtaatgggaatggaagggaaggggaatgggggagggacctggaaacctaaaattaagcagcaggggaaaattggaagtaaaaaggaaaaagggtaagttagaagaaaaataaaaataaaataaggaagaggacatggacggacaaaggggacaagggcaacggggggaaaggaacagaaggaaaatgatcaagagaaatgataataataataataataaccataataataaaaagaatgataaagacgggtcaaacgatcttttgcattcattcagatttcactcatcggtctatccagtcatgcatttactcgttcattataatactctggatctatgcatgtcgttctccttccttcctcccattattgcttatcctcgggcagtcaacagtcaataaaagtcaagtaactagcatagaaaaaaaaaggcactgcaggcgggagatgaggcgctggccaggagaatcagcgagagggcagcatgtcgattctgtggcaggaatgttgtcacgtagggcagcgcatgcgcgttggatctgaaatccagagcgccaagtccctgtgcagtgagtgccgagtggacagatggacccatccatgccatcgaaggcgcagcggatatcgtctgtttcagtctaggacaacggaaacggcgtcagcatcgtagccaggagcagggtcggctggacaagacaagaaacgatccgaggttcttcttctcgcagtttctttccttagtatagtctttttgttcatatgggggaaaactagctttgaatcgtaatgcattctctcgggttagatagcgggtgggggattgttgaagagttcaagggcatggcatgggaggtcgttcgtgggagtgataccgcattgttacgggggttgttctggaactactaatcagggcctcctatttgcaggacacccaaccgccctccggagctggtgaatcactgtggagtaatggaaagatataataataatacgtaactaataacttgaatgagaagtacagcgaatgtgagcagaatctttgtccaaaagtattagtttctttggatatggcagttgatctatggtattagcagcagcaacagcagcagcaacatcatgtatgaaatctcgtaggcggagagcatttaccacatcagcagcagaggcgacccgacagtgagcaggtggccagccagaaggcgatcgaggttgaaacatggtaccggactcgcctttttcaccgtctttgagtttggaccgacggtccatgctaaagagagattttcccgggggtggtttcttactgagtgacctagggaaggggaggggctgttggcgcaaagaagtggtcctgtacgaccggagactggaggcatggatacgtgctggaaatgctaagccattttagcttaggcggacaaccgaaaactcggttcagcgacaagactgaaaagggtgagggagggtgccagttccatggctcccttcgacctgcagtgctaattgactagtggtgattagcagcgacacaaagtcgatcctcaggcaggccccggggccttcttatgtgaactacccactctctgccactgactgacggccccgtccctccggtgcggaaatttactccccatcacttccgtgtgatcctggcccgcgagaccagtcttgccgggacaagccgttcaagaacgcgcgggagagaggggaatgatatccagttaacggcgcttgtcgctgtgctgcaggaaacagcagaggtgggcgcatgtggtccagctacggcgatgaggtgatgataacagtaatccgtccaccagagcgggaacttggcccaacccttagcgcctggtctagggtataataacaatattaccacttcaactcgccttcctaatcctagcaagtcaacaagcccctactagtaaggtacttactccttatcatggttcactatggatctcccccgcgacggcggatcgtttgggtgcgaggattttttttttttctttttcttctcttcgattgtcttggcccatccgaagggacgttccggccggatggcagcagtttaggtagatacttcggatgatgaccagtgctccggggaattctgtcccaatcatctcgattaccccaagtgcctggaggaatgatagtcactattcccgtactttacgaggtagatcaacttggagctggcctgagttacatcatcaccatcatcccgataagcccagcaggaaggcatcccaggtctccgggcgactaacggaccttggaaactcctgggatcagaaaccgcaagtcaacttggtccaataaggctgcgacttggttgccgcgctggacgtcctgacttttgttgccacattacagccctcagcaaggctggcaatctccccttcccctttacccaagcaacatggtttacaccccccatttcagagatgggaaatgacatggaagccataaattgatattctcaccaaatgtgtggatagtatctccaggtaggattggatattaaagtgacaagcagtaagtaggtactgtggatggtctggtggcttagagatgacggtctgtccccgtgaaaggtagattgaccggggttggtcggctctggtgtttcaaatgcctaaaccaacaactacgaagcacttactactaagccggacggactattttgtcacgactcgctcacactttactaaaatagataaaatagttgtcgatacctggggggaaaattgaaatcgcattcgagtcttgaaccagagatattggggatttacagtttgaaggtcccagttatttaattcctcatgatcatcatctgatgaccggaaacgcaaaccccaatcataatgctcggctgcctctactctacccgaccgtccaaaacgtgttaaggtgtaaacgcggcaaggtgactcgatcgtccgatgctaaagagcgcgctactatgatggggacggtatgaaggagtctggcacctcggaaccgactactagtgcctgcagagggccctagaaaggaacaacttatgttttacgatgtacccattaacaacaggttagactcagctcaggtaagcgcccgtgggattatatgtaatagctgggttcattagctggatttccctgtaaagagcactgcattgacgctcagaacaaaactcgttaatgtgtgagggagaatcacccgaattgtcatgattaatgatgatacggtgtacggggaatgtaagtctgatcaagtctgcttaagcgtgagtggccacatgtgggtggatcacttggggggtgggctttttccctctttgctcttttgctcttttttaccctcgtttctttttttctttttctcacccttccttttctttttcgggcccatagcctccggctcaataatgttgaagaagaatggcactttggcccgaggtatccgcctacctgggacactctggccaattcaacgtaaatgaccttgtagagctgagccagagcattctcaggatgaaagttgagctgttaagttgatatccacaaaatttcactcttatgcatggcatggtagcatcatggggatgatgactgtacacaagaggctcgcaacgcgggatgtgaggagagggcgcacatgaaccaacccatcaaggggcgtgttaataaaaaaaatacatacttggtaagccagacttgtgttgcgcaggtccgcaatttagcactacgtatggagtcggaggctgcctggccttaccttagttcttccgtagccaaaaggctgttacgatcccaatcagtcaggtgaccctaggcagccagctcgcacgagacaatgttctgtaaaaaactaatattgtgatattaatgcgggaagtgccgtagtgaaggcttttatggaggcagggtctgatgcagttctccccccccccccagaagagtatcccgatgcctgtcggaaggtatgtatgagaggggtatgaacttgaagttcaactagcgatcaataatgaatgttgggttctgatagccgggcttcttctccggccacccttgcttactcacctacctttagtctgcagagcgcgcgcgggacaggaaggaatagcgtggcagctggattctttccaacgtctgtgccccccgactgggtcgcagggtagaatcgctcgagttggtggtgcgaacactggacaccaacttactgcaagatttgctgtgatcaatgtggttacaattgtcatcatttcatattgctgtttctgttcttttggctgccgacttcaaaaacttcagttccctcgcccgtggaggaacaatcagatccggggaggctgctcggcaccatatggccagtgccacttgcccacggaagatgcatgccgctatcgactagcacacgaccaacctccgttgggtaagtcattcctctcgactggcggatcagcagggctccgattagcgggtgagccgatccaggaacgtttccgcacgggaacagaaaaataaaaaaatgctcaatcacacctactagtatcaattgtcactaatatattatcattgcggtatcgtatcttgggtctgagattttgactacttattagccgacataatttattcattccgtatttcacagcagagtgactcgggcctatcaagtttcgcagcaaagtagtatgtagtgtacgtaagtaccacattgcggccttaggctcgccgacaaggcactagatcggggggtgtggtgcctgaggccgattggccacccacatctctctagtgtagttaccagttgtgggatggatgggatgcagtttcccgaaacgagcgcgttgcacccgcgttcctgccagaaccatcaccaccaccaacggggctcgccaaggttctggaatgattgatcccattaccactatcatcagtgttatctttggcctggcctaatattcagcacgtctggatgtctaatcctacagttttatggtgtttcgttccaatcaagctactagttccttgtcccaccgggtttagccacccctcccaatgttgtctgggcactctccgaccatattatacttcccatgattctcattgcgtataggagccccacgagagccgctataactctacagaggtcaaaacgtcgacccaggcatgtctgcaccacccgggcagccatttcagacctatggcttccagacatccgtcgatattgcccgccagcggacgtttgaggtagtcccattggctggaaacaagcgacccccggacccttctgcagacgatgatcacaggccagtgggagtaaaacatcctacaactgctcctggtgcggttggtcggtcggtagattttatccgcccctcgttcatccttcccaaggcccgtctggtcgccagcgacatctatccggttgctgagacgccgccggtgtgtcgtggccaacagccgaatgtgtttcctaccgaccatgatcctgcacacaacccctatttgtccctgaatcatcccacgtatggcttgcctccaggactggtggctaattttgccgcagctgggctcagcagtatctaccagtggcaggcgtcatgccttctagcgccaggtctcctcaagggcgaccgacatttagtctacacagcccccacgggcggagggaagtctctcgtggccgatgttctgatgctcaagcgtatcattgagaaccccgggcgcaaggctatccttgtccttccctatgtcgccttggtacaagaaaagctcaagtggctcaggcgcatcgtacaggatgtcgagaaaattacccttgatgctgaggaccaagcagtcaatgaaaaactgtaccaccatcggtggaacaaactgcagcgatcgattcgtgtcactgggtactatggtggaagcaggactgctgcatcctgggcagacacggacatagctgtctgcacaattgagaaggtgcgttacatctttgcccgtgcagtcacgaatcatctctaagtgttgtcacataggcgaactccttgatcaattccgccattgaagagtgtagcattggcgacttaggcgtagtcgttttggacgagctacatatgcttgatgatgaacatcgcgggtatctgctggaactcatggtcaccaaactacttctcttgcgacagaggacccaaattattggcatgagtgccaccctatcggtatggttgaagactcggttcgcaagcctgaaagctatctgtctgaccattccaagaacacagagatgcttgccgagtggatgaatgccgcttactttgtgtcgacataccgaccaatcccgattgatgattacctagtttacgagaatgcaatttatcctgcagcaacctcgagacagcttttccaaacgatctctaagctgaagtctatgtctaacgcaactcttatggaacggatgcccccagaccgtgttattcgtccctcgaccttccgcgaacttgcaaaccccatgacaaatgcgactgtagctctggcgatcgacaccgctggcgccggacatggcgccttggtattctgcggtagtcgccatatgtgccagatccaagcagttgttatgagcgaagcgatgccggccccagcggacaacacagatgagctcaccaagcgtttagacttgcttgctgagctacgcagtttgcctagcggcttggacccggtcctcgaaaagacgctcgtgagaggcgtagggttccaccgtaagtaccattcgcattgtttccaggcatatgctaagctatcgctatagatgcggggatgacagctgaggagcgcgaactgatagcgcaggcgtacgaccaaggtgtcttacgtacactcatagcgacctgcagtcttgcggctggtgtcaatctcccggcacggagagttatcatcaatggagcccgcatgggcagggaacttgtcggtcccgcaatgctgtaagtcgcccctaaccgaacatagtgtgctattggctgatattcgcgaaggcgacagatgtgtggaagagctggtcgcaaagggaaagacgatgcgggtgagacttacttgatatgtggggatagcgacctacaagcggtctgcgacctcttagaagcagagatgcctgccatcgaaagctgcctggccccggagaagagaggactcaagaggtgagttcccaacacccaattctttgataatagaatagctcacatcccacaagagcacttttggaagcgattgcgacgggacttgtgtccggtaacgatgccatcaaggaatacgttagatgtacccttctgtacctgacagtggataaaaaagtagcctacgctatcatgggttcagcgctgcaagaattggccaccgagggacttgtacaactgaatgacgacgaatcatactcgtcaacacaacttggccaggcagtagtggcttcggcgtttgcacccgaagatggtctctttgtttttgaggagttgaagagagcgttgcaagcttttgtcatggacggtgatatgcatatattttacttgttcacgcccttgcaagcggccacagccactccgatcgactggcttatctttcgtgatcagttggacaaccttgatgaaagcgggctacgtgcgttgcaatttgtcggtgtcagtccaggttttgtaaatacgatgtatgctggctcacaaccccttcgatcattcatgaaggcgctaatggttccgcagggcacaaagtggtgcatcactcaaggagaatacgccagaacagatgaaccaggccaggatataccgcagagcgtacacggcatttcaacttcgggacttgagtaacgagatgccattgtcggcagtagccaatcgctatcggattccgcggggggcagttcaaaccctggcacaacaatgtcatggctttgctgcgggtatcgtgaaattctgtcagcgaatgaattggggcatgcttgcggcagtcttggatcatatgcgagatcgtctggaggctggtgcgcgtgctgatctgctggaaatggcgcaggttacctacgtgaaaggatggactgccaggttactccgagaaaatgggttccgcaatctaagagcattggcagaggctgatgcgaaggaccttgttcctatacttatgatggtgtggcaaactttgatggcagtgtgtgatgaggctgtgctaaccaagaaatacaggtaaacccgcggaagacccagaagaatcaactgcacccagcggaggccgagcgctatgctaaaaagttgcttgctaaggcggaggtcattgttgcatcggcaaacaagatatggggtacgtatggctgaaatctgctagattaaagtctggcattgctaacccagatatcccaaatttataacagaacgcgagatgcaggttgaattggatgagtgaacaatttcgaagtgtcttggaagctacactggggcgatttggcgttactatctgctcgacattttggactaaaaggcatcttataaccaatagacctcgacggtccgcacgcagtgtggggccttctcctttggatttgacagaagagcggaatggcaaatacattttatcccgattggtaagcctttttgatagagcactgctggatttacatggcgtgccatcaggcgggtaaaccaagagccacactgctcggaaagaaggacaatgagctttctaaacaccattcagttcactttgagccgcgatcggctcacccaaatcgacaaaatccaggaggatgaagttgggcaagcggtcgtatatggagtagcacaggtctgcctgggctccaatgctcccagaccccgacaccgcgttggtgtcggatgcatgatccttatcgggtatgaggattcccaatatgtcgacatccagaaaatgattgacaatatacatccgtccggaggcggatgcaccagcgggccggtcaatgctgcagtcggggaaagttgcattcgtcacatcataaggggtctcgaagaagtacgcaaactcatcgaggatgtatgggacggtcgaagcatcggcgccataatctggaaagccagtcaaataagcttctcaggacacgactacctggccactgcttaccaaggaaagacaccagccgcgtgccatttccgatcaattctcgtagggtcggccattcatccatggccaaagtgtctggagacgaactgggcacgaacgcatagtctgagataccggaactgttgaagacatcgccgaactgcgataccgatagactgtcaccgtttgtaaggaggagagtcaccacctcatccgggttgctgtccatccaggttttgactgtagttagaaacgattccaggctgcccgcatcctccagcaggcacgacgtgtggcaaaggaggatggtatcatccagttcagatttgtgggtttggccctgaaggaagcggattcccaggtccaactgctgggtgacactgagatcctggttatcggagaggagcgacccaacgaaggggctgtcgtgggcgccgacctgggtaacattggaaaaacggcgatcacagtactccgcctggccgttacaggtggactgcgcgatagttggcacaatggatgctatgcccaccgccaggccgaagaggatggatggggggaacatcatcatgcaacggcgttcctggtcctttagacgcagttgttgctaggttcgacagtggggggctaccgtaacgggcaggggggatgccgatgaatgaggaatgcaccggctttatttataccctggcccttgatgtacgatgttcagtccatattccatcttctgctaaaatgaccgcgccaaccgttgctgatgaaatcagcagtggcttgttggagccatctgccagcttgtgacctgcacgggtgatgatgagggatagtgtgataaccccaacccggacaccaaccgacagggcaaccacggttaagcatcatgataggaccgacgggagagcatttaaatagccaatactactctacactctaagtccaagggctaagttcccgagtgcagaactagtaaatgctgaccgtgccactgcaatccaatcaagcgggggtctggaaaggagacgacgagtagttggttcggagccaggcggttgaatatattggcagatccttaggctggccttctggggcgctagatgcaagttcctgactggaagtaatggctggctgttggaaacatgatggaatatggataacctccctcactgcatttccttgaagacctggtgaggggggattatagagggactgtttgtcacatgggatccgtcatcatgcaggtcagaagcttgacagccgcgcaccatgtcggttcatgattgggacgtgagggggggaagaaatatcactgtaatttccatcatctcatgctgattcctttttgttaggtgtttctggtgctgaaccaactaagagagaaaggagagttcccatgcttttgggggtggggggattaagatgcctaaggcatggacaaggaaagccccatgcttacctcggcttttgcaacatttgactcttcagccacagagtcgatcccagcgattaatttgcggaatattaagtattgggaaataggtagatgtgacgtctccgctgagttgatgaattggatgtctcttccgaaaccgtccacgtggaatagcatcaatcgcgtgtaagaatcgttttgctgtccccacaaggaagagggaagatgtttaggtcttgtggtaatgttaggtaaaccgactaccaacatgtaaggaaaaagggggaagaacaataaacaaaatgtactgtaacggtccaattctatctatctatctatctagatagtagtgatcaagacaatggccattcatgcatccaggcacccaggcatccgtggtcactccatcttcctgtcccttccgaattgggactagaccgcctggggctccattgggagcgtaatggtaaccgtacccaagataccaagaataccaagaataccaactcctccttcgccggtgggtatctccggtatctctgcctggccggtccttctccattgcctcctccagtccagttcaatccaagctcgtcgcggcctcttctccttccctagatccattcctcaccccattcggcatcatatcttcattacctgaacagctcgtgcgtctcctcgctgtgctgtctccgagtgtctgccgccgccctgagcctgacatccagccccccgttgatcccggccagcctccacttttattgccccattcgagcttcgtgacatcgattgttgagaccaccagcgcctcaccgtacaatttccgtccagaccctcattgcgattcattgctactatcaaacaagacagttggagcgatggtcattcgaacatcccgccgatgagctccatgatcgagaccagtaatgactgggcacgagaggatgagctcgacttgggccaggaagacgatgaacactccccgcccgcccgcaacggtgtctccgaccatgtcaacactcaggagccgccagatcatggcccaatggcttacttcgaggaggacctccccggcgtagccagcgaaaaccatgtttcggggaaaccaagccctcctgttgacgctgattccactgacctcccatcctcgccgcaatccgggcagcccggcgctcccggtagcgtggatgagaccctctcgacgccagatgataccccttctttgcatgttggtcgcgactatgtctgttccgccctgactccccgctgatgagaatagggctctgttttatcgtcgcgaagcagcagcgcgttggccctccgcgggtctcctcacctcagccccagtccttcccatcgccctttcgattgtcgtttccagtccagactctcctctgcatcgccagtcagtttccgaccgtcatccccgtttctagcccagatccactcccgaaaatcttcccttaccagccatctatcgccggggaccgtggactcgggcgcggacatccctctgggcccctgggatgttgtgcaatggactagattgaagaagctcaatgggcaggcattctcggaagttggaaaacggaactttgggcatcccacctgcatggtcgtttcgacgtccattgtggttggtacgtccaagggcatcatcctcgtatttgactaccagcaaaacctgaagaccattattggacttgggacaaagggtacgtctgatcctcaactcggctgaggtcccttctgctgacttggcgcaatgtagctgttgaatgtggcgcgatcacatcgttagcgctttcggcagaccactcgacggttgctggaggccacacttcgagcgacatattcacctgggaaatctcgcggtcagcgcggccttttcttcatatcccccccatacctgctagtcaggtagagactcgaacatcggacggtcatatcgcgggtgggccggtcatccatgtgggattcctgggaacgcgacggacggcgctggtatcagccgataagcggggaatggccttctcacacctggctactcgaggaatgggcgcaatgggacggacggtcaagactacacggattctgggtcgctatccccaggtcttcgcggaaggtagtcgaccgcgaaagcccagctccgtcctggcattctcgccgctcccgcttggcaatgtcgagcaatccaccgactcgctaggcctggtcgccatgcttacaccgtatctccttgtcattgtttcaacgacgcctgtcgcacagacacagcacaagtcaccccgtccgaaagaagtaacagctcatggcgccatgactggagcccttgcctggttccccgccatccggctcaagggcaaagattcagagatttccaagacgaagcttgtctattgttggtccaacgtgctgacggtgatggacatctcggaggtggaaaccgacgagtcaccgagccgtgatcgtcctccaagcctttccttcagacccaggagccgatggaaggccgacgaggcgattgttgccgtgcaatggctgagtcgctcagtactggcagtgctcactatcacacagcagttgctcatattggaagaccacaccatgcgtgtcacggaagccgttgacctcctcaaccggcacatctaccatgtggatctgttctccgcccagctgcatagcttggtcgagcagttcaatgaagaggatacttcgatgcatggagtggtggcagacgccttctatatgagcttccgctcctataagggacgcctgtttctcttaggtttcaacgagatgttgatgggaagcctgtcgaactgggcggatcggttgctagcccttatggaagccggcgactttattggtgcgatccagctggcgacatcatactatgaaggtagcgccgagaagctgaccattgaattaccggaggaggatgcactgaggcagccgttagttcgagagaagctccaggaaatgatctcggcttcgctgaagtatgcctttgggcgcaatacagaagcgaacagcggaaggctgggaaacggacagcttgagaagttagccgaggtatccatcgcggcgtgcgtctgtatgtccgaggaggacttcctttgggacgaggtgtttacctggtacgaggagagtggctcaccgggaatattcttggatgcgctcgaaccgtatatcgtggaagggaccgtccgctctcttcctccgactgccgtgaaggcactgatcaaccactttgcgacgaaccacagcgttagccgattggaagagatcatctgcctgctggataccgccacgatggacattgaccagactacctcgctgtgtaagcatcataatttgtacgacgcgtttatctacgtctggaaccgctgcctgggagattacgtgggtccgttgcaggagctcttgcagctcattccgacaccggaggctctcgtcaacggggagtcggtggatggactcaagcggtatactaatgcgatgaaaatgttcccttatctttccttcgtcctcaccggacgtgtctatcctaccgggacagacatggatgacgctgaggcgacccgagccaaagcgaccctgtacgattacttgttctctggcaaaccatctggtaccaaagctggagctcgagctcaactaggcgggtcgtttcccgagctccaggccatgctgcgattcgacacatccagcttcatgagtatgatgaacgaggcgttcgaggacagtttcttgaatgagcaagaacccgacgagactccagttcggggagtgtccattaaccgacaatatcttatcagcattctgttacaggttatgacccagtctttcgatgcatctgataccatttatctagacatgttccttgcgcgcaaccttcctaaatatcctcaatatattctcctcccgggcagcactcttcaccaggtcttggagcggctgtgccgatacccgagcctggatatggctgacgattgcgaattgagcgccgagtacctgttgtctttctaccatcctcccaacgtccagggcatgatcccgctctacaaggaagcacggtttttccggattctgaaagctacctatcgctctgaaaagcagtacccggagctagtgcgcacatacctcgaagatccgaatgagcaggaggccatctttacctgtctccaagactgccttcgacctggctcaggactcggtaagaagcagcgacgtgacgttgttgacgtggtcaaagagcatgctggccagctggtcgcaattgatgtggagaaggccgcccagacgatgcatgggctcgcaccggatatccacgggaccttcctcaacatcctcaaagacgatactggtcggcagtatcagtacttgggcgttgtggtccgcatgtctctgcagtctgtgacggagggacgacagagtaagcccatcgagaactggatggtcgagcggtatgtacagctgctctgcaagtataacccgtctcgcgttgccgactttgtagatgatctacgggtcggagacgtccggctggaggagctgttgccatccatggaagagagtggggtggtggacgcggccgtgatcctgctggctcgacaaggccaggtgcgggccgcgatggatcgtctcatcacacatctggggaccctcgagtcgggactggtaggcattctgcagaacctgcacgatagtcccgactctgccagcacgacggaggcgatcgaccatctcgttgagtctcttgacaaatttacgcgagtggggacctggctttgccaagggcaaagcaagacggcgaagaattcacgcgcggtggaacggaatggtacgggcaagggtgtcctggagcaacctctctccttcgacgaaagtctatggctcgatctaatcgaggccgtcgtgcggacggccagcagcgtgtttggcttaatgcagcaagagcgtgcagccccagtgactccggcaaccagccacttgatgtcggcgttccgcgccctggtgcagcaggtgttcacatcgctgctctccagtacggtgcgagttggcggatcgtcaagcagcgagcggagcgatgtaagcttcctccgtattctgcgggcattcctcacgcgggcggccagctggtcgccctccctgctagagctgcgggcggtactggcttcaattttctcagcctacacgtatgagaaatccctgttggcactggccaacggcatgctggaccgggacctgtttgtgcatgtggacgaggtgacgcgactacggcagcggggatggcgaccacgcgggcaggtgtgcgaaatctgccggcagcgcatctggggacctggggttggaccccagttttggcaggcgtgggagcagaaacaggaaaagacgcacgagcagcgtcttcagaaacgacttcatgcacaacatgatccggcgaccgcacgggggaagggcaaggccgccgatgcaggtcagccgctcccgctgatggatgggcatgcggccgcagcagatggtgagggtgtgaatggcgagaacgcgacggtggctgctgggccggtcgtggtcttttcctgccggcatctctaccatcggcgatgtctgttggaggttgatccatcgactactgggcatcctgtgcatccccagcaccggcaccatcatcaataccagcatcgtggagggccgtttcaccgaggaggatcggagtgggaggagttgttggcatgcccgatgtgccctgtacataatgaaccagcgatggcagcgtgatgacgatgtcttaatagcatttttttcccttcaacgttttatttttttctactctaatctctaccttaatttctctgtctatacttgcatacgtcctgatagttctcgcaggatcggctgaccgagggaggcaaattcccacgagctgtcaaaaaggccattggaagcgacagaaaccaaacaacgtcggtgagtggcattccagtttctgcattcgggcggggatttcatctgctgatgctgccggctaatttccccctaccaggccctcttgattgggcttcagatgcatcgcgtggccctgtcctaatctcggggttggctgcaactgcttgcggaatccttcccatctcggggctgatcttcatcctccgcgcggtttgactagacgcccagcctgcagcactttcactcaaaatggtgttctactcgcctccattggccgagccctcgactccggaatgtgcccgatcgcctgtcactggcccagttgattttctcgctgcccgttttcatgccctatattggtccgcggattaaattaacggcttcaatcaatcaatccacatggacctcgcagctggcctcgccaggtcccgactggtcctgcgctctgatccggtgggctgctgtggattgttcatagtcggcgccacacagatcgttagtgtctctgcttgaaggcttgaccagacccggaggcccgaggccccctgtctcggcgtctgtctctttacacctctctaactttctaactttctaccctcttcctctctctcccgcacgacgcgctgtatataaccctgttctcggccatggctcgacgaattcagagacctcgtctctagaccaacattcctttgcctatttctgctgctgctgctacgattgagctgcggctccattccttagatctcgcaagagacatcttacgcattcatataaatatctacttctcttcattcctttcaccatccgcttttctgcagaggaagaacatcaatctagctggtctaaatcaaagaaactcctctacctctcctttgaagaaaaaacaaaaaaaaaaaaccccccttcaattcatacatgctcgtcgcgatgcgacgcaccgcgactctcctttcggccttaggcctcacggcgcagctcagctctgcagcctacactttacaagacgactactccggctctggcttcttcgacggcttctccttcttcaccgacaccgaccccaccaacggcttcgttgactacgttgatgaagccaccgcccagagcaatggctatatctccacctccggcgactacgtctacatgggtgtcgaccacaccaacgtcgccggcagtagcggacgtcaaagtgttcgcatctccagcgacgccacctacaaccatggtctcttcatcctagacctcgaacacatgcccggaggtatctgtggcacctggcctgccttgtaagcccccctctccattccctccacccttcactcataacatctctattggacacaaaagctaaaacaaattcattgtagctggctcgtcggcgccgactggcccaacaacggcgaaatcgacatcatcgaaggcgtcaaccaacaatccggcaacgacatgaccctgcacactagcgacggctgcagcatctcctcctcatcggacttcaccggctccatgaccaccgacaactgctacgtctacgccgcaggccaatctagtaacgccgggtgtggtatcactgatcccgacgctacctcgtacggaaccgccttcaacgcgaatggcggcggcgtgttcgcgaccgagtggacttcagatgcgattagtatctggttcttcgaacgggggagcatccctgatgatattgattccgggaatccggatccggattcttggggttcccctgttgcgaggtttcaaggtgattgtgatattgatagtcattttgatgggttgcagattgtatgttctcccaccccctttccccccttcttttttgctctttgcatgttgttggtttgcgatgatgggcggggggcgctaatatgctggtatagatcttcgatactaccttctgcggcgactgggccggtaatgtctggggctcgggcagttgtgcgtccgtcgctagctcgtgcagtagttatgtggcgaataatccgggggcttttgtcgacgcttactggagtattaattcgttgaaggtttatcaggatgatggtgatagcactgttgctggggtggttgattatggggatgatgacgacgaggatgaagatgatgatcaggatgatggggacgatgattccgacgacgatgacgatgacgacgacgactctgattcggatgatgattcagatgatgatggggacgacgacgacgacgacgacgacgatgatgatgatgacgatgaagattctcgtccctggaggggaggaagaaaccatcatggtcagatgctgaacgcgtcgacgtcgacttcgtcgttccctagcccgtcgtttgtgaagaaggccaggtgggagccgaggaattatatggcgggcatgattttctaatcgattcctcctcgtctgtctcatctcgttttgtctgattccatccatttcatcttcatttcatctcgcacacgctcatcttgattgatacatcagttggtttgttggcatttcagtccttcgtttgattggttggttggttggttggctgttttgttttgggtttactctttcggtgcatcatccatgcatgcatgcatgtatagatccggatctatacgggcataaactactacatcatggtaccttactacaggtactagtcgctcgctttgtcatactactatacccgccactcgttagaacaattacaattgaattgatgtttctcatttccctcttttccatatttctactattactactccaaatgacagaacccataggtatataaacaaacatcataatcattacatgtcaagtcgatatcccaacacatctcgctggtcatcagttatccgtccccattctagcaataaccggaagaagtaaatctccatatcttccttacgaatcactcggttggcccattttcgcccctcctcggcaatccaagtcccctcgatatcgtgcggcggcatgtggacgtgccttgtggcgccatttaccgtgagagtcgtgtccacgccggcaaagtacgccagggtgctccataatccgtgcagacgaagatcgatcggcacaaagtgcagccagggggtgatacgtgagtcgaaccattgacggaacagaccggtcttgaatgggagactgtgactctgcatgaaggggaggaagcggccactgaagccggcaccgtccgagtcgaacaagtagcgatattgccagtgggattggaagtcgacgcgggaggccgcgccgagttctttgctttggtcgtcgcagtcttctctgcggcagcggacgatggggtcgatgacgttgacggaggtgtcgagatggaggatgtcggagggggcgcggccgttaaggacttcgtacatgtacgtgtctgtttcgttggtggggagaaagacggagacgctgttcagtgtgttgttgttcacgaggtgggcgaggcgttggcgtggtatgcctttccattcgccgtggttgctgacgccttcggatgtgctgccgatccagaagagtgtgttggttttgtcggtgtagtttgcatcggggtgttcttctgatggcttgtattcaatcttgtcgacgtagttccaaggactggggaaaataatgtcgttgaagccggcgattgtgctctggctgaagacgggggtcaagtcttgtgtgactttgaaggatgctggggacaggaagaacccgtgcagagaggcaaggtcgggctggtggcagatgtctgtcgcagcggtccagtcggacggaaactctcccagcgagtggggacgaacgcagctgaggcagatgtgtcgccggtcccagatgcgctgactgcgagctttggaggagcgtgggcaggtggagctcacgtagcgatcgaagatgtgcttaaaggagttgtcaacgaacatggtttctgttgtctggtcggccggctcaattggtccccactgagcaccgcgatcagtcgaccattcggtttggatgctgtcctccggtggtaaaccgtaagatctcgcttggtgccggagtaccgaaaccttctcccagggaacagaaacccgaggctcatcgttcaggttgaatgcgagatccatatccgggaggaactcggcaaacttctcgatcatcttggaagcgctaattaccatccacgcatgcgtgggcttgatcccttcctgtactcgagctttgccgttgcggatgctgatcgcaccgatctcattgtaagggtttgtcgccagcttttgcgtcatgtcccggatctgcgcaggcggcaatgcgcggaagggtagaaggtctgcatatatttggtcgaactcgtctatgactagggaagatcggttgacagcatattcgtaccacttatcaaaattcctggtctggttagctccagctaaaggtgtacaatcgtgagagaacgcacggtggtggatgttgattgtactgggcgcggtacttcctaacagcatcggtgagagtttgactgctgttggcccgcgcaagccattgatcatggtgctgtctcccgtcgtacacaagcagatcaataggatgcagatgcgcggcgctatgctgctggtgcaccaggacgaggccgattacagtaagaaaagcgaaagtaattcgcatagccaggttgaatcgatataggaattgcgcttcatcttctgaagcagttcgagcataaagaaaggctacggctcccgcaaagatgaagaaaagagccgcgaaggcgcgggaggcgaaaatcaatggaaatggatgttgtccgttgaacagagtggacgcccaagtgaagtagagcgtgacgaagcccgccagcacagccagcccagcgataccatagtacgggatctgatcagtcagcatttggccacaatagacggtttctcgaacctaccaattgggacgccgcagcgaccacacaagtcaccagcactgcttgacccaccgcactgcgtaggtattgagcactgatgaagcggtcgtcgccgtcggaagtagcgacgagaatgataacaacgatggtataaaagatagccactccctttcagatcatggtcagtttgattaagttcgagaaaaatgtcacattgacgcaccagtaggctataggcccaggaagccaaaggcggcttcctgatggtgtcccccgaccgggatccttcactcgccagttcagccgcgccgattaagatcaacgagtcgagaatgaggctgaagatcgtgaagacacgcatgcgcgtatatacactagaagtattggggcagatgtatgttgactgcaagccatgactgaacgttatggtgatgtatccaccagttaggagaaaaaaggccgctatgacatatctcaggcggctctgaaagaggaaattgtgcatgcgactggcaaaggtagctacggcacgcagatgcgcattctgcggacgctcaggagcggaccatttcgcaaccggtcgattgcgttgattgcgccaatagtcgtagagggccaataagaaaggtatggaatactgcgcaaggagtcaggttagcgctgccgccaaagatctaacccttggctacttaccgcgtatccatccggcgcgcattcagtgtggaaagtgaggtcgcgatacaaagcaattcggatgcatccaagcaccgagagtagacctagtttgatccaacgcgccgagctgcgcgagcgagtgagcgcaaaactgctgttactgtctaagctgatcggcgaaaatggctcttcgagcgtttggtcccgttctgtgagaggaatggcggagtatttaggtgcagacgaagcgatcttcggtatgcgatggatgaatcggctcagaattaaaagacagatccccgcaaagtagcaggccagtacggctgtgatgagagggtggtctaggaggacataattagcctagaggattaaggaccgttcggttcggtagcctaccgaaagcgaaagtagtcttgtaagacgtcgagataaaggtacaacttagtaagaataccctgtgcgttgcgttaggtcgctcagttgagtaacagagttgggcatccttggtggtataacgggcatgcttatactcaccctaccgcggccttgaggccggtctcagcagagagaaataccatgacgccaaagaaagttatgggtacagaaagctaatagccatcatggtttgaatgacattcacatcatgcagcgcacaggcaaattccggcgcagaaagaaagatccgcgagggagtaagcaactgtggtgcctggctggggatgccgcaaggaggtggagccgtcactataacgtcctggctaggggccccagggggggggaatacacttccagtagaatgaatggcgtgtgtcctccggagtttgcgaaaggtgtggaggagagaagaggggggaaaataggaatgacaaagggacgacaacaaccaaaaacatatccttagaatatctcattcccagcaaagataaggagaccatgaccgggattcgaggggattgcgtcaacgaaggggtctggcccacggctcgcgaccatcacggccatcctcattccaccacacgggaggaacttgtccttagtgtccaggtagctgcactgcccattgccttcctcgagcacgtcagcactcccaatttcacgacgatcatctttctggtcgaatgactggccaagagttaccgctcagtccatcgggcatatcagagacggtgtcactgaacacgtactcctggagatgcgtaagatgctgcagtaaacacacgcagtgaaacggtcagtcatcctgaaaggaaggaaaaagacatggcaggttgcagcgcttagcgtcagggtccagccattccatggtccatctttggcccatcttgggatgatcctctccccgatcgggcaatctcccctcccgtgtgcccctctggatggcatcatcaatcctgaaaactctggatctccagggagtccaagagtcaaacttgcgccaactcacccagtcaaagttggcagtaactgcgcgatatcctggcggcgggtaaagcgtggagactccgtggggactcgagttgagactgatttgagagggatcttcctgcctgcctgccttcttctggtgtgaactttcacccttccaccatgcgccatgagacctgaatactgtctgcaataaaagaaagtcctacacatggcatagttttactatcagtacttactacattggctcctcgataataaataatacgaggatgggtctttcaaagcagccgatcgctaactgttgtagaacaaacaaggaccaattgcctcgcatgcaaacaaatccagatgaacttcctgaccagatatccaatatagattctctgtagcttcaaaaatgtgaaaagcgattttattaaattatccaatgctccaaagaggaataagatcgcttgcgctactcgtttgttatgatcaactggtcaataatgggacctccccgttcctgtcagatggttgtcacgtgtcatatttcgagtcaggaaccaacattttacctgcctcaggcataaaactaggcggtatcccatacagaaagcggtcccaagcggcagttctgattttcggcgataacttttttttgtcggcgaaaggaatcgcagagttcatcggcagtgtgagcctcaatttctttacctggccgaccgtttctcttgttgctttgagggcctggtttgtgtctccctgtttcgcaaatcaagtggtgtttctgtatacccactgcaaacccgcaatctgtggtccccgccgccgtctacgaattttcgttcgcgggccatcgagacctttctgcgagcgctcatttacatacccaagtcaaccccctcccctctccagggtcacaggaatcagcctccaacatgccccgcaaagctattgattcccgtattccggccctcatccgaaatggcgtgcaggagaagaagcggagcttcttcgtcgtcgttggcgatcgcgcaaaggatgtcatcgtccacctccactatatcatgtcgagcgtcgacgtcaagcagaacaagtccgtgctgtgggcctacaagaaggatttgctaggattcacgagtcaccggaagaagcgtgaggccaagattaagaaggaggttaagcgcggcatcagagaacctaaccaggaggatccgttcgagctgttcatcaccctcaaccaaatccgctacgtctactacaaggagactgagaagattctcggtaacacctacggaatgtgcgtgcttcaggacttcgaggctatgaccccgaacttgcttgcccggactgttgagactgttgaaggaggtggtatcgtcctgctgctgctgaagggcatgaacagcttgaagcagctctacacattgtccatggatatccactcgagataccgcactgaagcccacgacgatgtcactgctagattcaacgagcgttttatcctatctcttggtagctgcgattcctgcctggttgtggatgacgagttgaacgtcctgcccatctccggagggaagagcgtgaagccgctgcctccgccggagtcgatcgacgataccaacattggcacaaagaaggagctgaaggagatcaaagagagtttggcagagtcccagcctattggctcgctggtcaacttggctcgcactgtcgaccaagcgaaggcgctcttgacgtttgccgacgcaatcgctgagaagacccttcggagcactgtcgctttgaccgctgccagaggtcgcggtaaatccgcagctcttggtgttgccattgcggccgctgtggcgcatggttacagcaatatcttcatcacctcgcccagccctgagaacttgaagaccctcttcgaattcgttttcaagggctttgatgccctcggctacctcgaccatgttgactacaccattcttcagtcgaccaacccggacttcaacaaggccatcgtccgtgtcaacatccaccgccagcaccgtcagaccatccagtacatccagccccaggatgcccacgtcctgggtcaggctgagctgctggtgatcgatgaagccgccgccatccctctccctctggtccgcaagctgatgggaccgtacctggtcttcatggcctctaccattaacggttatgaaggaacgggccggtccctctccctgaagctgatccagcagcttcgcgagcagtcccggggaggcgtcaaggtcagcggtgaagatgatatcgacgttgcggatcgtgccacgggcaaggccgccaagaacatcgacaagagcctggctggacggtctttgagggagatcaccctttcggaacccatcagatacgcaccgggtgattcggtggagaagtggttgaacaaggtcctttgcctggacgcgaccctacccaagtcccgcatgaacactcagggcacccctcacccctcgcaatgtcaattgctgcaagtcaaccgtgataccttgttctccttccaccctgtttccgaaaagttccttcagcagatgatggctctctacgttgccagccactacaagaacacgcctaatgatcttcaactcatgagcgatgcgcccgcgcaccagctgtttgttctcgttcccccgattgacgaggaagccaccaagctccctgaacccctctgtgtcattcaggttgcgctggaaggtcgcatcagccgacagagtgtcctcaacagcctgagccgcggccagcgggcgggtggtgatctgattccatggctggtcagccaacaataccaggatgaggactttgccggtctttcgggtgcccgaattgtccgtatcgccacgaacccagagtacctgagcatgggatacggctcccgggctctagagctgctcattgacttctacgagggcaagttcaccagcctttccgaggatatccccgagccgcaggaggagatggtccgggtgactgacgaggagctgaccaactccaacctcctggacgacaacgtcaaggtccgcgacattcacaccatgcccccattgttcggcaaactgtctgagcgtcgccccgacgctctcgactacgttggtgtcagcttcggtcttactccatctctgcacaagttctggaagcgctcatccttctctcccgtctacctccgccagacccccaacgacctgactggcgagcactcatgcgtgatgctgcgcaccctgacctccggctccaacgatgccgcctggctgggcgccttctcgcgtgacttccacaagcgtttctcgtctttgctgtcgtaccagttccgcgagttcccctccgtgctgtctctcagcatctgcgagtccgccaactccggcgccaaactcgacccctctatctctcagagccccctgaccaaggccgagctcgacgccgccttctcgcccttcgacctcaagcgtctcgacagctacgccaacaacctcctcgactaccacgtcatcctcgacatggtccccaccatcgccgagtactacttctccggccgcctcagcggcaaggtcagcctgtccggcgttcagcaatccatcctgctcgccattggtctgcagcgcaagaaccttgacacgatcgagaaggaactcaccctcccctcgtctcagctcctcgccatgttcctcaagatcatccgcaaggtctccacctacttccgcaaccttattgaaggcgccgtcgccgagaccatgcccgcagagaaggccccctccgctcgggtcaccaccgaggcccacgacgagctccccgacgagcgcttcaagcccctggagaccagcctggacgatgaactccgtgaaggtggtcaagaagtcaacgaggagcttcgcgagaagcagcgcgccttgatcgacgctctccctcttgacaagttagtccccccttccttcttcctctctcttccctcaataataccccatcataatcattgaatgacaataactgatttacagtctccagatacgagatcaaccacggtagcgcggcatgggaagaagccgagaagcagatccgcagcggcggtgcttccaccgtcagcgtcaaaactagcaagcagaccaagcgcaagaagggcgagtcggctcgtgagatctatgaccaggagatcgattccaagagacagaagatcattaagaaggggacggaggggaagaagaagaagcattagttatgtgctttcttcaatcacatttcttgcctttttttccccttttatcttttcatactatacttggctgttccaagtggaaatgttctttttatgcattgattagatcatggtgttatgtgtgtgattttattcctgaatcttgttttgaatgatgtatagttgtattgtatatatgatgtgggtgggtttgaaaaagtcttaattgaatctttagagagcttatttctacatgagtgttccaatacaagttcatcccgattagtggaattgaagtagctgacagtagatgatatgtatgcttttgatactcgatatgggaaaccagctagtagtacttatttgacctgataaacacctgtgctaataaacaaattcatgcactccatacggaccatatgttttacaattcgtcgtggtcgaccgccggcttctcctcgacgggttcttcaaccacttcctcgaccttctcttcgaccttctcctcaactacctcttcaacgacaacgccatcaggcaacttctgcttctcaccctcacccagcctgatcgcatcaatccaagcctcgacacgctcctggccgtactctgcgccctcaaccgagtcataccggcgccaccagccacggcgtccattcacagcaacgatctccaccgagttatcctcaggcagaccaagcccagcgcggagggtcttagctccgctattgatagccgggacactgtagaacgggaagagcttgctcttacggactgcgtgcttgtgcgagatctcagcgagactgaggagggcgtccttggccggagccgggagctctgcgtccggctcactcggttcagggaggagagccagcacacaggtaccggatttcggcatcagacaagcagcctcgagggcttccgcagtgggcagggtaccaatggggggagccggaatgggcacactggcgggtttggcctcgtccgagacaatcttggagtctggagaaggttcggtggatttcttcttgttgttatcgcggggcgcggtcgagcccttgggagcaggatccgggttaggagcagcggcttggctgaggaattcgaccatgggcttcttcttcagttcgccgtcgtagacgatggggtcttggccgcctcctgggagtaggacgaaggttgggaactcggtgatgccgaatttctcgacggcttcggtttccttgttgcggacttgagcgacttggatggagccgaggaagtcgatggccagggcgcggaggagtgggctggtggtgcctttctccgtgaagaggatggccttgggggattcctcatcctgcgcgagccaagtgtcaaggtccttgtctgttgcgcgcttcacatggttgggaatccggtcgacgactgcctcgacaatcgctttggcacttcgtgcgcccttgtagtcttccacgcggggcttgccgggtttcttgccgggggtgacgatcttgagggtagggaagccctggacgcccatgcggccgcagaagggtttgttgtcgtcatagtcgcaattgacggcggcgactttggccaggccgtcgagattagttgcggctttttcgtaggcgggctttaggttctggcagtggccgcaccagggagcgtagaatctagagggagagcggggaggtttaggattgtgggaggtagatgggtagggtgatcgatggcttactctacgatctaggagagcttattagacttgtctgtaggcaattgtaataacctgcacagctgtacttaccgaagtgtgattggagtttgcaatgagctggtcgtagttcttctggttgacctgcaagacgggggacttcttcgtatacaatccatcggcgttgacgggcaacgccgccagaagcgacgtgacgaaaagcaacgcagagctgggctgcagcatgattgcgggtaaggaagatgcgagaggggatccaagagtagcagctaaagcatcacccagcggggatgaatcgaggaagaagagagggagaagagaggacagaaagaagtagatagaagcaaggtgtcctgaagctcttggcatgtgacgcgaaatgtcttaagaagtaatattgaattgtatggatttggaatggcggcggatccgtccgttcgatgttccccgccatcacaccagtccattgttcatccccccatgaatggcatccattctctacgggattggattcagttaactattctgcaaaatccatggcgtcggcaatcctgtcttccgggaagcctccatgagcacgagctccgtagctccgggcccataagatcctttgtttatgcggagcccttacctatctacttaagcgttagactagattagttactacctgctccgtactaatcgagggtctctttcttagtgctcggaagccaggcacttccccgcctcaccaatcctcaaattacaaacgaacatgtccattgcatccccatctgaaggcaagggcatggcccttctgcccagggagatcttctggcttgtactgaagcatctcgaacccggcgatgtcctccgttgccgacgagtgtgtcagtcctggaacgtcgcctttcgaattggcgccaatctgcttccaatgttaaagaaacgatacccattagctagagaggtgcggcaattagactctgaaagcgcagaatcactcgaaacgccagaatacgacgttcgcatatcccagatcttcgataaggtcacggcgaaatacgactatctaagccgagtaacgccccaaacaatgcacaggcttaagctctgcgatgacttcggaatcacaggcgagaggaactggttccccgtccagccctgggagtatcacgccagccatctcatgcagcgcatcgatcgacccttcggcgagaccttctggtcctacgacgacgggctcctagtgtacccaagtgcagaccattcatgtctcgtcctgatggacatggaaaccgacaggaaattcatggtccctttcatgatcgtcgggagagtaatacgccgagtccggcttcagaaacgagtgcttgtcatcgaatgggcagaaaacaaagcctaccactggctcaacgacagcgacggtgtccaccgacactttgctacctcgttcgacgtaaaccagaaggaagatggctggcgcgttaattttcgtaacgaatggaaaatcatgttcctcgggcatcctctgagcgagcgagatcggttctactccacccatacccagacccattatgccatctacatctggcaacccaaccgcagcctctacactgcagacgaggacgcccctattgagtccctctctgtatgggacatttccaaaccctccgattaccgaccttctctagacccaacaggtcgcttgcgagtcgagtccggaggtggagaagaagatctcggaccaaccattatcactcgcttcgggttcagagaactaggcttctacggcgtccgtcagcgaggactcccagcaatacaatccctcaacatcaccgacgacgatcaatctatagagatcctcgaaggcacatgcgcgggccgctcaccgcaggttcttgttcctgatgaatgggaatctgaggtgtgggttacgactatcccaatcgttggcgagggcccgtgccgacgacggcgcgctgactttccgctgccaccgtatcgaggaaattgtagcttgcagactaatcctatcacctttgctatctgcgatgagccgtggtattctattgtttgtgagtcgtatgatgagcagtctcaggtgggttattgtctttacttggaagaacaaatatggccggtcgagacagctatgttcttggctgttggctcacctgagtatgcacccgagccggcaaacgtcttgcctgagagccttgtaatggagctcacggcgatggggaaggtttgtgggacagaggactatctgataggtcagagccacaatcgtgagcttgttattttcaggtttgatagatgaggtgatgggtcattactgagaaatattgtattgcatttcttaagctcactagattaggtttttatgaatagttaacgaaatgaaaaagcgtcagaaatacccagtctccaataacagtgaaagggaacatagaccacactcttcgtcatcccccattaggaagagccaggaaagaccaccgccagctcctaccagcccagcgcagtaacatcccatccctccagcaaatcccccacccccttacccacagcagcagcagcagtcaacctacaccccacacacttctcaatcccacatccagggcaattaagcatgtaaagcggctgtcgaagatggcaccctttacacttgtcccggccaaatctcttctcccaaccgcccaggtggaggcaagccgatgtgtcttgctgctccttggtgagcggcttcgcctccgggaacgtgaggcggacacattctagccaaccgcagtacatgtcgaagaccatgccagttagctcgaaaacgaagtcctggcttgtatagctgttgcctgggtcgtcgagttttgagtagaagtggaagaggagcgggtcgccgttgttgatgttagcggtcgcgttgagtttgatggagggggaggtgagtaagggcatgacagagggggaggaaggaagatttatagaactgggtgagaagatgcttgagtcggttggctggggcttgttgctcatataatgagtgacacagacaccgccagcttcgtccaggacagattcatcatccgattctctagcacatttggcggtcacgtactcggtgctgtcagagcagctcgaggcaggctgttcgctcgcagtgtgagagaatttgaagaaataaatgtctgctccattgttatggccgccatcgtcgtagcaatcgtcctcctcatcggagtgatagtacccgtcatcgtcgtagcgatccacatcataggaattgccgtggtgctgagtaggtgctcctgctcctgggccttggggctgctcatcatcttcgtcctcgtcctcaaaatcgtcattctggttctctccacggcggttgtcatcttcttcttcgtcatcttcttcgtcatcctcatcatcttcctcctcatcgccttcaccctcaccttcatcctcatctccaccgtagtaggcggcctcttcttcgttgtagtaaaagttttcgtgccactctctgggaacatcgggcccagcctcttgggatctccagcaatattcattgccgtagccacgagcaaactctttctcatcatgttcgaactcttcttcgtcctccccgttcctcagcctctcctcatccttatcgacattagccttcatcgccatctttctcttttccacactggcagcttcctgattgcgaagatactccaggatgtcctgaaaatgctggggtttctcaaatagaacgccaccgtcgtcctcaactccttcatcttcctcaccttcatcatctccattcccacttctcataccacccgcagccgcagcagcttccgcggcctccgcctctctcttcaactgttcacctactcttatctcaatctccacgcgagctttctctaccagagactcaggagcgaatggatccatatgaacactatggccgtacttgtacttgtacagttccataggatcggtgagatcgcagtagcgcttcccgctcgtaggtctccaagttcctttttcccagtcttcgtactcgtcgtcagatgcaaacggggttgaatggaaatagtatccagctcgacgaaggctatcgtcgtgctcttgcttccggatgggatcgcggagggtttcgatggcttcttggatctgcagtattgtgagattcagcttgctttattgctcataggattgtgtgatgatgatggtcatccgaggggatgagggatggatttgcattgtgaggttcagatcatcattctttttgattcactcaccttctggaactcgtcgttagagacatctgcactgccggtgccttgcttgtccgggtgatgcttcagtgcgagcttcttgtacgcgctgttgatgtcctttagagttgagttatgagagatacccaggatcgagtagtagttggtcacgcgtgcagcggaatacatcttgatcaaatgacttgattcctgaggtttgtagtaaatgtgcagtattggggattcaagaaggcgtaggcgtgaggggaaagtgacgggcgtcgcaggtaggtgcagggagagaggaaacaaacgccgagaggggagtgttgagagtccggacacatttgggaaggtaagcagtgaatggaagggacttcccccacatacgtgaagttcagagtgcgtgaatgcaaacgtgttgaagtgacgggaaattcccgtttgatattcccgcctatgttgtgtaatgacagcagcaattcattcacactaccaatcgatcggtcatgagaacataggaaagcaaggacaaagaaaagatagtgatagattttacaggctgacaagcatctaggtatttatgagtaagtctacacacatggcgactcctccccacacaagcttcatggaagcttttacatgtccgcactggcggtggcaccagtgataatctcaaccagttcaccggtaatggcggcttgacgctgacggttgtacaagatctggaacctacacgggattagtcttgaagcgtgtagttgtgtgacttttggaacttacttgttgatcatctcaccagcgttcttggaggcgttctgtagaacatggttagtctgggttcatttcaaatatctgaatgatacttgcctccatggcgttacgacgagcctgtaatcacattagttaattactccaagtcaatgggtactttaagctggaaaacttacggagatttcgcaagcgtgaccctcagccatagcccagaagaggttgttggcaagggcgtattcacggaggtgggccagagtctggtcatcagtctcgaaagtagagaggttggctagagcagagagttcagtttcggtacgcgcaaaacacattacagctggtataactcacgagactgggtgatagcctcctcagagtaagcctcaacggtgccggcctcataggactgggcgttgatgaactggttgtagatgatcttgacgctggcgtagtcggtgggcagctgggagatctggtcggcaatggactgagcgtcgttgaaggtggggatgtccttgcagacgttggcgaagctcaggacgatggcgttggggttggtacgagacagctgagccttggccttctcaccgaggacgacgatgtcggcatcggggtactgctggagcatgcgacgagtggccttgctgagaccggagtggataccaccgcaaagacccttgtcggagctggcgacgacgagcagagtcttcttgtcctcgagaggcttggtctcggcgttctcgaaaacggtgttggaggtctgaccgtaggcgcgagagtcctccatggccttctgggcgcgagtaagacgggtggaggcgatgaccttcatggtgttggtgatcttctcgatgttcttgatggacttgagacggccctcgatttcacgcagagtcgcgaagttggcggcattgggaggagcagtgcttcgaaaaaatcagccattgaaccattctgttggtatgcttgtagctccatctcctctttgtcctgtctgttaaatggattggtggaatggggtggtgggagccagctggacagcctagcttggggcagtgggagggaaacgaaaaggcgacggacgggcgggtgttgtggacattccggaagagaagaagaacttaccgggagaccgcaatgctaccagccctcacagccggacgaacagcacgggagaacatattgcaaagaagccgtacggtcaaaaagaccaacgataaacaatcgtagaggggatagtgtggggagaggggggaaggaggaagagggtagaggaatcctcgtaggctggcggttgagaagtcggtggttgaagttggactcctgtttctgttcttccgacagccggcagcacgggacccaaccgcgctagtcccaaacgggcaggggtggtggtgaaatggctggtggtccgggtgtccgggtgtccacagcgaccagctatgcaacccggccgggcgtgcgcggcgctaagcccaaacgggcagctctggaggtgtcgggcacatcaggtgacctggctgcgcgcaggcttacgtcggctgagtcagcagcgccactcaggcatgcaggcaccgaggcgcccggaatcgaaatggagtcgtcataatttccatacaaacttccagacccggcagccttggcacctcaggctgccagcctcctcgcacggcgagtggctgacggtccggagaaacgtgaagatcgcctcaggccccaaaagacggcctcgttttccattccattccttcttctcttcttcctctctttcctctctttcctctctcttctctctctctttttcgtttccctgttcttccctctcgtccgtcatctttggctctgctgtcttcttttctctctcctcctcccttcccccttcagcttcctctcctctccgctcttcccgcttgaatctcttttccaccctcccctctccgggttctcgttttccttccgtctttccctattcggtctatgtctgtctctcccttctagtagacgctttctcgttgcccttagccttcccattggccaggctgccgttgctttcatcactccttcaagcgccagctccgatctgcagactcgccctctctcgcgcgcgcccctgcgctctcccaccccggctttgcctgtctactcgctccttgggcccacgcgctatttctttcaatcgccgggcaaccatgagctcctcggaagacgataccccacttgtccaggcaaatggtcgccgtatcagtgagtgttacttcctctctttactctcacctgaccctttcccgcctctcttttacgcctcagttacccttcactttcctttgtttggggtcaaatttgcgactcaatcccctctttttgcgcatcgatatctataaaccctcgtgaatgcgataagtcttacacttcctcttgttgttttcaaggttcccatacggactcgaaaatgcgcgacgcgacggaaacaaatggccatgttgacccaggcgtatccatccgctttggtcccgttcaggccgaaaatgatgttgacatggcggatgccgacgctgccgccgttcccaagcggaagtcgcgctcaagcgtcggtcagagaaagtcttacgccgaacctgagagcagtgaggaggatgatcaacccttggtacgccaattatctccacgccagttccttcgttccccctatccttgcgacgctattgctgtcgctgttcgttccagcggctgaccagtcgacagagcaagcgacgccgcacttccgtgaagcacgaggaccccgaaacggacgatgatgtacctttggcgctcaatggaagaaagcttcccaaggcgtcggaaacggctataggcgaagaatccgattccgacgtgcccatcgaaagaaaactcgcctctcagaagaagaagatccagcagaaggcagagaaggatgcgaaagtgacccgcaagccagcccctccgaagactacgaagaccgcagcaaccaagaggcagaccaatggcgtgaaaaaagagcccgaggatgtgaagccttcgaccgtcaagaagacggccaagccgaccaaggccagtgacaaggctgcattgtcctcgcaggtgaagcgggctgcctccagcgccaagtcgacccccgtcaaaaaggaagagagcgaggaggctgaagacgccgatgaagaagagtacagatggtgggaagacccgaccaagggtgatggtacgatcaagtggacgacactcgaacacaacggcgtggttttccctcctccgtacgagccactccccaagaacgtcaagatgaagtatgatggcatccctgtcactctccatcctgatgctgaagaggtggccggcttcttcggcggcatgctcaatgcgactcagcatgttgagaatcccactttccagaagaacttcttcatggatttccgcgatattctcaagaagaccggtggcgcaaaggaccccaagggcaataaagtggacattaaggactttcacaaatgcgacttccagccgatctttgcctactacgacaatcaacgtcaagagaagaaggctttgcctccggctgagaagaagcgtctgaaggctgagaaggacgctcaagaggccccttacatgttctgtatgtgggacggacggaagcagaaagtgggaaacttccgagtggaaccgcctgctctcttccgtggacgtggtgagcaccccaaaactggccgcgtgaagtctcgcgttcagccggagcaaatcaccatcaacatcggcaaggatgcgcctgtcccgcctcctccggagggccacaagtggaaagaggtcaaacatgatcaagaaggcacatggcttgccatgtggcaggaaaacattaacggcaactacaagtatgtcatgctcgcggccaactctgacgtcaagggccagagtgattacaagaaattcgagaaggctcgtgaattgaagcatcacattggtcgaatccgcaaggattaccagaagaacctcaagcacgagctgatggtcgaacggcaaaaggccacggcagtgtaccttattgaccagtttgctcttcgtgctggtaacgagaagggtgaagacgaagctgagactgtggggtgctgctcgctcaaatacgagaacgtcactctcaagcctccaaataaggtcgtcttcgatttcttgggtaaggacagtattcgcttctatgatgaggtcgaggtcgacgcgcaggtcttcaagaacctcaagatcttcaagaaagcacccaagaaggagggcgacgaaatcttcgatcggctgactgtatgtactccggttcgctctttaatgacactgctaacaatcacgcctagacttccgccctcaacaagcacttgtcggcctacatgcaaggtctgacggcaaaggtgttccgtacctacaacgcttcccacactatgtctacgctgttgaaggacatgaaggcgacgggtaacattgcagagaaggtgaaggcgtacaatgacgccaatcgcaaggtcgccattctctgcaaccataagcgaactgtggctgcatcccatgccaatcagatggaaaagatgagtgaaagggtaagttggcctgcggtgaactctacaactgggacgtattgctcatgtctattttttaaacatttttagatcaagggactacggtaccaaagatggcgtctaaagcaacagatgctcgatctcgagcctagcttgaagaagaagaagggcgccaagtacttcgagatggacgaagatatggacctcgaatgggtgaaggagcaccaggccttccttgtggaagagcagcgccagaaaatccagaaaaagttcgaaaaggacaatgaaaagcttgctgcagaaggcgagaaggaaatgaaggccactgagctggagagccgtctccaggtagcgaaggatctggagaaaaagttcaacaaggagaacaaaaccggaaaggtggaagccgaaggcaaggccccgactgtcgataagattgaggcagcgatcaccaagctcgagcagcgcattgaaacgatggagcttcaagctcaggataaggaagagaataaggaggtcgctctgggaacctcgaagattgtaagtttctgtcccttgctctggccgatggttcttgatcgactaacactacatagaactacatcgaccctcgtcttactgtggttttcagcaagaagtttgatgttcctatcgagaagttcttctccaagtccctccgggagaagttcgaatgggccatcaagtcggtcgacgaggattgggaattttaagattccctcgaccgcgtcgcaactaacttcgacaatctttcccgctcgatccattgatcttgattccggatgcagattgtttccttgatttattttcctctattatattcttcggctacatcggcggtgaaacggattgtcttacgcataatgcattttggagccttatattattgttctttctcctagttctccctctttttctttgcttgccacatctatctcccaaaagccacccctgccttcttgtcgctgtacactccgcctcaatttattgtctcgattcattacgatgaacatgcaagagggcccatacacagcatcaccagttttctcgccacctctggtcttggttctcgctacgtcttggaaattttccccctcgtttcaagttttagccttccattgaccctacagatgaagataagaagaataaacgaaaagaaaagagttatacacccgggaaactctatacatctatcaatatattatcaatatatacagatttacactcaaggcatttatttggagaccatagtagtcagtaacatgtaataacgagtttagccaagatgaacgaccagatatgactcatgatagctaagatctcattcaatcttctgtaacatgaacaaaacaaaatcctgtcatcttaagtgtaattcttcgcctttgagatccatcaatctacctatcagattattcttgtttgtagggtgcagtagtagtaaaacagttggcgaacaacttcattgtatggtagctttgattaatgctaccatgctaccagaaagacctgttgcaaatcatgtgatataagggataggtagatatatgatggtgctatattctggttctgaacgctaaaattcaagatagatgggttttgaacgctagcgatcggcataccacacttatagcaaacatctagagttctgtcatgcctcgtggaggtggagaaaaagtgaagggtacagggaacatatcagagttgagggtgagaggagaaagggtgagagggcagtgggtgggcatgcatccaaagtacgcaggcgagacaagctggattatgtaggtaatgaatgataaaagacgaccatgagggatggcagtctgtggttcacattcgaggacaaggctcaacctatccatagtgtatgtaatgtgacataaaaaaaagataaaagtagtctaaatgtgcatgatgttcataatcaaaaaggcacaccatccagccccagccagtgacagaagaaatataaatgcaagaaggatatagaacataccagttgctcaagaacggaaacccagagacccaaacagaatattacagattacatgcagaaacggtccgtggtatacaacatgcgaacttgagatgagtggatgcggatgcgacaggtctatgtgcttttttgcccgagggtaaggtcgagtcagttgtgttctgaggggcaattcgtggtcatgcacggtgggagtagaacagctctcatatacgtcatcaacctcgctgatatgctcgtatagaggtcgggtcgagaacatgggaataggaatatcacgtgttgggtcgtctatggccaccagcccattcgcttgtaactgtcaaccatatctcgtacggcatcagcgttgaagcgctctcgggatggcttccacccagtggtcgtctcgaatagcgtcccatccagacacatgtcttggtccttcagcacatccttttccaggaacgggccaatgggcccaggccgttcaatcttcttctcttcgagcaaatcagcccacccctgtaagcattcctcgttcatgtcatctacaacatcgtcgaggttcagtttcgcaaactgggaagctagagaacccaaaaagtcacacttgagcttgaagacctcggacagagcctgtgcgatatcttcctgacgagtattgccgtggtcgaccacgttgaatgcaaggggcgctgaaccgtccgtgggagcgcttgctctccattcagccgctttccacaaggcgctggccgcgtccctgacatatacggtgttgatcttcagatccttagtgtaaagaagctccagatccttctccagctccaggtgaacgcgagcaaggcagattcccattgcgaagtagcccgagtcgtattctccgtagacgtggggcagacgaagcaagcagtagttaagacctggaatcttttgcagctcctcgctggccttcatcttccacttggccagcttgtgccacggctgcagcttgtcatcttccttacgcggacttgagccgcccttgtagacgtgagcggttgagcactcaacgaaagagcggatacctcggcgggcgacttcgcgacccagggcgacagtgagggcgtagctgcggacttcgtagacgtcatcgggttgcgaatgcctggtttcccctccacagttgatcacataatcaaattgttcaccattggcacggtcaaagatacgagggaagtgctctgagtttcaaggcgcaagttaggaaaaaaaaagcaaaggaaaaaaaaaaaaataaaaaaattctcctggtcggctaggacaataggttttgggcactcacgttcacggctggcatcagcctggacgaatttatcttttgagcaagcttcctggaactcaggggccaaccacgccagctgaggcaggaccttgtcaactagtcggacttccgaggccaagttattttcatgcaggtagagagcgagatggcgaccgataaatcctataagatagaaacccgtatgttagcgaggataacctggatatcggggaggggggtagaggggggatgcatacctaaaccaccaacgatcaggacggccggcttcttgctctgttcgtcggccattgtgggaggaaaagggtaaagtaatgagattgaaaccaagataggaccactctgtggtactttctcttctagtagcctcgatgcgatctgtggactgctggctgtattgacaccccgcacccgagcgcgaacaaaatcgaagaatgcggggaggaaaagggggaggggaagcagagaggatcaccaagtaagggacaagaaaggagctcggaggcagttaatctgatgtatttgccgacggcaggaagtcaccgaaaggtttgagttaaattccacacggaggtcttaaaggggaggaagaaaaggaggaagcgggaggaagaatgggaagaagtaagaggagagaagaggaggaggagcaggaggagcagaggatgatccttttccgggattaaaaccatttatcagaatcacctgctctcgctcagatcaacttcagtcccagtcccagtttcagtccactctcctccttcaggaatctcgtcatacactccctccaagctaggtagataaagaaacgagctaacaaatcatagtcatagccttaaacctgtcatggcttgaccatggctgcactacactgtccactatcgtccccggctgagacaggtgccctcttttgacactccccagaagtcggaaacgatgatgctcttgttgctggtacccttcctcccttcctcttatctgacggctaaaatggtctcccactctcaaggagaaacttagaactaactcaccgagggtgccagatggcgaatgcacttaactgactataaccggcctcaggtaacccctccctacacactatccttcaaatggcaatattacaacgttagctctggctcaactcctcatttactataaccaagctccatccttcgttatcattgtcacccttgatttcccggagtctaaaaaacataattaccgcggataacgctggacgaccggaagcgcaagtgaaagtcttccttacgaacccaagcgtacgccgaacgaactccgctagcgctgcgtctagaaatttcgccagcacggtggatgttcccgcttgattattccctcgtacagtagtggaaaatttagagtcctcgggagacccgaccagagccgacaaattaattcttcatctcctcccctgccaagcgcgcgttgtgggacgttttccgttcttcagggacaccgtccgatcatagtcccgccgcttaagtgggtagcagcaggcctaagaggctaagaggcttagagggtaggggggtggtggaggaacaaagagaggaggtactgcaggaagattcgaaagacgcgaatcccttcggaacatgaaaggtccagaataagcagacgatcactcgccaccacaacagggcggacgtatcattcctaaagcccgaaaagtgatcgcgacacggccagaaggaagcagcgcgaaggcaagtgtgtgatcacctacagggaataatcaaatgatctgcgtctcatattacgagtcagggctggtggggaatcgttccaagatcattaatattattgtgcgtcgcgcagttagttcctttcctgcgcatagcttcggcatctgactatttccaaccacaccctggttggttgggaaaggtcaaagccaaagccgctcactgtcacctccagaaaggcatctaagcactgctctccttccaccattgccggcgattattcccggcagtgacaagcccggtggtcgaaatgtaaaagcgggcgctattgactttgattccaagttttacggacaagagagagcctagtcggcgcgcgattccaaatgcgcttcgtgctttcgtctgcgaatggatcttttttctcgacggggttatcatggctcgccccatatcctacccaattgagacaagccaagctctacggcaatgctggcctattcgattctagcatagcatctgctacaacgccgccaataatgatgctgaagatgatgcgaatggttctacatgtcattgccgacaatgaggtcggtgtacaatgtccacgtaaaccccccaatccttcagaaaggatcagagatgcctcggcatttgcaaatacttacttattttgggccaaagggaaataaggaaggaagggaattgacgtcaaaagcctgccgttaattctccgaccttttccttttttttcttcttccccaggcgatatgcttcgctgtaccatggaccgtggccgatcgtcagcccgtggttcgtgctggacttagctatcctacgctactgccgtgcacttcatgcaactaaaggagtagctggaattctaaaacaaacctggccaccacaccatcattatgctatgcacatggttgcttgcccgcttccagactaaggcctctttcctcaccacatatctatccgtgttatggcttttctgaaggaggacaataacatgtgacaacaatgtgctaccggaaaaattatccccaccaataccatgatacacctggtgacactgacttcaatacataactctggggtaagttataatcagtaggggtggtgggatcaaatcatgtcaatctcacaatcgtacccacaacggggaaatcttctctttctttgccgaaagccttgtactttaagatggttaacatttccactttcgagtatttgccactagtcatacctctacgggatttgatactatctcttcacgggatttgccagcttccggattcaagttctagatgttggggactgttaggttactaagagcttagctctaccatactatttggtcttttgtcttctaggccttcttaagtaaaacagttatcagggttttaaccgggtacaaatgtaaacattgctctttcaagacaggagacatgcactaatccaactccagtatggaagaaaggtacagatatcaagcatgtgggtacgatcagcaaatgccaatgtgaagcatcactttgatcttgtagaccgatcccgaggcgccctcctttccttcatcctcggcttgccaggcattggacaactcttgcaacataaggagcagatcctcattacgctctcgacgcacgcggatctcaaagtctgaccagtcaaacctgaccgacgctgcgatgacctgaggcggcatcgattcccacttcaattgctctgaggggctccactccatcacgttgcattgtttcgccatgtgctccaggaactccgttgcctgatcgaaatccgtgaatggcagccacactggggccattccaacctggttgctcgccgtgacaagaaacttagtatccttgaaatactgagaagcagtcgttccgatgtggttgttctccgtagcaaggagtttggtatcctgtgcatactgagcagcagctatcacactctgactgccctccgtagcaggaaacttggtatttttcgcatattgagaagcagcacggtgtacaaacgtgccctgatgcggagcagacataccgtccttccctctcgagggtggcaactggacctctggggttcccgtgtagcatctagctagagaagtgcgctgtttcttagtcttctttgccgcactgctctggaattcagcctcgggttcagattcacagacaatagtcttgaacggccgaatggcgctcggggtactgcgggtccgcgtcttgtacacgggcttgtcggtgtcttcgtctgtctccttgagagtagattttctcttgctcgtgttcccggcttcaaagggtgatttagtcagttgtgttgactaaacgttccgtaaaacatgttagtactgaaggaaagcgttcagaatatgaactagaaacgattaagcagacctttgccttctcctggcttagtctggagtagcccttcgccttccttaacaacagaatctcaatcgttcgaacgatcctacgcaatgattagcacagccagatcatccgggagtgtaatccatcatagaaaaagagagaaagaaagaagtttgacaagccctagggcctcccgtagaaggggctagaagcaagcgtatagtgaatacgcgtactgagtctgatggctcagcattctagtcttttgcacgatagtgttgctaggaggtaggcactccgtccctagtaaaagcgcactttgggatcggccctgacaagaggaaaagaaaaagagaaataacgacaaatgaagggaagtagataaagaaaggagacaaaaacctactcttcactctgagcgggataagtgcaaagcgtcttctcatccgcaagggactcttcctggagatatttctttctattcgccggagtgccccagtacttcagaccgtactgcgcaacaaaatccttggcgcaggcgcgtcgttcgttctcagaggtgaggatatcggtccattcgaatctgttaggctcaacgtgttctttcaccagattaaggaactctcggccgtactcttccttgagatccaggaaatgaacaaactgcttatcgcgccaagaagccttgacttcaccgcgatctagaagctctttcatagtttctgcaccactgctggagcaggcagggcttgagggagaagacatgatggtgttggtgcctgggtctggagcagagttctgctttgaggacttgaaggggtaagttgaaagagagcggaacatgaggcgtcagtgtattttggatgtagaggtagtaaagagaagaagacgcggggaggataggacggagggagcaaaggtaggtaagaagacgcgtgctcttgccgtgtttatatagtatgtagtgctgagaggtgaagtgaatacgagtgaaattcgtcgctatagcgatgtgggggtgtttcggtgcttgtttaaaagcagaggtgagagtgagagatatttaatcggagaatgaactaaatacaggaaaatacagcctgcttagaaaaccgactctttgatagtgttgcacaacaatgtacgatcatagtcaatatcatgttgcagacagggttgtttgggcatttgagccaggtcgaactcgactctaaactagctcttgacttaggccaggaacacgtaggcttgcggaccatggcaatagacgctgaagatgctgggcagaggacctattaggtgcaacagtcaagtataggcaggaaatgggtgaggaacgaagatacgatatcgtataagaggaactacattgttgaaaagacttgaagtggtccatcatcattactgtacactatcaggttggatgtagcatgagctcttgtcataatatggtcttgatattcatggcttagtcaggttagggtttttctatgcttctcagctttcaaatacgtcagtcccagacactcatctcacatcatttcactctgcaccgagataacgcagtgaattcttcagctctttaatcgcggtgttgacgtcgtcgaatgtcaaggctgacacggcccagcgggcatgcttctgagcaagagctatagcttgatcgtcaagtgactgagcgttcaccccactggaactagaagcggcaggtgcaggtggaggtggtgtggatgacgggatactttgaggagtagggcgagaaactacaggtgctgtcgcagaggaagactgtacaaacggtggaggcggagcgacaccgcttgtcggtctggtgtagaacgagcttgcatcgtgagatgctgccgacgggctcgaaggcggaatggatgacgggggagggaaagagtggaacgagtcagcacgagcttgcggaggttttgcaccaatatccgcgggcgtatctgggaggttgggcacggagggagcaggtgaagtgaaagtctctggagccgagggaaggttcagcggtgcgcctgtctccgcatcgtcctccatgttcgaagtagacatggggtctgcaccgtagtgagcagctggagcatcggcaaacgtggtcggaggttgcgggagactaaggggtgattgtgagggttgtgtagactcatcagggacctcttcaacagaaggctgcccaggtggtgcggctgacgatcccacgatggcctgcacttcgggatcgtcctgctttgcctccatacccctaagttcactttcgagttcatcttcttcagtaggtgccgggttggacgcattaggatcctctcccgccttgatagcctttatgatcctcacggcatggtacttgcaaaacttgatcttcgcggcgatctcaggttccggagggttggtccaaatctgacacaattcgagaaacgtagcagcggcttggaatgtgtcggccgtctgtctaattacgggtcagcggtggtgcggatagtctcccacgaaaacaacccacttggtcactttattggccttcatagtcgcctccgcacggccaaggacctccaatccgaactgctccacgtaggcattggctgccaccgcatcggttaccgcatcattatcgacattctcactcttgaactgaactcagagagaagaggtgtaagtctccagggactgcgcgccatcgcagcgggggtgtcgtgcgcccgacgtacctgctccaacttgtccaccaggtccgttgtgtattgcttgacatcgtcgtcagaagtgtgcagtccccgtccgataatctgattaacaatccagaagttacctgtaattgagaagcaaccgttagtcagttcatgtggcttctgtttgagcagcagcatgcgcaatcaacagcacttacaccagtaggcaacaacgggcttcgcgcgttcgagctgagctgcccgcaacgcgtatcgcccaatgtctgcggatctcaagctagcggggatattgctcgccatagggttgggtgggacgcggacgtccaggaggtcagagctgcaacggttaggatgcaggagaaagatgcacaatgcagggcggggatgacgttggaggtggaactgcgccaagctggcctcgggtcggcctagcgttcctgacttgggctttatcgggatggtcgatccattgttgtacaaaatactacattctctcccaccattcgaaataaaattctctcttttagaatcaattcaatcacctttattacataataagtggcattcatttctgaccgaaaattgtagctagtttctaaacgatggatatcacgtattttcacgccgtttcccacgccggttaacccatgccagtcccacaaagcaccctccgccacaagcaatagaaaaccatccatcatgcatcctcgacgatccattcgccgatatccacccgctcctcggccaaagcttcaacttcaaagtggtcctcaacttgtcccccaggtcccccgattctctcaatgactatccaggccccaccctgatctgcgagacccggatgcagatcgaaatcctcaattcgtactccagatatcgcatcactgtggtttccatcttcagaggtagccagtatttctttgtacggcccttgacccagctctactgtcatcaacatcggggacgggccaacggcgcgattcccgatcgtagacagtctgctccgtcctatcagtttaatgcgggtcaagcgcttggtctccaaggaagccagcatccgatcttttccaggagtcaggattccaatatctgatatgaccgcccgtcgcccagctgcctccggcgcaagcggcttaacgacgcacggtagtgctgacgaaatccagagtgtgaatcgtccaagctggtccggggcgaaagttgaacagacgagagtgtacactccttcgccaagtctctttttttccgcaagagacccgccacgccggtagtcaccgctatcggtgattatatcgcgattccgaaccctagtcacacgctctccattggaccagaataacttgacatgcgtagcgagctccggctccgatggttccagcaggatggagatatctgtatcgtcatgaacctctagtcggaactggggattgaaagggtaacgggcagattcggcgtttcctcctgccgtggagggcatccacaatccctgagtttttgtcaggcaagcgtatcggttctgagcaggcgccaagagtaaagggttgtcggaaagagctgacaatgtgaagttctggctgacagcgggcaatgactgctcggacacaacgacagtgtaggtcgtgcctgggggcatttcaagtctcatgagagtatttggcgagtcaacgtatggtccacgatgaagagcgccttcactcaatgccactcgtttcccgtttgcgttgaatacgtagatactaataaatcctggttccagatcgtcttggggcacctgagtttgttcgtcatgatgaatcgacctgaagtgcttcccaagtagtagccaaactttgccgccaacctcagaggtgacagcaaactgaggatttttcgcgaaacagccagccacccctctggcagtcgaaaggtcccatgcgaagtggatatcttcccgatagcgaaagattcccgggttccagttcagatacagattctcgaaattctgaaggacactctcgcaatccatccaatatgttctaggtaaagaggacgcaggggtgtgagatgtgtgtccaagtgcgaaactgtctgcaatatctccggtgatcgcatcatcacctgcccatgggttctttacaagcatttggcgacggtctctctgttctctcatatccaaaatagcgtagtcgtgttcgctcgcaaagcctagttctttttgctccctctcggttaatttgcccgtacctatcgtcagtaggacatcgccattacggaagcgtttgaatagccgtctccagagttgctctgcagtcacatcatcttgatgaaggaaaacctgctcgggaatccaacctgtcaagacccacagatctgtaccagaattgctcccaggaaaatcataacccccgcgaagtttcagatatgccttttctacaaaggccggccataggaagttaggatggttccgatcgacaacatgaagtgatcttgatgttttggacgcaggcaagcgatcatcaatgacaactttcctgaaacatccattgaaataaaagcgaaaaatgtatttcccagaaggagaaattcttggatttacctgcccgtattcacaggggaagactatgggaagatggtgctgcaattattagacacttgtgtcttgcaaaaatgtcacgttgatatttctcataccttatctagaccacgctcggaccttgatgtagcagcacaaagactggcaacgacggagcagtcggtcaacatatcttgtacgagatctgtggggcccgagaccgacattacaggcatttttgacttcaggccatcgataccatttgcatgtttggacaacaaatcaaagggacgctcccagcctgccagaatgcgcctttgcagtttagacagatgaaggtctggcttgtcactggatccagtcagcaattggacatcaacatttgacgaagcctccaccatcagggactagagtacacttacgtgaaaaggccttcatcgcccttctcaaagtcctcggggcccggcgcattttcccatggaggaaagataaagccgttcagctttgcgctctcgagcagaatgatctcttctcgggtggtaagtttacgtgtggatttggggaaacgcgccgtgagaccgcttttctcatgaatttggagaaccgcctgccagtccttgtcctgtttgatcctttctgctcgagtgagccattctttacatttagcatcgagagcctgtctatcctttgactcggtagtcagactcagcgccttcatgtagttttcagcggcgtcaatggcagactcaagggcctggccttgagtaagagcactagatgcatctcgttcggctttctggctactggttagtccgaagaacctttattgtggtgatcgacatcaagtggtaagtaggaaagagtgagataattaccaaggcttggttcactaagaactttttagacgcggcgttcggtctagacattctgctgaaccagcctctctgcaagtactacagattcggctagcacctatcagatgtgatgcagtaccacactacttgatgatcatgccgaaggggaccgtagtatctccgatgatgacatccgaggtccacaacgttaaggattgcgccagacccaagcaatagacaagaggaacgtgcactaccagccaacccaagataaggaactttatatgcttagtcacgaagatccagcgtgaatgcaacagtgaacaggcacaacgtgaatggtggcgggcgtaccgatgaatggtggtactagaatagtatggagttgatagcgtcgcgtgtcggtggggagagtcggcagtgggcaggaaactgtgggtgacccaaagtgataacgatcaacaggccggccatcggaccgaggctcgtttcgtcatgcgcgccatcactgcgccgaggttcatctgcctgtcttgcctgttcggagtatccctgctctcatagtgctgcttgccgggcttctggttttgtctgtcactgaccaggcactcgacaacgctttgtctgtgatcgcttcaaactgtgaacactgcggtcgccagagtcccctcacacagtctagacagcctgtcaccctccgatcattccacacacactgagctgctagactctcctgggagtccccgctccgaaatatcgccaattattattccgcaccgccatattattctcaggtaataagtccgatactggaatttcggtcaaagtgtatcataaacggtttgggacgctggtcgatattcttctcgcaattatcattacgccaaatacctcatccattcaatccaccaaatataccatctcgttacaataatggcaggccagtcgaagcccgcactttccccttggggaagtgccgttgcaggtgctacaggtgcggttctagcgaacgctttggtctaccctctcgatctgtatgcaagtgcctgttgtcgctttagaactggaaacaaagaatatgctaataaccatgcgtcaatccacagagtcaagacgaagcttcaagtacaagttaagacaaacgacgcgaaagacgagaactccgaaacagttcactataaatcgacattagatgcgatcaccaagattgtcgaaaaggaaggagtcgaaggcctatactccggaatcgttggctcactcatcggtgtggcgtccaccaacttcgcctacttctactggtacaccgttgtgagggccttctatatggcatctaacaaggtccctaaacctcctggaactgccattgagctttccctcggtgccgtggcgggcgcggtcgcccagatcttcactattcccgtcgccgtaatcaccacacggcagcagacacaagccaaaaacgagaggaagggtttgattgaaactggaaaggagattgtcgatagtgaagatggttggaccggtctatggagaggactcaaagctagtttgatcctggtggtcaaccctgcaatcacatacggcgcctatcagcgcctcaaagatatcatcttcccaggcaagaacagtctgaagccttgggaggctttccgtaagtaaccctattaccgtccatatcttacgagccaaaccaatgacttttgcagtcctcggcgctctctccaaggcgctagctactatcgcgacgcagccattgatcgtggctaaggtcggcctccagtcccgcccacctccgagccgcgaaggaaagcctttcaagacattcggcgaagttatgcgctatattgtgcagaacgagggtctcctgtccctattcaagggaattggaccccagatcatgaagggactccttgtgcaaggccttttgatgatgactaaggagaggtatgtttggtcttgattaaggggcgcaatcacatgctgacagcgaccagggttgaactcatcttcgttcttcttttcgcatacctgcgcaagattagagagcagaagctcaagaagctggcggactctgctgcatcgacagcgaagaccagtcttccggcgaccctcaaatagacgtttgattgattttgatttatggctcggtaactaccatttttattgtacgaatttgtttttattctcactgcggcgcactggttgtgggatttcgcctgtcctgtcagtttctggtatgaccgaagatactactgcagttgtctatagataataacagcatgatatctagaacatacaatagcatcaaaaggatcatcgcactgcggcaagggactaactgactgtgctgtaccccaaaatcacataaggggtatcagcgcactctcgtaaaaccaataattgagattctcaaatcgtagataactaccatatgcagaccactcctccgaccccggggcaaatggagctcactgaccgccaaactttcacctcggcaacagctcatctacgtacggcccgaataaacatcgaacccagaaactctccccaaactaatttccgaaatcttatacacccactcgcaccctcccctccaaagcggcgccatcaccgcgcaaaccccaaaggaaagatacggagcggaaagtcctagcatgagccgtcatgcgatggccgccatgggcttccaacacgcaagcctccaacaatgaccaccctaccaccacgaacaacaatgaccccaagaacctactcgactggagcgccttcaccgaactccgcaccctcatcccaactctagtcctcacaaccggcatcctcagcgccttcaccctgcaccggaactacctccgccggttccccacagcagtcaacatcacgcccgcatattaccgtcgccgcagcatcctgggaaaagtaaccagcgtcggtgacggcgacaactttcgcatctatcatacacccggcggaagactcgcgggttggggctgggtaccctggaagaaggttcccacgacgcggaaggaattgagagatcagactgtatgtatacctccccacttttttttttttcatctacgtttatgctaccggagactatatttctaacatcagaatgaaattaaatagatccatgtccggatagctggtgtcgacgcccccgaacaagcgcacttcggacgccccgcgcaacccttcggcaaagaagcacacgagtggctaacggggtacttgataaaccggcgcgtgcggatatatgtgcatcgacaggaccagtatcagcgtgtggtggcgacggtgtttgtgcggcgggcgctggatttcccggttccgtttcgcaggcgcgatgtcgggtatgagatgttgaggaaggggttggcaacagtgtatgaggcgaaggttggggcggagtttgggggtgaggtgatggagaagaagtatcggagtgcggagtggtgggcgaaggcgagggggttggggctgtggaaggggttcaagaagaatagggatgcgtgggagagtccgagggagtttaagactaggacggggatggaagatgtgggggatgggaagaagtagggtggcttctacttattctttgttgatattggtgattgtgttgtgcttttagtttgcaatcggaggcgttcgtgtgctttgggggggtggttgcatgatgcataagttctgatgatgatacggctgatactgatagatatccttgtcgttatgtatgtctctgcattgcgcagctaatcttttggttgtatattcggaaagatatagataatagtctggtcatccaccgttgcagcactcattaacatcgttagactgatcattaggttaactcgtccacgaaaaatgtcagctgtctctgggtgaagaagtggtacaaaaaagcagtgtccccatctgctgcccttctaggactgcaggaatgcgacgccaacaaacacaaggatcaggatataaccgatatatagtacaagaaggtatataggaccgggggcgagggatagaagaccatcaggtgtaaaatctctagcagaaggaattctagcagaactgccgctcaatctctgcgaaaagcttcgggctgatctcgtcgcttgtgtcgccctcgacacgccacaaacagcccttgcgctgataatgttctagcaacgccttgctcgtctcttcaaatttgtgcaatcgctgcttccacgtatcgatcgagtcatcttctctctgagtcagaggctctcctgtgacatcgtccttaccaggaactttaggcgcattgaaatcggtattgtaaaccctcccggacggttcgtgtacccagcgcgacgcgatgcgagagagaatgacggaaggaggtgtaacgaggtggacgacgaaattcacggggacgatggtttctaggcttgaggcctgggtcgcggtgcgcgggaagccgtccaggataaaagatgcagagggcaatatcgatgaagtcggcgctgacgaaagccagccgcgagatttgaattcagaggatatgagatcgaggatcatcgagtcggggacaaggttgccggactgcattgtggcttctgcttgaaggcctgggtgcggaaatcgttagacagattctggtttccacgcactttgcaaactcaaggtcttaaagctcagaatcacttacctagaggtgtcttccgccggacattttcacgaagaaggtcgccggagctaattgaggcgagctctgggtatctggtgaggagccgctcagtttgcgtacccttgccgacaccaggagcaccgatgagaataatccgggctgcttttctgagctgccggattgtggcggtcatttcgcgcgctgctcgattatgctatttgtcgatatagtgttctcggggttgaaggtagtccggtgctctggtgcagccgggtcgtcgaatatgttgaaggtagggcgaaggtaggtacctcaacaataagtctagggaaagtggaggaacggcgggcagactatattatctccattgcggcatagggaagcagttaacaaagtgtagacagggaatgcaggaccggtagaggaagataatagtgcgtgcagcttatcgggcaaggtcggtgctcagctgatacgtcgacaaatcttaagccggggaaagcacgcgcttccgtggggtttgtagatggttccctgttcaggaaatcggtgagcggagatcggagcgtttcccgacgcatgggatgtcggcttttggcaatgcaattgactgcttcttttggagagctaactccgaattcgggcgaagacaagtatcatgcagaggggcagacaacatttgctgtctcacatgctaagtttacgatctgtttgtgggcgtagagtatagggtagtatctctacagggagcctcggctttcttggtatattcattccgtccattgggcgtagcaactacggtgtgtagggtactaggactacagataccagatacccagcaggcagagggaagaagaatggaattggctattgcaaccataaggcttcattgtgagcctgtgatgacattactggcaaagccaagcaatatctccctattcgagtatgacactagcgggtgcttcatatggtatgtttgagacgcagctcagtacatactcgtgaatctctttacactgtaaataaggccggtatccctgctgtcaccgttgcggtgttgacatgtcctaatcgagctttacattaatttgtgtatcacgtgatcatggcgcgtgtccgccgcgtttcgcgtccgtcgcgcgataggccatccagcatgtgttgcagaactgcagcggatcaagcaacggctgagcatctcaatagcgttcatatcgctgttggaaaaaaaacaagatgatccggcaagacttccgcagaattgacccgaagagaagggcaaccctcgaccacaaaaagaaacaattcgcgaccccggtcttcaagcaacaggactatccgcatcgcttaaacttctatgaggtccccccgaccgacgagatcactctcgaacaatttgagcaatgggctattgatcgattgaaaggttacttaatctccgatcttagtgtatcatatatactcacaatgttcgacagtcttggctgagattgaagcctgttcttatcgaaacaagtcgccggcagagaccgaagcgcatatcactcctcacctccagaaatatctccctctatcctccaacacatcctcctctaacggcgctgcggatcaacgattgaagaatgaacgccagaaagatcactattctcactttattctacgcctggcattctcggccacagaggaactccgtcggcgtttcgtgagagcagagactatgcttttcaggttccgcttccaacgcgacgacaccagagaacgccgcgccttcatcgagagccttaatctggactgggagcctgtggatgatgaggaaaaacagagactggcggaacaattactcgccgcttccccgggtctacgtcgcattgatgatgagacctggtacaaggtggactgggagaaagtcccggagttggtagagagacgggctgttttcctatccaaggggaaagcatatgtgcccggtagggagcaattgagcatgatcatagcagaatttacggctcgattggagcgcgctcttgaggtatgtcagagcagtagatatggactgttttatggtactgacatctcccagctcacaagtcgggcgttgccgcgcttggatgaagatgatcgcctcactccaattttgaatcacctctcgaagaactttggaagtgccgagtcggtatacacggaaaacgagggatttgttgatggcgccccgatcactgcgaacaacatcgatcgactatctcagcatttcccactatgcatgcgcagtcttcacatgaacctacgcaagaacaaccacttgaagcactacggacgactgcaatataccctcttcctcaaaggaattgggctgtcgctggaagagtgcattgttttctggcgccaaggcttcaaagggctcactgacgacgaattcaactcgcggtacaagtacaatatccgccacgcttacggcgatgtgggcggtgatcagaaccgcagaggccggggataccctccgtactcctgccagaagatcttgggtgactcgaatccgggagtcggacagacccatggctgtccgtaccgccacttctctgtcgataacttgatcggtcttcttcagtccacaggagtcaatgacagagacgtcctacgtggagtgcgagaggatgttgagaagatgcgtttccatattgcttgcaacagggtcttcgaacatacccacaaagcagatatcaagagagtgaaggaagacggtacatggaaccaaactgacctcgacaccatcgtgcaccccaatacctacttcaagcgcagctatctcttgaagcaaatggggaaggcaccaaagaatgcctaacatcactgataggtccacgaagccacgttcctttcttgcatttttgttgtcggtttgcggatattccaccatgcgggcgttccgggtcaggctgtttttggaaatgggtagacgctattgatcccacatttcataggtagatattttatgtataaattaagagcatggaatgcaccgaaacatttaatacagagcgcacatcaattgctctttttacacgtaaatcgtaaatctactatagtagcggtgatagaagggcatatgaccacagctgattcccagattatccaaaaggaacaaaacgtcctttcaaagccaggtgcccagcaacgggtctaatttactcttcgctcgacactttagacaaaatcaccaactgggtggatggaagctgccatagaaaatgaaaggagtcggcgttgtgaagaatatttggaaagaaaaagaagaaaaaatgttgtggagggaagaggagcgggtatttaaagcgcactagcgcggtgtacgggtgcccgcagcgaccggtgatgctgcaacctggccttatggcaacaggtgccgcttcacacaacagtctcctgatccccgcatagtctccggacaacagctgctggcgttgcccatactgtgactgggttgtgatataggagggacctcctgcaaaccggtctgtgttgtttgaatttgttatttctggccttgttcctgcccgattagacctcccctcgttatcttccagttacggaatcccgttccccccaggccgccaacatggactacgaagcgttgaaggaccaatggagtgatgtcgaggatcgcgatggcatcagactcagctggaacacgtttccgagctctcgcatggttcgtcagatctatggaaccctcttccctatatctgctaacttatgcttcgacaggaagcatcccgccttgttgtccccatcggtgccgtctacacacccctcaaggagaagccagactctccgttgctacaatatgagcccgtcacttgcaaggcgccttgtcgggcggtgctgaatccttatgcgtatggcttcctctcaactgctagcaggcatggctatatgaacgacttggctgacatcgcatagcaacgttgacgttcgggcccgcatctggatatgccccttctgccttatgcgcaaccccctgccccctcactacaaggatatcacggagagcacgatacccccagagcttcacccgatgagcacgacaatcgagtaccaattggcacgccccgcccctgctccccctatcttcgtctatgttgtcgatacttgccaggacgatgacagtctgaaggccttgaaggactctctgatcatgagtctgtcgttgctgcctgtgaacgcgttggttggtctgatcacatacggtacaatggtagggacacaaaccattcatctacatttggttcatgtcaggatgcattgttgactgaactacaggcacaagtacatgaactcggctacaccgagtgcgccaagtcctatgtgttccgcggcagcaaggaatacgccgcgaagcaggtccaggagatgcttggtcttgcttccggacttcgcccgaacatgccccagcaacccgcgcgtcccccgcttggccctgcggcgcggttcctccttcccgttcagcaggccgagttccagatcacgaacgtgctcgaacagcttcagcgtgacccgtggcctgttgcgaacgacaagcgacctctcagatgcactggtgttgctctcagcgtcgccgtgggtctactcgagacctctttccagaatgctggtggccgcatcatggttttcaccagtggtccggccactgagggtcccggccacgtcgtcggacctgagctgaaggagcccatccgttcacaccacgatattgaccgcgataacatcaaatattacaagaaggctgtcaaggtgcgtgctgacccgacttgccttgtgtgctttcacggttctaatgacgtatccagttctatgacaacatggctaagcgtgctgccaacaacggacatattgttgatgtctttgccggctgtctcgatcaggtcggtatgctggagatgaagaaccttgccaactacaccggtggacatatccttctcacagacagcttcacctcctcacaatttaagcagtcgttcgtcaggatattcgacaaggatgctaaggataacctactcatgggcttcaatgcatctcttgaggttctgactaccaaggagctgaaggtcaccggccttattggtcacgccgtttccctgaacaagaagtcgagctctgtcggcgaaacggaatgcggtatcggcaacacttgcgcatggaagatgtgtggtatcgaccctgcctcgagctacggcgtctacttcgaaatagcaaaccagggcggccctgcagcagtgcaaccaggccctcaaaggggaatgatgcaattcctcacatactaccagcactcgtcgggtcactaccaccttcgggtcacaacggtcgcgcggcccctcagcggtcctgcgggcgaccctacgctggcgcagtctttcgatcaggaagcagctgccgtgttgatggcccgtatcgccgtgttcaaggccgaggtggacgatggccccgatgtgctcagatgggttgaccggatgctcatcagactttgctctcgtttcgccgactaccggaaagatgaccctacgtcgttccggttggagaagaacttcaccctctaccctcagttcatgttccacctgcgccgaagccagttcttgcaggtgttcaacaactcgcctgacgagactgctttctaccggcatgtgctcaaccacgaagatgttggcgactctcttgttatgattcagccaactctggattcctactcccttgaacacgaaggaagccaacctgtgctcttggattcggcttctatccagcccgctcacatccttcttctggacactttcttccacatcctgattttccacggtgagactatcgcggaatggaggaaggctggttaccaggatcaggagggctacgagaacctgaaggtgctcctcgagcaaccaaaggaagacgctagggttagttttataccatatcaattttgccgggatacaggctaactaggtacacaggaactgatttccgatcgtttcccgctgccccgtttcatcgtttgcgatgctggtggctcccaggctcgtttccttttgtctaagctgaacccatctactacccacacaacaggaggatacggcggaggtgtgacgtcgcagatcatcttcactgatgatgtctcgttgcagacttttatggaccatctcatgaagtaagtccttccttgatcaacacaaagatataaaccgttgctaactaggtgctttaggcttgctgtttccggaaccagctagatttgacgaggtaatggccatgacgagagcaaggggcggtttgcgccagtcctcgggtcgtttgtatctttagcggttattgatttttgttcgttaccctggaatatagcaactacctagattcaccaattgaatacaaacaaatttcgtaatatgagtggatcatggagtggatcagttaccattatctttcacagtactaagtaggactatttacttagatagtagtagttaccgtttcgggaagacagctcatagtcccaatatggtcacgtgatttacatgggttgagccctacgagacttaccgcttctgggtctcgcttagctcaggcgcaacggcagctaaatatccttccggcctcgacggcttttttctttccttctttgtactatccaccccgacaccttccaaggacgattgacgacctttcgcactcgccatgcgtaagtatcatctccttggtgaaatcgaataggcgaactaatatgtatcccattgggcagctcccaagttcgaccccaatgaggtgaagatcatgtaagttgcatattctgaagatcactcggcgcgatttttgacgcagctgctaacgatcttttatagccacctgagagtgactggtggtgaggtcggtgcccagtctgctctggcccccaagattggtcctctcggtctgtcccccaagaagatcggtgaagatattgccaagaacactggtgactgggtaagcacatcgtccgggtcaaccataggaggttacagtgctaacagcatctttttggtattatagaagggtctccgtgtcaccgtccgcctgaccatccagaaccgtcaggccgcggtctccgttgtgccctccgcctcttccctggtcatcaaggccctcaaggagcctccccgtgaccgcaagaaggagaagaacatcaagcacagcaagtccatccctctggacgagatcatcgagatcgcccgcaagatgcgccaccgctctcttgctaaggagctcaagggtaccgtccttgagatcctcggtaccgctttctccgtcggttgccaggtcgatggccgcagccccaaggacgtctccgacgacgtcaaggctggcgagatcgacagtatgttaaccaccatacgatatctttcgagactttgccactaactatttcgcagtcccctccgagtaaatgattcaaattcgcggcggtcgtggttttttaccggcatgctagttacggaatatgatcatcttattcgaaacaaaattgtcttatgagacatgactttagattccccatttctgttctttcgaattcgataagtgttttcactcgacgtcctcgttgagactccccttctctcttttcccgtctcacatatggtttacttgccttctatgcaagctggatcataatgagtccccacccagacgacctttgcaacactctggcccttaccgtcttttcccgccttcgggcctggaattgtcatatcacaacgtggtataggcttattttaagcaaagaagagcaaatcgacctgctactcaccgcggtatcttcgaggggagcttcgtgcttctttctgtggatacagtggtccatttaacggtcaaaatcacaatcttagccccaggcatgtgactatgtctgatgatcgtagacaattgaatcaattcaagcaatgaaatttactcttttccatccttttcaacttttgtctagctatgcctcggtaaagtgatcaacccgcggtccttctgaagaaatcgagtcttgactactaccgcctgaacgatcggcatgtcccatgcgtatactaaccatcactattgccgtctcgcgcctgaagatggagaccaacgccccattccgtagtccactccatgcaaaccatacaccaggacggagaatctagtgatggtgagcatcgacagtcgccaaatagacacatactgcgtaggctggaatcggatggggccgcgcccggacacaccgagagcccgaagattccatgagctttccccacccaccggggacttaagtactactactaataactactgggatggttcaattggcggcgttcctgatacgcgccccgagctgcaggtgccgcctggggcgccccccttaacgaacacaaatcccgggtagcggtactccgtccgtaggcagaaagggaaatgaatgaccgaatgaataataatggaaaaagaggcaggctatggatggctacatggatggggagagtaatggatctctcaagtccagcaaagcctgcaagtgtctccatcggaagggctatggctgcgactcagaatgcaagttgttgttgtgataggcacagacaggcgcaccgacatgcataagactgcatctatcccactttagtgagttgatggaatggaagttatctttctcgtgactcaccacttgagagggagtcggctgagtcagccaggcaggcagtcaagttcaggccgtgatcatcaaaatctcttttcttctggccagctcagcaggatggaatgaagtgaaatgctgtccttttgggaagtgaaacatggcgggaggacgggtgcagacggggtggatgtgttcgattccgcctccatacggatgaatttgctatgtatgctaactatccaactagcaactaaccgagataccaaactaactatagcgaaagatatttagttatcattaaatcaacggccacaaggagaagattaatgaatttgactttcgccatctcaattccccctcccctcttttttattttctctcctccctctcagctagttggtctactaagtgtagttactgtacaactctcctctcagacaggaccccctcctctaagcgcctaccggagtggagaggcaggaagagccacagcgcagcaaagtttgccgatcctcatcgccagaccgctcgtgacaaggcccatggattatcacagcctactcttcttttattattctatttattttattccatttttgatttccagggcggccccggtcccgctgcccctcgttgatccccgtccctactaaaaaagtttctgcctttacattgttttctattacactgtatctggacgacggagatgaccggacggtggaaatggaagagggagaaaaacttggaatgccggtaacacttagatctgtggtcaaagacgatggctggaatcgccctgtctaagtggatggggatacagtgaaactaaggtaggtttcatggatccctcctccattcccgagacctagattttgagttacaccgggggaaaataaatttggggggaaatgggagaggggtgggaatttaaaagtataatgcatcatgttgatgtgttgttgttgttgttggttacataagggtggaaaagggaggcctgatgaatgaatgatactttgacaccttcaaatcaaatctacgataatctttgatgtatggtgtgtaggggggatatggattggctgatatcaacatttaggcacggatggatcaaagcgacagaaaacgctcagcagttgctgtcacaagagagaaggcaacctatcagaatcccattgacagtcatctcttttataacggcaccgcgctctgtaccacatagtgcatacttattatacatattgacatacctgagatatttatccagtggcaatgattcggccatcttttccacctgatcggacgcggcatgcgtcttagttgggattttcttttcagcctctggatgcctccagggctgcagaatgatgctggccttgggcttgtggccagatgtctcagcctcgcggcgatgtatacgcataatatactaattagctacttactagtatatgaaggattctgctaattcaatcttgcttctttccttgcgaaattctcctatttgactagtagacaagtcttcttcagatattatccctacatattaatcggcactgctcaagtaaattgggttacgaaatcaatatcgatatacatatcaataaaacccatcctttatatactatatatactccggatatacaaagtaatatgatacttataagatattcacaatattgattgattttatttaatctcaaaattatgaaacccaccttttttttctagtttcattccacccatccaaggccagctcgcaggccattccttgacggactccactcgaacccaccgaaggtgccagatcgcccttccgcactcaccaaacaaaccctcccaaactccaacttccaagaggcccccaaggccccaaggcttgaccactgcgggcgccactcgcgaccgggggggccatggctgctggtccactgacgttagactggcctggattcgctgcctgcgcccaagtggctagcgccggtccatcctggccgttggatcgtagtatcctcgggtgggactgaaatgtgatggatgttcgtgtttcccttgtttcgcggtttctaggtgggggtgagaaaaaggaagaaaagattattgagggttgaggattctgagaatttgcttgctcccttggatcggtcgcatatctgcgttttgaggcaccacaaccatccaagccaccgcgtgttatacctttgtgccatctagtaccaaattttccgccctgatttagttactgtacctacagaggggaacatcaataagatactactgttaagtactccgtagttatccgttcagagtaaccaatttgcacacagtatggcgttcatacgtaaatgcatgtacctttttcatttttcttttgtccatccttattacttcatgatatattttccctttttctctttcgaattttgatttttctgctgttcattttcctttccccccctccctcttcctctcttctcatttggtcccaagccaccaccaagtaatcaacctggacgcccaaacccacccgcgtcccaactcagtaacctcctccccactccaccctggtccaggccagcgcctattggctccactcccgctggtccatcctcagaacccactcaggttgccctccccccaccccaaaaaaggaaccaccctagaacaaaacgggagctataggctgccgccgcccactgcttgcgtttaggaagctccgctctgtcatgatgcgcgtcccgcttgatggagactttggctcgtcgatgactctttgtctgctacattagtgagttagttagtagtagctcactgcccgtatggatatcttctgtgaaagaaagtaagtaagtagttggccttttgattttaatttttaatttttccttatttttttaatattttcccccccctcctaagcttcaattccatcctcttccacttcaatcggaattccctatcgaattttatgatccgtttcctttaatttcctcccgttggtcgcatacctcttttttctctcttttctttcttcacggtcttggccagtcctaccccggactcaactggctttttctttttggtctcttcggggaatcatcagcaattccttgcgcctgttcttcatatttgtcccctattgattgttgacctctccgcccgccgttggatcttctccgcttcgaacagccagccctgtggtgccttggatctgaggcatcgccgtttggaatagtacttcggtccaatcagctcctccccaacctgtgagggaaaaaaaaagagatcgtcaaaaagacaagaataattagacacgaacagaagaaaaaagaaaagaaaagaaaaacaaaaacaaaaacaaagatcatttaattttttttttttctttctcatatcaaaagacaagaggacacactaagttgttgtgattgccagcagctagtggtgccatgttcaacctttcccctacgctatcgtttccctgattcggatttcgtcggtcgtgacatcggggcagatctgggtcctcggcctctttaatcctcctctctattcatcttgcagttcttcctattctttccctaccacacttgcgttagccattatccatccttcaactaaacacccgtttgttcggtcagcctacctgccggtcactctctttttcccttttccctttgaccccctctttcgcaacccacacccacccacccaccccaaagtacagcatttctgccaagcgcaggattgcctagtggttgatcgcgtcgtgcggacacctgcgtcagtgtgggcgctctagcaagctgactagggctgtgattctctctcatcgatccctttccctcccttgcatcgtttcttcacccacctgtctctcacgcagcaaatagcgttgtcggtgcggatcgcctgcgtgtctttctgatcttctggaatccagcggcttcgtgaatggtatcttcgccccggactcagcctctccattcggttccctttcctcttcctcctcttcttcctcctccatcactttcgccgcgcccgcacttgcgtcttctgtcattgccggctacaatcagcgttcatgtcgagcccagggtcaaacggtgggcgccttcgctgagtgtcaactgagccggctcatgcccaggatgaggtgtaggaaacgtttcaaggaggatgcttgttgataatttatcgagagtgataaccccgtcgaccaccactgtctgatttcgatcgccccgaaccgcctcgacgagatccctgcattgcttctccctattcttgatactccgagtccctatacgtctccgtcgcggtctctccctccctctctctctctctctcacacacaaactcgctctttctttcttttctcctctctttctccgactttcaaccttgatcttgcatatatatctataatcccggcggaagaaggcggtgccaatactgttttgaggtcaagatgttgccctcagtagcaccgttcccgccagtccagccgcaccaccttagttatcggcacggtgccgacgctacaaacgggccttacgaccgcaacacatcatttctcacgtcactaccccgcagcgatttcggcaaagactcgttccagtccgtagctcgatctcggctgcaatatccgcatcctattcaacgcctcgaggtacctgatgccacgggtctggtacctagcccgaagagtgctggcgagcatgcattacgaaggaaaacaccgaacgggacactggcggctgggtatgatggcacaccaggggataccaccattcagcccgcgagcaagcacctcttggtctcgccgatcgattcgggccacctgataccgccccatacagggttcccagtggagacatggcaacaggccaatttggatcagtcttcagccgggaagcacatgaatttcccgcccgtatatcgaaatgattcgagccgaactaatgcaggtccagcagagttgacccaaggaatgaatggcaccagttgggttcgttcattgaactatgttccaggaatggactccatgctgaatcagtcgctaccaatgcagccttcccagcagcgattttactggcacaatggtgcctatgttcctacagttctaccagcgacactccagccctgtgtcggtcctaccgcgtcggcaggaacgggaccatatggtccatattggcccgatggagtgtatatcccgtatcgcccagcggcgtttcgggatgcccgattcgactcgcccactccttttgcaaaggcgacaaacccacccgcccttcaattattcgacgcaggccaacagcccttcagtcggggcgctttatcttcaggcagtcatcccgacccgggcctggcgtggaatcaggcccctgctggaatggtcaactctgagttgtccatgaagaataactttcctcggcgtcattcggagcagaaagtcgctggtctgccgggcggccagcggacactgccgtaccatacgcgccagtctaatcctacccctggcttttcgcatcagcaggtccacgacacaggcccgtcatggtcaggtcctccaaatacccaaggggtccaactgggctctacggcaagcccacaggcaacgaacgtggagttcaaggagaaggtgctgacatgggctcatggtgtttacgttgacctactggcatccatccaccaagcacgacggaatagcatctcgaccgcggctgctgagggacagagtcagcgttttctgaaaccgagtatatacccgaaaccaccgcgtcagcctggtcttgatttttccaacactaatacgctggaatcgactcgtcacaataactactcttcgggccagcatgatcttgttcagaggaacaacaccattggcaacataggccacaatgatactgccagcttccaggctggccgtcggtatgaacgtgcttcactgtctcagttcccgcaagctgcaaccgatgtacagatgctcgacaggctccgccacactggacggtttactgcatccacggcaacgtctcgtttcggtgccgcaccgttgaacgagggttctataacagcgaatgctgtttcatctttggagatgctatcccatctctgcgcggagagcggttgggaatggattgatgggatgcttcttggaggctgtctcgcttatgggcttggagattaccataaggccatgcgttggtatactagaatcatcgctcgagatgcaacgtgagtatgcgattgtctgtaagtagctgagctgtctaacaaagcacaggcatgtggaagcgatatccaatcttgcggccacccttctggcgctggatcgccgagatgaggccctgcaacattggcttcgtgccgttaagctccgcccgagtttctttgaggcggtagagcacctgatcggtcttttgtgcagcagccaacgtggcaaggaagcagtcaacatcattgagttcgtgcagaattccatacgctcccctaagaacggcgattgtttcgcgtccgacgaacacgcgagtgaacctgagagcgacgcggagagcagagcgtcgagtgcgtccgatttgggttcctatgagaaagcgtcctttgattacgatgacgactttggtcggtcagttgccacaaatcggggctcggcagatgttggctcggctggatttggttccagcggctacgccatacctggctgtgataatggcagaatgctggctctcgtccacgcaaagggaaatatgctatatgccctaggtgacaatgctgcagctgccgtagcctttgaggatgctattctgattgcagctggaaggaggcgtcatggtatacaaagcctgatcaagcagatattctcggccttcatgcagggtacgcatcacggctaccccggcccagagcaacgtgagcaacaggagaccattctcctgtatccagaccatgctctgcaaaccgcaaagttggtctttgctccctgcggaacacccccggggatcaaatatgtgccggaaggtctggcaagaaaggccgctatatctactaccagcaactcgttgctctctctggccaagatataccaagacggcatgtctaatatctccagctccggcgttccaagatctgctccgggcgttcgggatattctagcactctattatctttccctttctcttcagccaagtccatccaccgcaaataatgtgggtatcttgctggctggtattcagaacaatgcccccaagaaagttctaccacgtccaagcggagagatgcagcatcctgaaatacccggtgtaattcctggcacgggaatatcgttagctctcgcgtattacaactacggtctacacctcgattcgcgacatgcccatctttacacaaatcttggaagcctgctcaaggatattggccagttgcaagcggctatccgaatgtatgaacaggccgttcattgcgatagtaactttgacattgcgctggcgaacctggcgaacgcagtcaaagatgccggtcgcgttaacgatgctatcgtctattacaagcgtgccgtcaaagtgaatccggaatttgctgaggcagtgtgtggcctagccaacgctctcaattctgtctgcaactgggttggccgcggtggcgttggcaacggctatgggttccgagaccggtggcatgtcgatgaacagggtatgatccgcgacgcatacaccattgaaacagggactggctggatcaaacgggttgttgagattgtcgaccgtcaactcaaagaaggggaagcgtggggtcgtggtttgctgactcccaatgtgattgagcagttgtgtgcgcaactggctcccgcagccagttcgcgcggccatgtcacttttggtactctggctaaaatcctgcaggcgtgggcaggccagcggtgggagggctctaggattgtgaggatcgtggagcgtgccatcaggtcgattacctggcagtggtatcaggatcggtacgtctatggcaaagaataccctctgaccaagtatcggcgaccgcagcttccctctggcctgacggcgccaaatgcgccgacagtcctgcctttccataccttcacctgcccgctgtcagcgaagcagatccggcaaatttcgcagcggaatgggcttcgtatctcttgttccaccttgcgttcgccgtggctgcctgctactgttttccctccgcctcccccaccgcacccttacatcaaggtcgggtacgtgtcatcagacttcaacaaccacccgctggcccatctgatgcagtccgtctttggactgcacaatccttctcgggtgaaagcatactgttacgctacgaccgtgagcgacaagtcgatccatcgccaacagatcgagaaagaagcgccggtatttcacgatgctagtggatggcccgtcgatcgactcgtcagacaaattgtggaagacggaatccatatcctcatcaacctgaatgggtacacccgtggtgcccggaatgaggtctttgctgctaggcccgctccaatccacatgtctttcatgggctttgcggggactcttggggcggaatggtgcgattacatccttgcggacgagctctctattccccccgagaccctttcccctggacggcgcaacatacggatggaggatcggctactcgaagaagaccacggtgaggatcttgagaactgggtgtacggcgagaagattgtttatactcgcgacaccttcttctgctgtgaccatcggcaaagtgctccggatgctcaagatcctcgcctggcttgggatcaggagcaggcccgacggtggcgcatgcgtaaggaactgtttccaaatctgagcgatgacaccatcatacttgggaatttcaaccagttgtacaaggtaagtgcaacacaggggacgacaggtcaggccaaactaacagttctgtcagattgaacccacgactttccgcacttggctacgcatcctggcacggatccctaatgccgtcctctggctcctccgctttcccgacctcggtgaacagaaccttcgtgagacagccgttgcctgggctggggaggaaacagcatctcggatcatcttcaccgacgttgcacccaagaacacgcacatctcgcgagcaaagatcctggatctgttcctcgacacgccagaatgcaatgctcatacgacagcgaccgatgtgttatggagtggcacgcccctcttgaccctgcctcggtacaagtacaaaatgtgctcgcgtatggcaagcagcattctgagcagtgctctgccgaagtctgacgcaggccgcgaggctcagtcggacttgatcgccatgtcggacgaagactatgagaataaggccattcgcctgtgtctcagtctgaagtaccagcctggtggacaaggtcatgcgacgggcaggttagccgacctgcgccggatgctgttcgaggagcggtggtccagcaggcttttcgatacgaagcgttgggttcgtgatcttgaggacgcctacgaacgagtttggcaaagatgggtgaatggcgaagaaggcgatatctggttatgatgtgcgcatcagaatataccccttgagcgattctgtttctcgttggatatggtgtgatgtttatttatatttatttgtctcgattctcggcatgtaggtctatgtctgtgcatatgacccttttggtctgtcaattctgggtattttgatcttgtgtgcgtggaatttttgcatattggcgttggatgtgtgtgtgtgtctaaggaatggatcaatgatgatgacatccccggaggctgtgtgattgtgtatcagcagcttggcgggcaattgttttgggtttatgacaatgattgatatcttgggtaggcgttgtggttgagatgatgcctggaactccccgaacctgtcgggttgagtgttttggagtagcgaatgatagagcgagtggtgcctttggatgttatttgaatattgtcatgggcatatgccgtatttatatttactatttgctgtctgtactgattcgatgagctggtgtctaggcagccaggcttatgcatgaacagatttacttctgtggttattacagagcactgactcgtactaactatagatgatcactgactcttatgtcgaatagtgtattcaactgaacttactcatcccaccatgcatcctaattaattcataacctgcacctccgatccaacacattatagggataccaaccatcttcagtaacaaaactcactatgagcattcgaaaatttcttcaagctggctgtccgctgtgaaccctcgtaaagcaatcggaatgcctcgggctttcgccatcatatcttctattattgtcgtgtatcgttgaacctcgactggaccaaagtcatgggagtttctctgctgctggggtgcttttgttgctggggtgcggagcttgcgctctttgaatgataatagcaccaatgctatatcaagcgcattgaaataattattgaagcactctctggccactttgactgcacttcgtatgtcaagctgggttgttgtatgctcattggaccatgctaaacgaagagacccaacacggttcgtccataagttcctcgaagcaggatcccgaaattcaggataaagatcatataatcccgcgtgaatgagctgttccagagacaccacactagaccgcccagcatgatgcaataccccttgcgacagatactctccattgtcataatatgggtcctctaaacgaaaatcaaagaacctccgcctattctcatcaagttcaggagcatcacgatacgcccgaagtagcgacttgtcccgggcgaactgtccacgagggaacttcctcgtgtcaaccatgcatattttgacctcggaggggtcacaccgacgtttgttgcatctccaaatcgcgtattgaatgacaaacatcaaagaactactccacgacattaagttgtcggtgtcctcagctccaaacaaagattttttgagatgactgtatagcattcgtgttatttcccctctcgaccgcgagaggagatctgttctgctgcgctctgatattgcggctcggctctcagcagaagctacaatatggttgtcactccagccagagcttgcgtcgtcaaacgctcgaaacaagtatcgcggtacctctgccagatgagaattgagaagactatttgctggcgaatagaatagcgtggtgggctcatcaggacattgacccagtgcacgaacccaaaacccgatccattcttccctttgctgctgctctctctcagctctgcgctcgcattgcacgcgcaaggtctcagcatagctatcgtcgatagcaagtcgattttcatgctcgtagtattcctcgctttcgaagtcaggatcatacggctcttcgagactagcttcctctagagaatcaaagtactcagcggggtgcagagtcccagaggcacgaagagactggtcatagcagttttccaaaatctttcgcacaacgctgcagtcgtcggtgttggcatcgtcaagcacattgcgaatgatgcgcctcacttcatcactaaaatgcagtaacattttctgctccagcgtccatggaccagccagcgatataatgtacgctatgatgtaattctcagtggcatcgctgaggttcttcgtgatctgctcgagggcaacggcttcttttctcaaggagctcagtcttgcaatatcctggccgctaggggtctgtgtgccttcgatcacggtcccaacatgtgctgcgtttgctgaagtggattggcacgattttaccagctcccaaatcgtcttcacgagggtttgagttgggttcgagcagtgagaggttgatctatcggcaaggctcaatccaccgattgtatcaacaagcttgttgaactgttcagccatgattttagaatgaagagaagcctagaaaggatgccaaacaataaactattctctcgacaatagggtcagcgagttaaaaacggtcgcagttgcgttgcggggtgaggcaaaagaaggagggaatagctaagttgttccaatgaaagcagaatatatttctggttataggcaaatttatatctcatggccgtcatgttgggattaagagagcctcgtcttgatcctgtgccaggcaccagttgcggctggcttcaagccttgtggctatataagtccatgtgactggaaggcagcagtagaagtacatgttggggcgcagtaaatcctcgaggcgaggtctcagaaagaagcagtcccgccattcctaccacctctatggttgacacagacaacagagacgacaacgaggacaggcacaccatggagtatttggcgccgaacacgctgagcattgaaatgactgtgtatgtatgaactacgtatgtaccattgtgggcatgcaaacatcaacaagttggctggatggtgtagttggttatcacgtatgcttcacacgcataaggtcctgggatcgagccccagtctagtcacttctttttgcacttttttttttttccgcttgccgttataaatttttatctattggaacatgttttaatgtatgctatttggcttaaatacttttttgtattttcatttttcttggagttgtgtcttactgcttgggtatctgggttgagttacccggcgctcaacatgattccgctactatcatgatggttggtatatattcacgcgggccctagagtggatataagtatcccgtggcatttatttatctcgaatatgataatttcctcgcaaatgaacttgaaatacgctgtctaaagcccatctacaccacccagattaaacgattgctcatcaccatactatggtcacaatacccctcagtctcgttctatacccgatacatcccgcctcatatattgcaatccatgctttcagtctctaagctgtgcatccacccgccatgaatcatgcatgcacaggattgtcgacttgattacaagcagaatacctgctaaattgatatgatatatgatgtttcatgaagatgtgctacggtcacctcggccaagggcgcctgtctaatgatgtcaagagcaagagaaacagcaaatgtgtttggtgtttcatttagataggtagatgatggctgatcctagccaaggaaaatggatgaaaagcaaacgggagaacaagtaagaaggtagaaaaggatactcgatcaagaagatgcgggtgttggaagcacctaaatacggcgtactggtttctgacaagcgcctgcagctgtgtagagagatagtaagggagaagccggcaacgatcgagttgagatacatccgtataacttctgagcagatacattcccaactcacatatactcgatctgttgaatattacggagacagactggcttggactggagacatgatgctatcttaaccaagatactgcgcgtgtttctcctagggacctgtatctggtattgtgaatttaatgcagatgtttgtacctgtctttgctgcatttcttagtcgcattggatgaagctagaccactgaaacccagtcaaattaccttacagtttgccccaaagtcgactggcaagacagagaataacccttgctaataatgtccgaacgctgtggtggagtgaaacccgaggacagctactgggccattcttttcccatctattgtttcattaggtgctgtatgatcgaccccggaagcgtacttggcacggctgtagacgtccctagacactgtggttaatggtttgaatgatatgggatagtaacctgttatgtgttgagaaattctcgcaaagatgattctgacttggtagtgaaagccacaagtcccggaaaagatgctgggcatatccgatgtagaaggtactccattaatctgcctatggtaatatccccttagctgtgacaagattgttcaggcaacgagatgattctatatagacatcgcagcagacatcgcagcacatagcgcaggcgacatcacttggtaatcttgaatattattcgtagatacactgtcgcttgtcaccattgatgagagaaatgagattcaaaaacattattcccgtttctcaaatgatcttcggacacctagggaagccccagtaggaataactgcaggataaagtccgctgccgcgagttgctaagtaatatatgttgggacatacctctccgtatgacttgagtatacataatcgagatcaattctggcctacttggcaaagctttgacatgtatgaacaatttcgaagtttcaggtgcctagtatatatttacgcccgactgtgagtcgcaatttcggccatcctgtagtcgttgatgttgatggaaaactttctttgtaacccagacaggattcattgtgccaatctgcattggtagctagattagatttgcgacggaaccatataagggagcatctggtagctagctgtcttgatagggctgtatgcaaaacggcaaaaatgtcgtgctctaggtcattcaacaagtcatgcgaaaatatggggagctgctacaatgctttcaacaatcaaggtagcttagggcccgaggcatgtacctggggattttctctgtggtatgaagtatcctagaaaagctcgataagtccactagaccataagttctccaagaagcagatatatttccagtatcgaaatgtgtccctaaccaggcatctccttcttgtgctttactagcgtcattccccattataatcttctatctcgaatatgcccaggcttgtatgttggacgacatgtcttcctttgtatctcacgaatttcctcagatgccaatcatggatcgtggtagacgtgccctcgaccgagccgagatactgtgtctgtggagcgtgtaggacggagggagaatgggccgtatcgacgcatgtgcaggatcagctgccatgggagatggataaccgcgtggagtaagaggaccggtatggagtgtcgacgatggcgatacatgctgctgtgattgtatttagcatgctatgtataaatagtgcggattggctctttgacggatatgtagatgaggacggcgctttcctggtatgctcaccccataagactccttcacttgcatatgcggagtataagaaatggatcatgattttcttgcaaacgaggttttgcagagcaagagttgaacgacctagagaacttgtccgattagtggttgcagagctagctgctaggaaatactggtagtggaagcaacggggcaaagccaactggtgtgatctgagcaagatattagccgacccataggtagtccccaagtaatttggcaacttcttctaagatagccaacgttcttgcgacacatatgatggtctctcatgcagaggtatagcttagtacttctccggtcatatataaagggatcctttggccccaaggcacatattggtaattgaatcaacacattgatccttctggtgcaagagcacaagaaggccgtatccgtcccccaaaatggagcgagtgagatgcgttggtatccgatagacactataaacaacgctgtcgctattagtgttgcatgtagacgccctcacaggccgggaagctgcttattctcaatccccattgcctgaaaatgtggatattccatcaacggaagacgcatcctcagaatcggtaggattctgctctgagccgcaatatggtattcaaagaatgccatgatgtcttctgtggcccagcgtaaacatcggcgctagcaccatgttcgcacatgttcttctatggttattcgatctccttgaataacgaagatttgagaattctgaacgcgcgcagaggtcgctgacgggttgctggcgaggagtggtagaggatgcgatattttttatctccttcagggtctgtaatgttgagaatcagcttcagtgtgggatacatgtttttctgtgatataaagctctttgatactgcactattgaagaatataagaagagtatatggtatttttgctaatagagatcgccccatagtgggatatgagcgaaaaggtagactaatgaggagcgacttaggaatatacagcacttgcctgtatctctataatagaatacaatgggagtagagaggagaaaagcaatggaagcagcagatagctacaaattaatacaaacctctttctatcactgtgaagccataattcacacttatagaagtcaatatcaacatcattcatgtccgtcattgactataccaacgcctacactcacctcaagcagtgactacataatactgaatcatgcataagcatcattaactgatcacaagacatcaccccctctcccaggcatccgcatccattcattcgccacttctgacctatccagcaccatccatccaccacgcccaaaccgtactttcatccctcggccactagatggatagcatcgtgtgggacaagaacccggtggcatcacatgcagcctccaacggagaattccaaatccgcatgccttgctgcaaaggtgcggtttacaacccgcgtgcagggatagtaacgaccgtcgagccagtatgagcacctacctcctcctcccctcctcctccaaaggcagcaaggatggcgtatgtatgacaataaccagcattccaatccttcgatgcaaaagcaagcggcttcaacaggtaatccccactagtttagctagcggagggatgggggatggggaacggggatgggatggttgcgtggctcgggatcggggaccttttctcctcgccttcggggtttatcatcgttggttagttgggttatccgtcaaacaggctggtcgtgatgtcagctagccagcctcactaactacgccaacctgagtctgagtctgtatcttcatggacgagtcgagtggcactagtgaagaaagatttttgggttcggttagctcgtcttctacctacataagtgagtagactattcagtggatgacagaaaaagaccctagctgaggctatgacactctataatgagcagcgtagatattgaaaccggatcatacaaaagtaaaataatcattatctcttctcatcaccacacacatggcatccacgcttggtcagcgatcgataatcgcggagaacaaagcgatcacagagtcaagcaggaaaaaaacagggattttctcaatggcactatagacttttttcttttcttttcttccttcaacttgatggcttacagtaggggtcacgcgaacccaggatcccggttcgtcttccttccttcttcgttccctcgcgacgatctgtcgtagtacaggatcctcttgaattgatatcctaatgggtactagctagcagccactctcgcatcaattctcctctttttcgcgtctcgaggctggatcgtgcgccccctcgactctgacaacttggttggtcaactatcctccgtactatcggtggctcctcatgcagccaatatctcctagtctgaattgaccccatcctgcggtggagaaaccggagtcagacaatcctacatacagggaaccgtggaggatgataccagcagggatggatggatggatgggggctagttagccttgtgcatatgatctggagacagacaggacaggacaggtcgtgctattcggttgtcatgcttatcctccttccccatccatctacatctacatataccgatacatcatgcataatatccctctgatgtagaccaatttagtcaggggaaactggacaaacgaatagacacacagacacatacagtagatagatactatctatctaagaaatacctgaaacccgcccctaccttaatacatctatactatgattctcctatctccatcatactttgtaaatatccatcaggcaatcaatcccacacacgatcaccctcaccctagaacaacccgtcgaacttcgaaacaaagcaaaaatagacacaacacaaacacaaacacgcatccctgcccttttgcctcccccccccggcgccccccttaatgatttgagaaacgcgagtcatgaaacatcctctttaggtgaagacgaccagaaactctgcctaagcgcatacatacatacatgccatacttaacctaaccaactagtttggaaaggtaagtaacctagtaagtatgtcggcgccgccgatcgatcggatcgtgtggcttggttacacaagtcctactttactttcccgtggaatgtgtaaagtaaaacgatggcgtagctgtctattccatttgtccatctctaacccgttacagcaggtatgtacataaacaatcaaataacataaacactaaaaactcaaattcataatcagcaagggtgagtgacttgggtggcagggggggagggggaagaatcaataagtccgatctaatccgtccgtcagcctcgctgccaaaaaccgttgtcgtaacagcatcactgcgagaatgtaagcaagaaagaaagagaaaaataattaattcggacttgcccctagacagacaaagggggttgggtagggttgtgattgagtttaccacataacttacgtagaagagacatgagtatactatagtcatggatgggctatggtggatggagctgagctgagctacttcgcccccctctctcctcctcgcccaatacggatttacgcccatacaaacgcgtaataccattcaaaaacaaaggcagaagtgtggtatcaatacaatacaaaaccatacacgcgcaacggcttgtatctgacaagcccatctccacgtggtttagcaggaactccttacgtagaaggggtttgtgcattgggcgctgtccctggtcgtattgcgtatttggttggcggccctcctccccccttgtatctttgtattgtatgcggttaccaagaaaacacactaagctaagatacacactatacaaggatatgttacatacccacactcacttaagtaacttttagtgtcatacggagtataccgggagggacccacccagttgacaaatacttgtcaatggtgtcggaaagctggtgtgccttggctgaatcgcagtcgcactcaaattgggaaagtggtctgtgtaggtgtgcggtaagtcgactgtccgtccatctgtctatccatcaacaaggtaactatctacttagtgtttttcggggggtccctgcgctcggggagcattgatgcgcttttgcttgcttgctcgctttttatgtacaaattgggaatatgttcattatcatgaaagcttacatgagaattaaactgaaatcatcaaatttcatatacttcataatatcctatatactactttccttcaggtaccaaaaatgacacctcacattacccaacaccatctccctcagtaaagtagcgtagcgttacagaatacgaactaacttgttataaccaaaccacgatttaaaaaaaaaaaaattaaaattcccagcgattagttgcgtttttgcttgccgatcacgggcggaccggcaaggcgggtaccctaatcctaacctggccaagtcgatcatcgatcacccactcacctcccacaccgagatcctccgacatccaatcatgtggtgggaatcggctcaaatctcaacgtcgagactgtgctgcgctaacttagttctgctggtggccagtggttccactctgttccaggggggtggtgtcgctgcctttagtctagtatctagtagactaactccgtagttagactgaaggattagtagagaggagaaataaagacggagtgggattaatggataggtcggcggcgtcgtcgtcgtcgtcatgaccctgccgtactattggggttaattgatggatccctgagtaattagaccctgaagtgggagaggaagatactttgtatgtatctgggaggagaattaagcagtggcgttgataaatagtacgtagtagagatatctacataatgacagtaatgcatgcagtgtctatctaacctacactaagtactaccccaatcacaatgaaatcgaatgatgattacaataagtaccaacttcaaccccctccctccccggaacaatcgaatcaaagataccacccacctcctctcaccacaataatatcgtcctccgctataggcgcagcgccgctatcccggtccgacagacgaataaaaccacccggaaatgcgggcaagacttaactccccttagctagctagctagtagcttactacccattaaagcaacggacacactccgcacttgcacagttaactaacctcatagggtatatgcaaagggaagcaattaatttattcttaaaccatgatttcccctcagcaatagaagtatgaggaggtaaaagtagtcagtatttacgcttgaccaattagcgcgcgggatgtctaatcctctccctggtctccttcgttcagcccgcactaacctaagcaccaccacttggagatggagcgtgtgggatggatggaattgattgtctggaaccttttccaaatttactaaatctgtctttttatttcccgcgttgttgaaactcaacacatgccctagatagtagtgaactaagtaagtagcaatggagctcaagctcaggaccaattttcagatcttaaatttcatcagtcatattaggtaggtggttttgcaatttccatcggatatacccgccgccatgggtaccgctgccattgccatactgcaattatgcttcggaacgcggccaaattctacctccgattagcattattcttgtaccggttacctacctcgcaacgaaagggaaagttcacggaacggtaaaaagtcaatttccatggatgagtttattttaaatgaaaaaaaaggggttgaagcttaaacaagaataaacggtaagaagttaacagcgacccatctacacatagcttacttactattctctactgagtatgctatgcggtaaagtaatctatatcagccactattaagcttgggcactacttatcaatctggataaaactggcgagacagggagggggggtttgtgtcatgtcatgcctgctgcactcattgttcagggccaggctgggcagcaggggaggaggggccagaaggaaaggaagaaagaaagaaagaaagggtgagttgagacccactcctttttttttcctccggttatcgtttggctggcctcatggggtgttgcttacaacctacctaattgatacgttatcattgtcagtagcagtagcagtagcagcggcggctgtattttcccgccttgtgaaagcaagcctcaacagaataaggtaggtgtgtgcgtgccgtgtgtatctatcctatcctatcctatcctatccgcagatacggtacgtacggtaagtagataaatattcttcccgaaagtcccgtcccgatcccttatccgaaagggagggaaaaaaaaaagtcaaaaaagtccaacactccgatatcgaagcccaccaaaagggaaggttcatcagaaataggagatggggggagaatccaaaaaatcctcataaggagaaatactagtttaccattgtgaaccgatagaacgtgtacagtgatcgatctccagcctcgtcctcgtagcgaacaaagctccactactaccaccaccacccatctcatcgatcacgtttcgtttccgatttcaagttctccagattcgatcccatccatccatcccattcgattcaggagaaagaggaggagggtgggaatgcctctctaaccgaatgtaaatcgcgggcacagcgcctcgcgcgaccgtttcacataaacacagcactcggactaagagagaaaagccaacccttggttctgggtcggtcgcttggagaaaggacgttttaaccgcgccgaccggcggtaggtaggtagactctgcctcgcagggaccgcgggaagatcactactcacaggctggggaggggagacgaggttctgagtggttggaagtggatgattacggagaagcgactagaatcgtgacgagagggattgggccggtgggaggagatcaaaccagtgtgggtgggatgaatggatccatggatgaggatgggatggaatggatcggggaaaatcaatcaaatcgttgggcgggcggagcgggcgggttggtagtgatgttgagctttttccgtttgaggaaatcggctagggttgatttgattcgatcagatcgagaggaggtttttgtagatatcgtagatttatttttgattttattttttgcttttagtttgggggtcgtttctggttctgttttcgcccccattctcctcctccttctggtcaggtatcggaagtagatggatgttgggcgttgatggtaataacaacgtctgttatgggataggattgttgttgagtgtatgatgtatgatgtatgaggatcatacgagctcagctgaatggtgtctgcgccgccccctttgggctttggttttggggggaaggtaatagttaggagggcgcagcacccagcgactattggagtggcaatattagacctggaggaggaggcagagaaggagagaaagaaagctgttataaacaatctatctggaacaataagagctccccatccatgcataaatctgcatagctgacgatcaaaccgggtgcgggaagaagggaaaatcaaaccgtaaatctgagaatagttagtcaaactactccataggttggttctcttaggataaaaagaaaaaaaaaaaaaaaaagggatattcgcgcctcaacgcttcaactacaaatccacatcactagtacaaaccaagagttatggggagaagtaacagaatcttactattaatatcggatactaatgtcgcatcatttgggcagaagacagggggtgtgggatgaatgaagaggtgcgccaatgattcaacatctttctcttttctctctctttggctgaacgcactaatccccacagtggtatattaaggtccccgaaacaaccgcatcggctctgttgggcaggcgaccagatggccgatagagtcggcaggggggtttgtgatgggaatggggataaacgagacagctttaaaaataacctgacactgacaaaggtttgtagattgcttcactaaactgaattgttggaggtggattgtttcagctgtcaggatgctatacccggcggcagtagtggtgatagactgcaatatactacaaattaaccataatcaattttaaatgcatccagacagttgactgagcgttgtgcgtgtgtgtgtgcctgggggcctaatcaatttcgaacattaattgttaatatcgacgatcgcttggccggacttgtctgcctgcttggcaactgacgtaccccgtatcttgggtcgtgtgttcagaggggatccatggatgcgctgttggaacttgagttgctctatctgcagagcatccgcagcaggttcggatgctggaacctcattcgatgcttccaccagaataatatgccatcgtggagattgtgtaacggtcgcccagggctccactgccaagccctctctcatccttgaccaatggatcggagaagcggaacatgctcgaaccagaacaggaggaagggggggaaacttggatgagtggtaacgagatgaacagatcggttgtcgttcaccaccctctctcccccataatgtgaagggtgcaaatctcctaattagtccgtctgtcaaatcaggatggaggatcggggatggaactgagggtacgtcacggtgtgtatgtcgcgagtggacggaagtggattagcggggcgctagtgaccagaattccaaatcagatgtaaaaaaagatcagcggtagttaattaatgcgagaatctcttggccggcagggctccagatccagtgcgccggcggtgactgatttgctgctgctgctgctgcttcttcatttcctcactaggccattgttggtgttggtgttggcattgtagtccaccccgtattgtcgaactccttttacttcactggagtactgggttcccgcatggtgcgactggcacggatgtagaaggtcttgtttcatgctatatttgttctggaacttgataagcgattcaacgtcacaagaaaggcccaaatttggtcctgtgtaacccccggaacctttgtgtcagagtatgcctaacctggtaggtgtgtctgtgtatgtggatgtactgatgtgtaacctatgcgtctgagagatatctacatagtcatgcgtactcgatacgaatcgtaggggattctctatcggcaaatggtcgtcagagagggtcactggcgagccaacgtcctccagaacgagctgcatcatccttccctcacccttggacttgactccacccaaccttgaccccggctgaatctgcaccgcctaccggtaggcgagcaggagctggtatgctcatgcacgcatggcagcgcaacagtggtgcgtgtgagatgttagattggctgaaacagaccacaagtcgtgggtatgcacagcgtagagaactggagacactccatgagtgccagtgcatacacccccgagtggattacagctcctgcgttcggtgaccccgccgatgccttcattcttgatcagtcatggtgattgcctgatcggcatacgtgcagcaccctccccttcactgggtgtggcttggtatccgtcgcgagtgtggcgagtcaggttggaaagaagcagccatgtctccgagcagcacgtcacgattgggatagcccaaaaagccactagtgagttggacaccaagtccagaccaggaaggtcgtagtagtggcacatctttgaggaaaatgtggcgggaatggaggggaaagtaggaaaggctgctcattgttcttatcgttcgtccttttgcgcttcgttatatttcttttttccattttcacttttgtcttttcttttctttttttgtttttagcctttcttctgcctgttcttgactataggccatttttggagcccgattcggggaccgctcgactgctgacatgacaagaagtccatgggggaatgaagcccgtcgaattccccatccccccataactctcgtaccgcggatgggtcccaaatgagacaggcggttgttcaatgtccaacaagcttacttaccttatccaggttgaatgcttgcgcaaaggtcaaaacaacacaacgtaaaataaaagtaaataaataaataagaaactgaaatcaaaacgggacagccctgcttcgagaccgttagcgacatgtgcgcaaacgagtaaagaaagggagggtagacaaggaaagggaggggcgctggcgaatcaacccaagtcaaatcggaatccaccaaatccctgggataaactttgtctggctatcaaccttacctcctagagcccatcccaactggggccaagttaatgtagtacttcagtaggaggaagtagtagtggtggtggtggtagtggaggggaggggggaaagggtaaggtcttccggccattgagagcacttccatgacagtggccgttatgcatgaaccatcacgacttccaaaatccacccatccattcgtcatgccaatccccaaactccaagggaaggattggatcagacagtcgtcagctgtgttcctaaatggacctatccattccacttttccgtggaggtggtctgccatgcgccaacgacggttggtggatgctgtccggtgttgctactgctgtgtctcggttcatccaaccttgtatgtatgtatgtatgtggtgatgttcccacccccttcaaatgtgacttcgtaaatcatagtattcttattttttttcatgacccagattccattttgggcgtctttcttttatttaaaatttttatttatttattatttatttattattcattattattattattatttatttattttttttcacttctagatttcccggggtttaaccagtaattgcactgtcacgctgccttccctccttgacctgctcgtgtctctctcatgcggtctcgcctcgtaactttgggtcgccccttgcgttctgaacctcaagattccgcggctttcatggaagacaggagctgatgacagccagccacagtcacggaggatatgcggcgttgttccagtgggcccctcgccccctatcatcctcctgggctcgtccataggcacaacggtcaagcctggctggcgcccaaaagtaagcctgccaaatccggaaataacatcccaaaagtaccaagaccccatccagaatggtgagtggaggtggcagtgtcgaggagaaatttcaaagaaacagtaatcggaatttacaactgaagggatagaagagtagagttatttgagtggaagtattattaatgtatcattaaacgatcatctggtcgatagcgcgatggtaacaaccaacagtcatggggtattattagatccaagctcacagtactttccaaaagtctccaaaacccagccatatacatgcaaaacaatggacagcactcctcaatctcctctatacacaatgattaaccccatacccagtaagccaaatgatgagcgacaaagaaaataagggaagggaacacaataactatgacaaaaggagatcccgaatgcttttctttggtaccgtaaggaaaccgggccgtatccacgtgacccgcagtggaaatagccgagccgaaccatccaaaaagacaatatacatgaggtgatgatataagtacaaaggaaattatgccaaacaaaggagtgacgagggtcgggaggtcatgtacataaaatttcccatagaaaatcgatgacagaagaaaaggtcgtgtgatcatatccagcaatgggagctatcgtcatttagttgagcaagttctgaagacccatccgcgagtcgcgcggagcttctgtcttgtcttcgatcggagcagaccatgtgggagatagcggagagtgctggttccattgctggtgatcggagatccaccgttgcttcaacgacagatcgtgataggcgtagatatcgtccgaagtgctctgcctgcggaagtcgccgtattgctgtctcatgtccaccggaaggggaagaagctgtggcgaggcgatggtcctgggagaggaggaagaaacggagttgtggtccgagatcatcgagggaggttccatggaagaagcttcggagaaggcaggcgatgtgagaggagtttccactgggcggttaagagcaggaagtgtgtagatcggggtcaactggcgggggcagtcgatggaagcggcggagaaggaatccctccgagatgagggagacttggtccaggaagtcagaggtctgtcgttggagatggaagagtagcgagagcggctgatggggctgctcatggacagagaggcccgcgcatatggggcctcgacccgtccgtgcattgtgcgtccggcgtgaggcgagctggaggtagggagacctcttctcttgcggttcatgctgccgttccaccagttcttaaccgcattgtcgctgcggtttccaaggcgtcgtgcaatctcggcccagcgcttgcccatttcgttcaccatccgctcgatcatcaagccctcttcagcagagatgggctcacggttcaaagagggcttgaggttctggtggaagcgctcgcggcattgcttgggcgagcggtagtgcatgtgctgagagatgcgaacccagttgttggggccttgttcgcgaaccaactgaaggagcaactggtcctcttcaggaacccagggtccacgacgatgagtgggagccattgctgaagtagttggcaagggaaaattaatccgagtgattgatggaagaatttaggtagttggagaatctatcgatgtaatgttagacttcagaaaatgccaggaggtcggagagtttttaaagagagttggacagtcgaaggggggcgccgacagagttcaggtactatgcgtgggcggggaagggttgacgtctttaaagggaacaggcttcttaccgtggggttgtggttgtgtgggaggtttagtgtacccggagcggactagaccagagacacacacacgcacacacacaagtgtagacacacgcgggtgatggataagggacgagagaagggtagatagtaggcaagcaaggagggaggagcaatgaccacgcaaccgagctgttgggctatgtaggaagagtgggaagttgggagagagagtttgtttgatgatggagaaagaataaggttcgaaggtgcgtcgtcgaggtggtagatatataggaagagaagtgagacccggaagggggaattggaattagagaaagggcgatagacaatagtggtgtcaaggagcgatggagatgaaggttacgatcatctattatagcaacaagcagcagcagcagaatacaatgaccagggagacgggtcagagaaaaatggctactgctccacacttagagcacgctataggagaagatctgatccaagatctcggagctgacagttgtgtcggaggaataaatttaataataataaatgccaactattattgattttttttggaattggatttttaatttttttttattgttgtgatggttttattttttcctaatcgattttttgattttctgttttccgattttctgactcttcccccccactctcttttttattttatttttttattttcctgacgccccattcagtacccgctggtatgtatggtattctccgtatagtttacttttggtaccgcagtatgcgtgtaaaatacactagtcactagtagtagtaacaggtagtacctggttagtagggggcagctacttaggtattaggcaggtaccacctcaggtagccttcctcaaggaggcagagctagcccaggggcacagacctactaggctagttcattgattaatttagattgacctccatccatagctctactactgcccttttgacgccccaggctgtgactatgggaggcactgcggatgcgggctatatgatgacaaaaagaaaataaggaataataataaaattatgtgtgtctggactagaaccgatcttttgaggtcaaagtggggaaatgtgaagttgacgggcaaaacttcttgcagtatctggagaaaaagtgcgagcaagtctacggtaccgatcagtcgggcgtcgactaaacgggaaaatcccaaacctagttggttagttcacggcccttttccgcttcttatggcagactgcagaccatgggcgatctatccaccagacccagtttcgactgctactactaggtaagtatggactggcccatgcttcgtcaaagttcaggccctgacaggaaaacgggagcggcagaaacggtctggaggtaggcgaatgagcataggagtggtcatactgaccggatgggtttccatgggtcagtcaggcggggcgggcaacctcggaattagaaattctgatggaggggaggaaaggcaggaaaaaagagaaaaagagagagagagagagcaggggacagggaagtagattgccgatttgagaaagatgcggaaaaatgacaaagagcacctccgagtggttgcataatggcgttaaggtgtaccgagatcgtggacaggcgcccgcaccaccaccaccccccctcctccttcttctccccaggcaagttgataggcaaaaagggccattgtaggcaaaggagcgagtcatggcttatccagtctaggtatacattgcgcttcatctacgatttctactattgagatgacaattcttgttgcgcattgttcacagctaccaaatactaggtaagtttattttccctcctcccaacaccactatagctactattgcttgcaggaattcaattcgagaccatatccatcagccagccatgaaggcctttttttccactttttttaccctcgagtaaagtacgagatagatactactacaatacgtagttagcactccaatggagcgatttgtaaccctgctacttttggcctcacccttggctggtagcgcccattggccgccgctaaccctcatccgcaccggacgcaggcttgatccctcctccactccccgtgggccgttacccagaacatgaaccgtttgagtgggggcagtgattggtgcagagccggctagcgccctttgaagatttggaatcttttggctttgtctcatacccgggagggttgggatcgacatggggatcatacgcaatctcgaatctgggccggagtaccttcgcgccggtgctaccggctgccaggcataaggcaagcgcacttaccagagattaccaaagatcggactcgttctcaccaccgaattgttagtcagcttggtcttaactccttaaggtgaccaatcattacggcatattgcctcggatatcttttctcgctttttcgtttcgtttcttacacacagatgctcactagcccactcgatctgaatccctctgcaccagagacacgggaccgctgtcccgtctcctcggttcattgtcgttattttctgcatctcgaagtcgatcaggaacgaagataaaggttttgaagtcgattggctaaggacaatacagtggatgcccgtgcagttggctcagataggtactaagtacgacttactactcctactactattatgcagtggattactattactcgcttatttcggacgcaacgcttgaaccacattcccattcgccgtatagagtaaacagaaggggagatggatgggagaaaaaatgggttactacgtaagtagattttcttcggtccatccaaccagcacccagtatacaagttcctgactcactttgacctgcagggttctatccgggtaagggatccgcgacgagactcaccattgtaggcaatgcaacagaagtatgatagatctcatggaatcctcaggttcccccttttcgggattgcccatcaatgtggcagagtggccttctgcctcttcattggctgttcgcctggagcatggccctcccagccaggtactagcctcaccctgctctgcagctacgaagtgcgtacataaattaaaaaagccccgtatattgtcctttctacgatgactttggtcacgatcatccggggaaggtcggaagattccaaatgtatcgtgaccaacggaaagtaccagtgcctttatgaggggttacctgttttcctaagccatacagagtaaagtgctcgtcagctcaccgcgccggtaccgtcccgctgtcatactaagcggtgggaatggatggggtcaactcgagaagctaaagttaaccatcctagactatgggattactagtactattcgcctgccatccatccaccaaaaccttgccctcggagctatttgttcgatcggatacaacgttgctgcgattgggcgatctaggctgatcactctgtgctcgatgtaagagcgcttggcgaatcgacggccctcgtagtgtgtcctcgattcccagtggtgtgggaactgggaagggggggaacaataaacttcgtcaaatgttcaagacgatcggatccagatcatcgtgcagtcatctctgcaggtctatcatctactcttctcgtccaaactattagcaactatgaaggcatcgccatgttttgccatgcgtcgtttcttcttgcagtaactattgttccaggtcaccaccaccctccatcggcgtctccgagaaaatcttccaggcttctattttccctgcctagcctctccccgaactgatggaatttgataaagattttctccgtgtgaagggggaggggaaagaaattatcggggtcatccgacctgtattggctgggtttgtcttgccacaggctcgctctcacacacacacacactctctctctcttacagcacagagcaacagatggcccccctctcccgccttacatcgtttcggaagtagtgacatacataatttcttaccggaatgctttgtgggtaaccaaatgtcaccttcaccggctcaacggaaattcaaagctccattttttcttagcaaggcgcggttgacggaggtcgcttacaggtgtcaagtcaccggtgggaaagaaaaaaaatggcacctcaggggaaagagtgccacgagtcaagccgttgaacgtcatcaaatcatggagcgcgcaatggaaaaacctactacatgcttcctgtaaagtaaggatggaagcgaaggaagggctgtgtggacggttggagtgtaacttggtcgggcctaattgtcatcaataccgccatactggtagtaccgcagcctagttactgaggtatcagtgaccaattggttcctcaacccacctaaacaggctagtaagcacgaacccctgaggacctgaagtcctgagaactgcatgacgtgacgaaccactgccccatatttgcagctgattggtctgccaaaataaggtatttgtcattctggaagcgcggggctagtcctatccagggaatgatgatcggggacttgggagggagggggaaaagagcgatctcggtaggcttttgcaacctcgtcaaaaggacgagacgcacttagattaatcttgattgaggcgagattaatgcaattgacaggtacgatctggagaaatgtaattgatggtctcggctcgcgatagtgttttagctatgctttaacgaggttcaatggacaatagcattctccttctttggatcttttagtcatttttccttttccaccacacccccctctctttcttgtctttgcctccacacgcacacacaaacacacacacgcacaagctgaacaaaaaatcaaatcatgttgtgggccggaccgccaaccaaatcgctcataagcatcccgtcaactgttgtgacccagtaattattagtggatagatactatacacaaccatttacctccattacattccaggtccccgaaccccatcccatcccatccatgtcaacgtccgttaacgtatgttcccgcccgcctgggcttacctcgaatctacaaaaaataaactggcgttaccccgggaaacagatatttaaataaaaaaaaaaaaagccttggtctcacatgaaatacaaaaatccctccacagctattgaacttctacgtaagtagactccgataaataaacagggggaaagaggtggttctgagcggtgtcaaacgccatgtacgtcgtgggagggttacaattctgccatgtggacgggtacttgcgatctgcctacctttacctcgtggtacggagtaccgtgtacacaacgaacgaacaaacggatttacatacatatttacttacttacaggaacaagtcatacatcgccttacttacacagcttttttactcggttactactagtaagttgactcccccattatttttaatgtacttcaagagactggagtcgacatacgtacgtcatttgtcaaagatactacttagttattattactccgtactttgtattaagtaccacgaaaatcagaggtgatcgtccttttgaaaagaccacagcggcccgccgaaatatatatttctgaggcagatggacaactacttattatacatatgaccaatccaacagtttcaattccacacagctgtaaggtaccatcactacatacatgaaaggtaaataattataataataataataaaaggatttactccacctctatcgcgaccaccacctactatagacccggctggacggaagcaaaagtaagtcagaaggaatcgtgtactattgaatatatcacgaaggagccacaagagtctaaatcctagtaacgatgatgtacagtgctacgaccaacatactacttaacttgcccggtctagtctaactactttgtttaaccccggtcgatggtccccgatgtaccttggccttgggttgccaatcagagacacgggaagtatttgagataaaccctggttgacccatacctttagcgtgcagcactcgggattcttgattgatctccctgccacttgccatattcgggatatattcagcagtgcctggccgctgaatatattaaatcttcagctggctccacgatattattattgatattattttttgaagcgtaagatgttaattttggtacctgtctaactgtgcgctactgatttagttgaatatggtttctttgagggggacacaaggcagattttttattattttttcgcgtactacagaaggtcaatagaaatgtaacagtgagcgacagacaacaggttctaagcgagaccgcgaccgcgaccgaccttgcgtcctgtccctccatacgcacacatacatacatgcacacagcgtctgcaggacgtcgtgtaaccgtcagaaaagaaaaccagtaacgagagaaagaaagagggtgagagagaccaagacagatgggcagggatccccgactgcaggacaccctgtatgggggggtcagttgaagagtggagcgaacggctctctcgcatcccgccgctgtttcctgactgtcgggcctccaaatctgcgaacctcaggaggtccgagcaccgctgtcagttagggagtctcttgtcttccgcgggtgaggaaccaatggaatttcaagacaggtaaagaagacagaaaataatcactgagacaataacgagtttactattacgctgctattcatctttctcttttgttgaattcgacgctttcatgtatcttagagatagataacgcatggctattgataattcttccgcgaaattattattctttttcttattcttcctttttttctcccatgcgtttaccgagtcagtagaccccgtttgtgtaccacagtcccgacacatgccctgtcgatttataccggcgcatgattagaattggggaacatagtacctggggacgatgaaaaggattcattgtcttcattcagtaatagtaaactggcggttgcgatcgtaagttacctacatcgtctgaactagtgttgaaacattctcgaggataggtcgagtccgtactatgttgttgcatccttctctacctatcatccttgcttggtggcacctagttataattttcgaatttattttgttcatccgttttccgtatcctagcattggggccggagttcacctggaccttgatccatggtcaaaaaaacggtcaaacccgtcccgtgataacatgtatggatcgagaggggcggtccagatctaaggtacgtgtgtgtaggtattctgttgtcctcacctccctctgacgtcggagaatgtgcaatcaattccggtagtacccagtcaagggctcccatcgtttagctagtatggagtagatggttagagacccatgacgtcgcgcggtatctgatggaggtggagatttgagaagaggggaggggtgagggagtggtgaatgtgttgaagggtacatacaggacgcagcaagaattggcaggaaagcccgtgattggatgccctctctgatcggggtttatgtcttccccttcggggaccatgtgagttccccgatctttcccagatgcccggctgggcattgccccgattatctctttgggtttagtgtgacaaaggagttgctgtgccccgtcctcccggctgaccaggatccccaccgggggttgtgttaccttacttcagcgcggtaactgatgtatggatttaccgtatctatccaatacccattacttggtatctgtaaccaagtagaaacacccagttacttcactgccaccacgaagttaccatcctccccccgcttcgtttttgcgcttgcgaatccctttaaggggatagaggcgatgatgccgcgataatggctacaccgcaggattccctcagtaccaccctttcgtcagaatagtaactattccagtatctaatccagagttcatacgtatgtatacatctggcgtcgggtattgaactagctatgcctgtctgccagagtaaccaggtagttccccgtagataactcgatgtatctaagatgttggatggatgatgtatactgatactatacatggatggctagcaaaaatatttggagtgatgagtggttgtgtaatgctctttctttcgtcataggcgaggcacatacacattgtgtttgtattgtacttcctgagctggaaagagtacagggatggaaagaactactctctctctctctctctttctcttttcctcagctcaagaaaatactatcttcatcatcttcatcatcttcatcctccatgtatatacaatgtgctcagctagagttacttggactttccttgtactaccccttccacagatctggaaagccccatcgcgcatcctagaggtcggatacgtcgtgttgacgcggcctgtcactgatactaccaccatggcagagctgcagtgaactctctccaatgcagctgacgccttgatcccatgtcttggtatggtggtggtggtggttgtggtggattcctggaccaatgcagattaatgtgatgtgacggcactattgacttttgtcgaaactggaatgcaaccagcttcgagtcttccttgagatctgacaaatcgagtgagaaactctctttttccaccacccacaccttcttgattccattcccagcgtttctaatcagctggtaactggaggggggtcacaagacatcatcaacatcagcatcagcatcagcgttgcccgttgtgcttctatccaagccgttaccaggcctcgttctccacggcactcccgctgtcaaagaagtttattcgtgaccggtgccaacggatgagtgtgcacctgcagcctaggtcccgtggtggtcagagagtgatcagagtaacatacaactaacgtcctgggacgggaggccctgccatctggggccaagaggtgaatcatcaataggatggttcacggattaccgactgtagcgagtggcaggaacatcagtgggcctccgggccaaccagaccaagccagtgcacccgaataaacccaatctacccggtcaaaactcaatcttcacgacccattcagccttcagtcccggcgctgaggtaaggaccattggagccgtggatgtgccgtcgtcctcatccaaccaagaaaaagaacccacgagctagccgcgtgcccgggagcagcggccgcttccctcctcccaagaaggattgaatcttggtccgtttccatggccttggagccacccgttcttccttaatttcccttctttcccgtcaaatccccagtcttctgcggaggctaccattttctagtagccctcaggcctattctcggcacatccgggtcagaaactggaactagggagtgtcggatcggttggtttgtcgcaccactggcaatggggtctgatggatcaatcgcttgctaacatcagcccggggagatactgagaataggaacgatggaaacgatggcgtcgcactacttgtccctaaggattcagggttaagctttggcctcaatccttttttttttttttcttctgcaaaaaggaaaaacccacaaaggtaaccgagagaccaacgagggaaaaagaaataaatgaaaagagggtctggaacggcagattcttctgcacaagccgtgctacgatgactttgacgaccgtgcatttgccgagtcggcgtctacgtacggctccataacgaactactccgtcagaggccatctccactaccctcaactcctctttaggcaaccctccccctctttggcgatccgctcctggctctccaatcgagccgtcagggaagacttcgggagtatacctgccagacggcacggaaaggaacaaataaggggagtgtgaagaaagcaagcgatgcgacggtgcccaccaggacccatgatatgcactgcactggccgctttgagtcaactcttccggagctacagtggctaggaaaactggttgaagcgtgaggaaagctgaaatggttacataattccgcgcgaggcctttcgattcgctgccagaagttatggttcactagacgcagcagtcatagctctctgcacagacttccacttgtgacattggtacttcttctgggggccaatcgatcccgttcgtatatccaacggtgagacggccaactgtcttcttggctggaaaggaagaaggaagcgaatagggagaacacacaaactctgttcagtctggacaaattcctgcgtcttccctgtttccgcctattacagactagaaactattcctcctattgataaatccatacgtctgtggctgggctgagccatacatacccttttctttttcctgccagaacccaaaccttgggccatgtggctaagctggactcaattttgtggctacgcttggggctactggcgacatcttcatggagaccctggtcgccactagatcgatcgaagaggaaaatgaagaaatctaagagagcttccagactcatcttgtagaatgttcgctacttgtctagtcttcgatagtggccacgcttttgccatgagattcagtcgtcgaagcatccatccatgcgactttcttgcttttcttccttggcgaggctgaaaatgaagcagaaaaaaagaaacgaaataaaccattgacccaagtattgaaaaaaaagggtcatctaagtcgcctttgaatttgtcatttgcccctccctagttactgtttcttgctacctgatggatcgatgcactttggctacgatatcccagcgacttattgtaagttacctaaggtgtagagtccatcacatacacatgctgacagattgcatttgtgattacttagtgaatgttggctgaactaatttctcccttctctgacaatttgcaaatcgatacatccaaccctgctccggctatacctccccgtcgatacatccagccatcaccttcaggcaacctaaattattcacgagactcagaccctgacaaataccggcatcgtctcaatcggacagtccacctgaatctccttccctccctcatggatcacatcttcctgaccccaaaccttccacgacgccccggccggcaaatacacctcaacagacctctttcctgcctcgaacaccggcacaacaagatacttcgagccaaagagatgttctgtctcgacgtcccacgcctttttgtcagcgggaaactcataaaacagagttcgcatgacgggcgttcccttctcatgcgcctccttcatcaaccccctcgtgtaatcgcgcaactcctcgcgaatcccaatgtactttttacagatctcgtagacctcctcaccatacgaccagatttcattatcggagcccgaatccgtaggccggttctcgggcttgggttcccggtcgccatgcaagcgcatcacaggacagaatgccccccattggaaccaccgcgtgaacagctcccggaatgctgggtccgacggatcgcctccatggaagcccccgatgtctgtcgtccaccaggggatccctgccagacccatgtttagcccggccgctagttgattgcggaacgacgaccacgaggatgctatgtcgccgctccagactagggcgccgtatttctggctcccggcccaggcgcaccgtaggagattgacgatgttggtttgccctgcggattccatgccttcgtagaacccccgcgcgtattctttcgggaagatgtttccgatttgcaggttgctgccggcgtggtaccggtagaggtcgaagtcgtagacggagtactcgggttcggcttcgtcgagccagaatactttgatgcctttgtcgtagtagttttgtttcgctttgctccagacgtaggcacgcgcggatgggttcgtagcgtcgaagtgggtgatgtcgccgttgcattgcatggacacgcggagcccccggtcgtgtcgaattaggaggcccttttcgagcatttcggggtagttggtcgatgcgttttcgacggttggccagacggagaccattaattcgacgtttagggattggagttctttgatcatggcgtctgcgtggtggtgggttgtgttagttgttgaaataagggttctttatatatctagatgtatgtggagaacttaccgggatccggccagaattcaggatcgaagctccattctccttgatgcttccagtgaaagaagtcaacgacgatgagatccagtggtatgtttcgtcgcttgtattcccgtgccacgtcaagaagctgctcctggttccagtatcgcagcttgcattgccagaacccaagcccgtactcgggcatcattggcacatagccagtgactttgctataggcttcctcgatctcagccgggctgtctcctgcaacgacccagtagtcgagcaccttggtagaataggcctcaaagctcatggtattcgttcccaacacagctcgtccgatagccgggttgttccacaggaacccgtaaccaagggaggagagcgcaaaggggacgctggcttgggagttccgatgcgctagctcgatgtctacacccttgaggttgaggaacggctgttgatactggcccattccgtagatcttctctttagggtccagcgactcaaatcgcatggttaggtggaagtcgcctcctaggattggtcgcagctcgcgagcttcgacctctagtgcgctgcatttggggtccttgagatcgcgacgattgcgagcgtattcttcgagcagcttctctcccttttgattgtagatggtgatcttgccgcgctgggatacggtggctttgatcttgccgttggtaatgctggagtctttgtgctcctcaatgctgatggtaggttcgattgacgtgaccttggaggataaggcccagtcttcggtgggcatggaagccagcttggtagctctcactcggagtgcattttcgccccatggctgtatccagaggagatggtcgtcgaaccggaagatgagtttgttgtcttcggcgtacagcattgtgttgatgtgattgtctgggtgggtgtgcgaagaatgtaggctctgaaggtcacaggagtatgggaagggttctaattgatttaaatctgtcagtctagaaatgagactgagaggggtgtttgaacatgctgtgcaattgcagcccctcacgatgaccggtctaacccaaggcaagagcattgacactaacagttgaacagatgcagtccaattaggagaaggacacaaagtattctgctatggccgcatcgctgcctgcgtcacggtgttaccaacgccacgacgggcatgctgctgaccagcttcatcttcgtccagtaaaaaaggcagcgtagagaaacgactgctctaaagcgagtgacttgttccggccaagagatcggaagtcgttttggtccacgaatagcattcatcggactggaatatggcaatatagcctaatcttaaccgccacattccttgaatgaggaggtgaagttccggggaagcgtcgagatgacaagaagcggggaaggcgggaacacaggcctgcatctggtcaagattgcattaatgctatcttgactctaccttgagtcgacccatcatcgcttctttgctagattattagaatgatctatatcatattatcctaggtggatggatccacggttctgtcttgaaaagaagccggcggtagccgttgttgctgtagacggccttcaatgtcaatgtagactaatctaccatgatgttcgctctaaatttcggatcacttacacttttacgctacaacgatatctacgagtggtattcaatatcgcagtggtttaagcccagcaggaacgtcggggcgacaacccggtaaggttacccatcatactgcgaagcgacggcgcgctacgctgatcaggtgtatgaaccccatcagagtctgtaaaacagactcgtcattcgacaacggcaatggcgggagtgacaacaaaactagaagcaatggctctcatatgatcaaagattgcatctcccggagctccggtgggggtaaccccgggttttagccgggcctcaccgtttgctagacggtggatcagaacaagaaagtgacctggaagttgaggcaccgtttgataaccatctgctagggtagtacgtggcttgctatatcacttgctggaggctaaatgagagacttccaatgatgggctgcgaacaaacgaaaagacatcgccagcgatgttatataacactataacatagcgtcattctcttgtgaattagcacatgctaccgtctaggagcagaactttcctgagcaggccgctcagtcacatcgtatcgttggcttggacagagagacgatatagctggaagcatgggttcaacctctcatcggtggatactgaaaacatagggaagaaccatgttcactttcgtcacaccataagtgaggcgatagcaactggtgatgtgagcagactgcaaagcttctagagagacactatcaacttggttaccaccacagctcttccttgcatcaggattccccgattaactgcatattcatggcaattatattctcggtgtggaaaggctggcatcattgttcatgatagaatcagaagcatgtcctgatgtcgataggagtgttgcttcagggtcagttgtaggcagtgacagactagtcagataactttgtcccgtttggcacagttttttcacgagcatgccatgaccttactcccgagtcactgagataccactggtgaccagcagctcaatgacagctttagccatgtgttgcttgacatgaaggtcgtcattgtcgcactgactatcatcaagtgtcatggacagcacttggctatgtgatcagtctgacctgctttatgaggacctgtgaatatcgacagaataagcgcgctcttctctgagatttgattgatagttgagaatcagtcgagtagatcatctgtttgaagtgacaaagggagcatcgacatcatcgcctgcggcagcggcgaaactccgccggcgactggtccgggcggtgtagaagacaacttcctttcggcttcactttacgctcatctcagcctccttggcgcccctcttcttctctgttttattgccatcgagctttgttaaagatactctactctgattttcattttgttttggcattacatccaatacccgcctcttccgactaagtttcctccctcaatggaggtagctagcgcgcaacagccttctcttcaactagacgcctccaacgctgccccggttgctgacacaatggacgcctccatggatattgacatggacattgatcttggaccccttccagaagcagaaccaattgagactgtgagtattactattgtctgatctattacagattccagtcgtccactcctaacgtcttcgtcgactgtccaggaacaaactctcgtggcaacgactgctgttcaagatggatccatcgaccctcttaatgaggaggcacagtatgaaaaggttcatatacgcggtgtagatgagttgacgacagacaacatcaaacaattcgctgtcgaacacttcgcccttgaggagccaagccgcgttgaatggatcgatgacacatcagcgaacatcctatactcttcgccggaggttggtcttcaagctctgtcagcatttacgcaggttagcgaggaggaggatgcatccgcgttgcctgctctacggttgcgatccgcgaagctcctctctacccaccccgactctgtgctccaggttaggtcagctgtcaaagcggatcgcaaaaagcctcgtgcgcacgaagccagtcggttttacctcatgcaccctgaacatgaccctcgggaacgcttgcgacgagaatttgcagataggcgacgctcgggaggtggagacgtcagtgacggggattatagacgaagacggtttgatggtcgagaactgcaacgtcggagagaccgtgatgcaggcgagagcttcagtgccaatatgtatgatgacacggtgcctgccagccgcgaccgctcgtcggaccgcagtcgcgaaaggcggggaagacgaggggggcgcgatctattcccacaggaagaaggacgattgtctggtcgccttcgcaaccgtagcgcgtcacccggtcgagatacactgatggaaggcgggtatgctgaggacgatcggcaggatcgcagacggttccgcgaccggtcgccccagctcggtcgccgcaatgaaggcaaggagctcttcccatcctcgggagccaaaagcagcgatgcaaatgcgcgggagctcttcccgaaccgaacagccaaggaactctttcctcaaaaagttagcaatcatcgccgttcagacgcgatcgatggcgcagatgagacggcagatctcttctcgcggaggatttcagtgcctcttgttgatggcagccaagaccaacaacctgcgcgccgaaagcgcgacattgagcttttccctgagacgaccgagacaagcggtctcaacatccgcggggcagcaaggcaggatcagggaatgtcgattcgtggtgcggcaaatggcatctcaatcaaaggacggggcgcgtctgttcgtgaactgttccctaataaatacggttccaacgcaggcaaggagttgttttccgataagattgaggggcgaggaggaccacgacgcagggcggaggacatgtttagctgagggcttaggttcgggcagacctttttgcaagcaacatgtcatgttgctatgtgtataatttgcctgactggtttctctttggttgtcgctcggcttttgcttggatggtggtgcgcaaagttcgataaaatcggctgacatcggtgataccaatctttccttctatatatattttattcttttgtacttcagcctatgcccaatgagaacatcctacctctctactagatgcggtatcttcatgaagcgtagtgctcaggaggtctgtttgcgcaggccactttcaatccggtgtcggaaacatagatctggctcgagtggagcgatgaagctactagcccgatatatatatctttcccccagttatcgctcgacaaagtacattccgttgctcaaccccagcccaacctccaaaatgccacccccatcgcaaaatatcccactagccagcaccctcgtggcccgttttctacggacaaacaattacacgcaaacactcaaagctttcctgcaagaagcggggctcccgtccgacgcgggagaacagagcggcaaagacgatgccaccaactggaccatcgagaatctgatcgaggagaagaaagcctatgaccaaagtaagaacttcgagagatatggtgacaatgacaaggacaaagatgtctggaccgttccaggtctgtgtaacaccttcatgccccgctagaagctagaaactaacctgctcttacagcacccaccaagcccaacatcatccaaacgccaagcagttcaaacctactggcatgctccgttgggcaatggcaaaggccagatgcacaagcagagccatatctgatcgccaccggcgcagacaagcacctccatctcttccaaacatctcctggccatgacctcgtccagtcattcacgggcacatcagaggccccaattctatcgtatatcccggtccaagatgggaaatacatcctcatgaccaatatgtcaggccagcttcttctgcaaaaaggcgcagaaatcatagaccgccgcaaggaccacgccaaatacgcggtcaaagtcatcgcctacgaacagaagaacaacaacgacacagcagacaccttttccaccactacgacaatctggattgcaacagcaggctgggactccaagatcttcctctaccgcatgcagattaacgatgaagcccctacgcaaatcggtgaccccattgcctccatcccattactctccaatcccgaatccatcctcttcaccacccacatcgacaaccctcaggacctaatcctcctcgtctcccgccgcgactcaagcaacctatactactaccatgtcaaaccgtcagcggtctcaaccaccggatacgaatgccctctcatcggtaaacaaaacctcgccccgcactccaacgcctgggtcgccttctccccctcctgtctggccctcagccctcatgacccgggactcatagccatcgcaacatcaactcttccgcatatgaaagttatgattgtgcggttgctcttcccctcagcagagagcttggagtcaggctcggcggagcaggaacaggagccagcaacgcaagcggcgcaggctttcgctgccctgtcgctgcagaatcgcgaggacgccgcgattctgatccaggcgaatacgtttgcgccgcagacggcgtactcgacgccacaggttgtgtggagaccggatgggtcgggggtgtgggttaatggggatgatggggttgtgagggggttggaggtgaagacggggaaggttgtgacgttgttgaaggatgggcatgaggttgggtgtaagattaggacgctttgggcggggtgggttgatggggagaatgggggtgagagggaggagtggttggttagtggggggtttgataagaggttggtcgtttggaaggttgagtgagaagtatagaagctctaggttataagggacagtctcatagtatatttctcaaaacgatatcatatagttcagttcaattcactatcaacctacatgggctacgactgtatgtagccctccgtccatgcaccctctcgccacggtagagcaaagggaaagggtgtttggtaattggagggcatggggtcttctctcggcacgtaaataaatccttcagcaagcgcgcatggaaaagataagcacggagctgtacacacatatgcctgtttcatcaccaacttcatcatcaacttcaccaccaaccacactacggtatgagaaccgcacgtcagaaaagcaaatgaaccaccagccacgggaatagatgaagccaagaaagcaacactagagaaccgaatccatttgctttatgtgacaaacccggtcttgcggggtaacccgacgggatgtgatatcctcatccatgtattctcgaccagtcctttgtcgtcgtttgtcggtaggaaaggaacaaagcaaatcaaccaactcaaatcgctttcatttcttttaaaacgtttctatattagttggaagtaatttatgcgatctcgcgcttgccctccttgcgctccttctgtagggttgttagtgtcgattccttttggcttggccaacaagtttcttgttggatcggtcacaaaacgtaccagagccttagcggttccgtgaagggcgtgtctgtggttgcggcggaacttggggtcgacacccttgagggaggggtaacggtgggtcttgggcttcttgatactgttgatttcaaaaggcgatggtcagtgttccgatctctctcccgcgttcgttgtagttgttgtattgattccgaggacgaatatgctgaatgctggatattggtcgatatcctccctcattgagtatcctcttcttccttatccgttctctgagcctcaaatctgtcgaagatatcgtcctctatccaacatcgcagtattcgtcctctggcgtttcgtgtggcattcttggaacaaataaagaggtaggaggataatcggcttataatacgcacccgttacggtgagccttctggctgttgtggtgctgagacgcgttcttggactctgtgggaattcatgtcagcgatacataactcttcgatttgcaatggtcgataatcgcattccccgcccatgagagacgggaaaacgaaaataacggggtttcgaggattttggagcaaaaggggtgtcacgtactcgccatcttgtcggatttgtcgcaactaacagacggttgacgaggagttggcgggtgaggttatcctgaacggagcggaaggccagagtccccaaggcaggttcggctagggctggttttctgtgggatttcgcttaccgagcacggctagcgtcctgcccgtccggtgtctcttcactgtaggtctacttatctagctactgcttggggggaactgttccgacttagggcctagatttgcatgtgcttgtgattcgagtgctaactacatgaaattacttacaatgctaaactgtgtctgctacttataataccttcatggagatggtggcgcatcttcaatgttggggacagtattgatacctgaggcaccatggaatcccgtgattgatgactaacagtatggtcggctattaactagttagaagttaatgctggggaaatagtttcaatggagcacgtgttgaccggtgctttagatatcaatgcagaaagcatatggttggcaaaccatttaatcacaaggtctgagagtctgatatcgattggagattagagatatggatggataaccggtccatagttatgacgacgggaatgttgacagccgagtatcacgtgatattgacatggggcccccagtattgaatacatgcggacttggttggatcagactcgacatgactgtggtgatattgataatgatggctttatcttctattccttttacgcgcctagactgctttgactttcccagcttgtaggactctttagcataggcttgtacaatacgtggtaacaacaaccaagtctggcggtaggttcacgcccagtatgcatctagatagaagctacgcaccctcagcagagagtgatcttcgcataccatacccaaggtcaatagccggagaacaaggagttaagcgttgtgcaggtcaacgcagcaaccgagtacggcggtcttctgttggcgcgtggcccaccacgtgaccgcccgagccgctagggaacaaccggcatccgacttcgacctttgcaactcccaactcaggttcaagagggatactatcaccacccacccccttcgtccattgcaagatgagctctctccgcttcgctcgctctgccttcagggcccgtccctccgctctccgcgttcctctccagcgcagaggttacgccgaggctgtgtcggacaagatcaagctttccctgacccttcctcaccaggtacgactccgattccgttgagcgcttctgtgcacctgcacgaacttttgatactgacaatttatcctttcaacagtctatcttcaagtcgaccggcgtgtatgtagcctcgcattccgaataggtcgaattcattggacgaccgtctttcaccctagaccgccccatactcacgatcctttcccatatagtgtccaggtcaacatccccgccgaatccggagagatgggtgttctcgccaaccacgtcccctccattgagcagctcaagcccggtctcgttgagatcgttgaggagggtggtgccagcaagaagttcttccgtacgtccgaccaaccgtgttgatacctgtgccgcgggccgagagttttcacatcagccgctacacatcgtgtccagggcaaggctgacatgactatttatgaaaattagtgtctggtggtttcgccgttgtccagcccgactcccagctgagcatcaacgccgtcgagggtttccctctcgaggaattcagcattgacgtaggttctaaaccgatcatgctttaccctgtgcgcagtgctaatctgtcaatcctcaacacagaacgtccgttcccagatcgccgaggcccagaagattgccaacggaagcggcagcgagcaggatattgctgaggccaagattgagcttgaggtaagacaaacaccattaacaagacctgaacattctgactgacaaccaaaaacaggtgctggagagcctgcaggccgtcctcaaatagatacctgatgtacatatccactcgcgacttcaactttgaacctgtagaattatagcaattctcatgaaacacttttttgcatgctttcggggcagagacccataaatatctaatcttgaaaattgtctggctgatcaactggttgctgatgcctttcggctacaggcctggatcgctctttccgacatagctcaggggagcctttcatattctctttccattcttcgtctactcccttctaacttgcccaacacctaattccggcatcatttggcccttttgcttcctagttgatgctaaaaaagcaaacgattcacttctggggtggcaatgatgccgtctgcgttcaccaagccagttgcaatcatgcaggagcccaagtccagtgacctggaatatcccttctgtgaaggctcggacaatccccaaaactcttcgagtcaactccagtataaacatccagatgactgtcctgcccgcccgatcatgacccgcagcgatactcatgatactgatgctttccacatatttccaatggacgtggataaagaacactcgaaaaacccttcaacctcagaatacaagatgatgggagctctctttaataaggacacggcgaaccgccaaggattgcccgatctatccaatgattcagttgtgcttgaaaattggtatgagagcacaaccggaccttgcagcacattagaccgagggactccgtctctagcgagaccggaaaacacaaccctcgttatactgaacgagaaaagcttatctgaacgcaatagtcgcggtcctgtggaggccaaatcagcgtggaaaccgcctagaccccctaaaccacggttcctagcacaccttgacgttgccggcttcgagtcatatgagaattcaacaccgtgcccaatgcctgcctcgagagacggccctgggggtcacaaatggctggcacctagattgctgcaaggtatggacaatgatatcagcaagcgacggaaaccatggagcgaccccaagctcggcccatctcgatatctatcccggcctgccaaacgtggcgcaaagtcttacctcaccaagaacgatctgagccagccgttccccggcccctggccttcaattgatggcttgctattgcgccaagattcaaggattgctaagtcgagccctgccaagatatgcgtccgggaccacagtaacgccttgtcaagcccccaagaggcacgagagtcaaatgtgaagcgcataggcaactggcttgggaagctacttagctgggtttcgcacttatcgaagcttaaggaacgaggcgttattagtatatccttggttgggcagcgatcacttcagcacccacgtttcggatttgcatcctacgaatacagtgtgagcttcaaatggtcaaatacgtcggggtctattgcaatacatcaaggacaagaagagatcaacctacctgctgcgtcaaaaaatgccacccgtctcttccgggctgatattacagtaccgtatctcgctatgcggattctcatgggcttttgtgccgtctgccggagccgtatgtccagaggagtcatgattagctttgtgcgactcttcatgagactcatcggacttccggttctgtattttttagagagattgagcgtcagcttgtccattcacccaagggagtctaacacgacccagagcgcaagagatcaacatgcggttttttgatcaatggcctgaatgatatcttgctccaattgctactgacgataccttgcagacgtgaaagatgtcaaatttttatttttcattaaggacaataaagcatcacaatatgaacgacatggcaaccgttatatgcaggaatcggaaaggcaaatgaaaacatcacggttaaaggagcaccgactcctactgcctatgagctagcactgtccattccctcatagcagtatcttatcacaaaccaatagccaaacaaaaccaacagttcatatccattcccttgctcattgcaaccgttgtgcatggctgctttcatagcgtcattaccggacatcaccagacaagaagctcttcccgagcacagatattttcaacaagcacgaatcatagtttccagaagaaccaacaaccgagacggcgagtcattggcacttgtacgtcataacgtatttcaagattgacatgaaggggtaaaatcaaaaagaaaaaagcaaattctcggaaaggaactaaacaccaaggagaaaatgggcatgaaatcatcaaggttgctatacaggggaagaggaagaggaaaagaaaaagggaagtgtcataagttatagcaggagataccgtttcatcaagtaaattccacaccatgctgttgtctttcctgacgtgctcgagctctctccgctcgtcttcgtcgacgattgctcgcatagtccccgctcgcttccgtcccagtaaatgtacccggagacgcgatactccctgtcccataaggatggctagatggcaccgggggcggcgggggcggcggcatatgactcccgtttccgttctgaggaggtggtgcatagtaggcggacgtggcgggaggcatacttgatgatggagcagcagaagtcgctgggaagcccgaggaagccgccgccgccgcagcctgttctcgttgcatctgttcctgttgctggcgctccagctcctcaacacggcgccagcggtcatacgagcccccttcgtttcctgatagcgagcttgcactgccggcgcgacgacgggaattccttcgctctcttcgtctcgcttcgcgactggcggcagcttcttcatccgttagtctccggagagtaacgtggcggccgtcgttgtgcattttcagtttgacagaaacggggggagatgcgatgggatcgcggtgacggctgctactcctgggccggctgctgcttcggtgacggctggcgctgcgacggcgatgtgccgatgacgcagcacctagggctgttccggctgctactcctgaggcgagctctgtaggaccgtgtgtagatgctgctggtcctgggtattccgatgctgctggtgggggaacgggtggccctggtgcaggcggtatgtctgagcgtgcaccgtccactgctccggatgccattgggggtcccgctgctgagactatggactcgccgtgcggcggaccgcggggtggccgggacaggtctgttgaaaggtccgtggctgtgaatgatgccggtcggtcacgtcttgggtaatagccctctccggggtagcgccgcttgctgttggcccgggctagccgctcgtcttccatctcccgacggcgcatctcttccacgcgacgttgttctgcgtcgcccttgcgacgcgagaagaagcccttgatcgctgcaagtgcccccgctccgagaagagcgtctcgaagtccgtgggatggcctgcgagggggagcttcggaaagataggtgctgttgtacaggtacgaagagcctgggctttgaggacggcttagaggtcgacttggtggtctgctgggaggtctgctgggaggtctgcttggaggtctgcttggtggacggttgagaggagtatgcgctgttggctcgggtcgccgcccatcttccagtctactcaagctttcttcggtcatgctgtcgctccgagtatgagctctactgtatcgaccggactccgtgtcgttgtctcgttcgcgtcttctgtcaaagaatttcttcgcgagccaggcaccaccgccaattgcacctaatttcagaagtaagttccctttgccaccacgccgtggtccttcatcagaaagcttttcatctgagaaactggtatgcgattcgtcataatcgtgtggtctgcctctggaacgacgtctgaagagcgaagccaggccagctccggtcgctcctgcggcagccatgggtccgaggttactatgaccatgatcatcggcagccgagggccctgagacatagctgagtcggctttcgtatccgccgctctccatgtgatatccttctgtgtcgtatagatatgacagcacaaagaacactgcgaggaggatgaaggcgacaacagcgtagaggataaatagcactttaggcgagccataaagggtgagccccaatggtatctgaacaagacctaggatggcgagggcgcgtccaatccatcgatgaatctgtgatgtagaagttagccttagggcggaacatcgaacggccacgcaacataccacaagcttcaagggaacatggtaactcctcctgttcctctcaatcttatggacaagccagccccacagaatctgaaagatcactaggacatatatcgcaagtccgataccgtgatgcgggtttgtcaggcttctctttggaccgacagcgaaccaaccgaacacgaacacgacggtgctcagcaacaatgtcaggacctggcaccagacatgcagcttgaaggcccagaaaggattccatcgagagtagtatcggatgatcaagacagagattgggacgagaaaaaggaagacgattgtagcgatgacgccgtgaacgactatgagggtatggtattcgggcatatctttgaatcgatttcccattcctaacatatgtaagcgtatttgcgcctcatagagctataaccttactaaccattgtatcgcattgtgtcgaagttgatacccatcagattagggaggagatatgtgtcgcgctccgagtcccacgttccatcgccgacatgcagtgtatttgaagcgtaggtactgctccccgcagcggagaggccagagtcggccgtcatgattgctggagaccttgagctcttataatttccgattgacgtggattcctcccgatctcattgacactggaatgttcgaactaccgacggagatctagcgagatcccccactccgaagaatgcaccatgcgctgatgggaaaggtcgaaggaaatcgatagcagtggcgtcgacttgagttcctggggaatttgtttgcagaggctaaaacgcgaccgagcccagtgttgcaatggttgtttatctttcgaggaataagaagctagcggtgagtgataggtatagatggagggtgggggagggctaggtagtatgggtaacagggataagagaaccgtggcaggtcaccaacctgtatagccaacaaatgaagaccacttagatgggatgaaaagaaagaatagcactgaagcagaggaacggatcgtgggacagggaagcggataaccgccgaacgatcgagatgcagggcaagcaagccgcttcatcgcaacaactgttttccatatgcggtttagcccgtcagcgtatatcccggacaaccaccagctgactcagccatctgccgcgggcgaccgcctgcgtatgtgagtatgattgtcatcgacacgattgaacggaccctcgcagatcaaggagttactttattcgcgatggtcgatgctttaattaatggacgtactgatcccgatggaagctggggcacagctactaactgatgacacagtctcacgaaaactggttgctatccaaatagcagggtcagtgtgttgctccatgtttgctggagatttccagagcaccgatcccagttatttgatcaatagtagtgaggccgttggtctttctgtagtattgattgttaagttaaccctgcggtcctcgcgcatcgaccaaggcagcagtactaagtttaggtcaattaatccacccaggaaccgatccaccagacttgcaaggaacccaactccagcaattagccagcagagttgggaaagcggtcaggccaggtgaccgcaatcgcgtgctttccgtatcttatcagctgctctctccgccagcgatccaccccatcctccctccttgaggcatatagatagcctctccatcttgctgcagtgcccttcctacgccctcctatacaaagaaacagcaggagagctacaaggagctaaatatggcaactcagctagagattttcgtgagggcgctttctcggtatgttttttttccctctgaatctctcgccttatctcttttgtacaatgtactaacacaccatggcaatgcagcctactcggctggatatagtacgtctttaagcccgaagttctcagggaagatactatcacgacaggcgtgagacttcaggagattgtacatactgattacctctcttcagcacgttctgttggtctgcgtccttctatccccagccgatcaacaacttccggcgacggtcgacaacggggctggcaatcgactttcctaccatcaacgtgctgggcttcgtgtgctataccatatatacttccgctttcctttactctcccgtgatccgtcatcaatatgctgctcgtcacccacttgctgaggacccgaccgtgcgcttcaacgactttgccttcgccctacatgctgtcgtccttagcttcatcacgtatacacagttctggccattcatctgggggttcaaggtctctcgccatcagaaagttagcaagccggtagcaggccttttctggggctctatagtcggcgtcacgatcgtgatcttcatcgttctcggtcagagcccaaataacggctatgacccatactcctgggcgtggatcgatgttgtaagtagcccaaggatttggaaatggctatcccgcatgtgctctaacccctaactcctgggtcaatctagatatatgccctttcttacgtgaaactggtcatcaccatcgtgaagtacgtacctcaagcgtgggttaactataagcgtaaatccacatacggctggagtatcggacagatcttatttgatttgtctgggggtgtcttatcccttgcccagttgctgctggattctagcttccaagatgactggagtggagtcacaggaaatcccatcaagttccttttgtcgaacgttaccatctttttcgatctgatctttgtggtacagcactatatcctctacagagatgcagtggacgatagcggtaaggaccggaacccgagtgatcggactcctttgttgtccgtgtccgacggacagcccgggcgcagttagtgtttagacttccgtctctcgtggtggtcaaatgtcagaaatttggaacgcttcggcggccccgacccgtcggcggtcccggtttcttggatggattgaatataagcacgttgtttttgtttggagggtcttgtgtgtcatgtgaagagcatcgagctggttgacataaattttcgcttttacgattttcggtcggatgatgactgaggctgagattctgtgacatgtatgacctcatagacctctccgccaacacagccgaacggagcaaccgtctgggaaaatggctgtagctcgtatacagtgtctacggcctggatgaccatgcgaagctcaaaatagtcatgtgtgttggttggggaggaatgatagaacggcttatcaattgcgacaatgtatttttggaacaatgtctttggctctctccgcgaaagtgtatctacacatccacaccgcgatgtaacatggcagtgacacgcgatctaacccggcctaggccagatctgcaaactcgatggaggtcagtccaagaagactcaaagactactggacctggcgacaccgctctttggcacccggtccatgctgacagcgaccctctttccgggccttcctgcgtgcaatcctccagtcccggggccccgtcacctagaaatactggcaaccaaggcccgacggcagggatcatgggcacaaaggcttaagtccatctggcggtaagccaaaatgatctgcattctcagccatggttatagcgtcgaaatgcacgcccctttgggaataagcgtgggggcctgacctacccgtccaagtaaatatagcgaatagttgacgtcgtccaaccttcaatggcgagggacattgcccaacgatatgactcgtatgccgactattttcttagtttgatgccttttttgccttgcctcctaccctgttgggccatcctgggatcggatcacctggaactttgtttagaaggttgtcgctcggcgctgaggctcagacggcatttagactttccatccaagttccccataaaccagagagttccgcatgcatatgtacgatgcagtggccggaacaagtacacgacacagccaatcatcgcgcagcctcgtccgtccatacgctggtccgccgactccccgtacggacgcgccctatcagcgccgagcaaaaggtcctgcaaccactggattggggctcaaacgtcatcctcatgtccagaactgtctgtattacccatcatcacttgtctggtgccttatggaagtatcctgtgacgctcttcacctcagccctatcaaagagtcggacttaagcggcaatggaacacttgctacttctacataagccgcgagagtcctgttttggcacggtaaaccggaaaggcaaagagaaaagaaaacgtacataccaaaaaacagagcattactattgatctgcttgggcactgtgcctcagattggatggatcgtctctaagcaaatgtgtcatccgaatagggttggttctacattttcagccgcagtgcatgacaattcattagttctgcatgcctattcgagttaccaatcacctcgcagccgaataaacgttccccttggcttttggagagtttagacacgggaatcccgagctgcatttccagggcaaacgtgggagccaccagcgatgaaggccaataccaaagtcaatggtacagtgacatcgacgtcctaatcccgattattgatcatctgtgaagagattcgctcagctacccgttgaccgtcagccctgggggatgtgcatagccacatctgacattcgagacactcctgaagataagaatgttggagtaccacggcttctactggctttaaatatccagaatgcatccaagcccaccaacttgtgacaaaccattcaaagaaataggcttcatcccactgagacatcccgagtcccctcgatacatgaactacaagtaccgccgaaggtacgtccatggacaaagatacattggtgagacccgtgcccggcggaataaatccccccatactgattagcctcagaacaagcgcagccgcgtgtccagggcacttttatccagttccgaaccatccgcaatgacctctaggactacaatcaacagagccatgctgatggtgcccggcggctcctcaacccacagtacgatgtcgtcagaggtgcagccatatctttttcccgctatagcctttcaacaggcccccctgtcagatgcccgcagcatgtctgggtcagttccctacgccttcgaccaagcacagcccctccatcaaaggaaaccagacgttggaacccactactttcaggaccaagagtcctatacacccttattctcaaatcagaccataccaccacagtcattcagacccgatattgaatcctttcccccagccataccaaccacagacggtgcatacttccctatcgatcaagaagaatggctcgcgatagcagtatcacagtcacctctcaaccctacaaatacagactattacctcccagagtcagctccatcctccttctctcagtcacggctaacccccgtaaccaccgcatctttatcttccgccaccaccgcagaccttgacttcgagcttgatctcgacctcgatctagacgatctccaactccaatccctatccgacacctcctccgcccgcagccagacgcgagatctaaccaactacggcattaaaaatcccgacggaacctggcgctgcgcatatcccggctgctcatcacacgccgtcttccgtcggggctgtgatctccggaaacactataatcgtcaccgcaaacatctcttttgccggtacgaagggtgtccgcaggctgtgcggggcgggttctccagcaagaaagacagagatcgacatgaggcaaaacacaacccagaaataccttgtgagtgggacgggtgtcagcgggtatttagtagggtagacaacatgaaggatcatgtgaggaggattcataagaggagggagacttgatgatttctcttttcctcacccttataattttcccatcctctctccctccttccttcttactttcctactgctgcccctccccttcatgaaaatactttcacattaacatttttttctattgaacaaaaccaaacgggatatacacagttccgggactgtatggagataaatgggactaacggcgcgatttactggtttttgaggaaaggaatcatttggatttgatttggtttggtttttacctggtttcatctggaaattcaagcgacggcaaaattggccaccagcactgcgggacagtgacaggcaattctgagaactacttactaccttaccaactaaattgactcatcatctactttttactgtacttatacgtgtcttcttttgagacgttcccacttttcttggtttttctttttcagccttgccaattttatgctttctgacgtggtgtgaactaaacagcactacaacactcacactccaaattggtcgatatactgaatctcgttgttccttcttagttgcagaaatatattttcttcccaatcgtctgatctcaattcatatgtagccagctagccggttcaggtagctagtcaaatggggtaaattcaaattcaaatcaagacatcgtaaataaaaggaaattgaagaaaccatcgataaaacgcctctcgttaccatccacagatatgataaatttggggggtaaaagaaaaggaagatgaggacgccagaacctcctatatgtatagtctgaggaagaagcgaaggggaaagtaagataaggtcgcaaattgggtagttggaaatctgaagcgaagatgaagatgaagaattgaaaaaggggtgaaacggtgtaaagagaagatgagggaaacaagtaagaaacacggcaaaacgcccactagcaaagtcttgtacaaacccgtgcacacttcgccagattacttagcaagacgaacgggggaatcaaactattcgaacacaagaagcgaatgacatgatgcgagcaatgcaggaagatgaacgaagtgaataaaaagtagatcaaggctctaacaacatctggtatcactgaaaagggggtagtcgaatagatgtggaaaagaagggggttatgggtggattgcttagttagtgggaaggttcgtaatgcatgtgcagtcagtatacatgaatgccatgatagtcgataataacagataaaagtattgactgcgttatcctcacaccgtcgcatggacggttgtttgagaaagtcaatccttcatctcaggataaatcaacgcgaacggacgctgtcgctaatgcaatatcgtataatggtaacctgcacttttagagcatatcgctgagccgatgatgaaaatgatgatgaggcctatatgggtaataggttcacggaacattatttcgacggcggcgtccacgcgtactaccctctggcctttgcgatagaacctgcctaagagccggatcatctcggctcttgtcaacgtggtggactttgacgtgtctggatggggtgacttgtgagctggcttgtataataatctatgcattcgagtaaagtcttaccgttgcagattgtccggtcgagggtatttgtgctgctggtctggacagaatgggcatacatatccaggcgaattatggacgaggccgtgtcggatcatctcattcttccgtttgaatcctttcccgccgggtccacgcggacagccagctatgggacagaaatgcggacgatcctgagaatgaacatttgcatgggagctgtacatgcgataagcttgggttacggggccggtacacgtgagactgcttacttcaacaggtattgtgtttggaacggggctgcagtgcagcccgggtgacggcatttgtacgtgcctgtggagaccgctccgttcggatgcgtggggggattgtatgaccgatcacaggtggatgctggagtctgatctgtcggggtgggatagcttgttgcggggctcttggctgtctgcggtgcagtctcatacgttgaagtgagatacgttatgtccgccttgataggcggccgccagtaagcctgctgggatgcgggcgacgacatagccgacatatccttcgagcttgccggtgacaagtgcgagtaggggctgggcgggacttgtggcggaggaggcggaatttggcctaagcgttggtgctcccagacaggatctgtccttgacaccgggggggaagaagctgagactggaggcaaagggccgaaagacgagccattcaagcgtccggcactagcaggtggtggtacatcggtaacaccagccaatgccgttgaaagagagggcagattatggttcacggcgctcgccgttgttgatgggtggagggcggggagctgagctgctggctccgatggtgctatcagcaacttgcccaggcgtgtttcaggatcaggtaatttcccatcttgaaacagatgagagaaatgggggatgttaggcggcgtgtgctgctgctgctgttcttctttgagcgcaggttcttccactgggatagacggtcggcgtggtggttccttgtaagcgactggaagatccttcggggctacggatgggcctccttccttgggctcgctcggactgatcaaattgagagcttttctcgcgaccacgtctacaggctccttggtctccacggaggatttctctgggccgaatatgatcttaggaagaaccggaaagtcgtccgctatagtgctgcgttgaagcggatgttcagtttcgaaccaggctatgtcaggtcggttaggctctagatgtctgatcagcaccgagttgccctcagttgaatcgggcttttggaattccggcagcttacgcgaactgctcggaaactgtgcctctgcatcgtgcttgggtagaccgcccttgggtgattgatccccggtatcgaatggaggcggtgacacctttggtaagtaatcaatctctgtgggccgcaacccaggggtgcgaggttcatcgagaccgtatgattctgtcatgaaggcggcggttttaggcgcatcaggtgcgccgccccttactgttcgatttggcctgcctgtcccgttcgagtgccccgaagtgtttcagaacactgtcttcagcccggaaaatagactgccgttccaacggcttgccaagcaagataggacacgatccacttgtcgatcccagatgtgctggcaccatgttagcatgcacacagactagagaaagtggtggcacgacatagagaaggacaacgttggatatgaatagagtacagatgggccagcttgtgcaacgctctcccggggagaaagaaagtaggtcagagaaggggggatgggacaccagacgagcctgcaggacatgggaagaaactcagaagagcgtgcaaaaatcccggaggcggcgagtagcagcctagttttgtaaaatctccaacggcaccaagagctggcccaattgcgacaatatccaggatgcaagtttggccacggatagccaaggaaagggaagaagcaaggtgacaattgatagcaagcaaaccgccagttgaacgatacggggggtttcttattactgatgctgcgcaattggaacgacgggggaaggagatgcaaaataggctcacctgctgtcaggaaccgagaaagccgcaggaaccgcgcaatgaggctcaattgaaagcgattgcacgtcaggactcagtcaaccacggcaccaccgggcgcatagatcaataaatcatgcgcgcgggaattccgagccgcgtggataaaactgggggaggagaggatggggggttgggtgggagggaggggaaagaaagcagtttaggataaggttgaacgctcagtggtggtgatgacgataagggaggtcacgatgtcacggctcgggtcgaaaagaagaatcaaagaagaggtggaggtgcaaggatcagagattggaaaaattcatcgtctaacggcgccagcagcagaacggtagtggtcgcgagtaaagaataataagagtggtgtagtaataataataataatggcagaaaagagcgataatcttaggcccgagcaataatgatgaccgtgtccggtaatcaagggacgctggaacgaatagtggccgatgaagctaatggtcccagcaagcgggttaatgacacgcttggcaggtggtaaaagggaaaaggaaaaaggttaagggtatggccgcggagcggtcagcaggtagttgcgctggaacggccgaaccgaggggaaggatcacagtagtaataaaggaaaaacgaggtgggaaaaggcagatggagacacacggatagtttagttagtttagtttggcgtggccgtcgtggtggtagtagaattgaggagaacgctgagaatcaatccactcagaactgaaggtgatccaccggccgggctggaaaaacgcgggtggagaaagcagcaggtttggtttctggttgacggttgaggtaggtagacagcaagcagcagcagcagcagtacttccgttaggagaaccagaactgtagggaagaactggcaaggtcggcaggagaggggagtaagtagtagtggccgtagtaaagtagcaaagaggtacaaaatataatagttgcagtggttctggttggctgtttcgtctggctggctgggcttgggctagctgggggggaagctgagctgactgatttattgtctctggctctcttctgttctgcctattcggcagctctcgtcgggtcccgattcttgtttttattacttcctcttccttttcgtcttctttctttttggtgtttgttctcttttcttttcccttggctggtcagatgcggaggctctgttggcgtgctttccaagtaaaacgttagtcagtccttggttctgttgtcccttgaagacactagtgaggctccaaaggaaatttggttttagattacttttaaaagggcattgggtgcccacagcaacaaaatagtagaaactggaacaagagaattatgaagaagaatccgcaggacaaggcggaagaagacggagggaatgaatgaagctgactctccagacgcgcgcgccactgcgtgcagacaggcaaacaaagtggggtgagcatggagggagggacaacaccatcaacccgggtggagagaggaaacaagcaaaatttctacctaccgacaataatcctagttaagacaatcaacgaccattcacgcttttcttgccggggcgggataagtaaagtaagagcgccaaagagggtgagaagaggtaaggggacggagaggggaatgtcttgtgtatgtgtgagatgagggagggagcaagaaaggcgggttcagagtgtctctcgcagcaagctagctgtctgatctagtctgtctgtctgtctgcctgtctgtctgtctgtgtagtagtgagtggagtggagtgagtgagtgagtgtgtgtttccttcagcatgctcaccttttttttccgttccttttcccaccccctcgccgaccactgcttggagcaggaagaataatgccacgtccacgaggccgacccgcggcgactagactaggcccaaaagggctccacttctgaggctctctgcatggccagcgatgattggtcaccacgcgcgggcacagtttaagaggctgaattgttcatctgcaccgaaccgtcgtagaacttggctgctgctccgagtgaagggaagggggtgtgggtgggagggaaggagccgtggatgcgttggccagcattttcctcgtttctctactaacttccatggcccaactcgaagcttttctcatcagatgatgcggctgtctttctgactgactccttcctttcccctcttctccgatcggataaaatctatcgatcgaggatttaatctacccttgccctactgtagaaaaccccccttccctctacggttaacaatatacctataatatagtccacaggttttattaataaatggcccgtccgcgatcactaacagttcatttccctaaataaaaaaagaaaaaaaaaaaaaaattctctctaattttccccaaccacaacggccggctaaggtcgtactcgggtctctaaggcgacaaggctgcagtccacagctggatggctgaccgccacgggaaaggacgcgccccagtgttccttccagtcctccctactggacaagcctccgcctggtccgtcacacaacctgcagaaggggctcgcacgatagtccagagcaggaatctgcatcatgtgcggagggcagtgtgatgagtggcatatgtggaagggaggaggcgcctcaaagtgagaatgaggctaaaagagaaaaagtaaaaatgggcatcgaaaataaatataataaatcaaattcaagaaaacaaaaattgattgttgtacatttttggatttttctgaaaagaaagacgaaatgaagagaagaaaaaaaaaaaaaacacctcaatgagatgcactggaaatagaataatcaacagcctcgctctaagagttacaacggaattacaacggacccagtgctcctgactagcagaagatagacttaaccacaacagctgccgcttttgctaaactaacgtcgtcgcccgtaacccctccgactccgactccgactactttgtgtgcgagcaggatcgaggatacggctgcaccgagtacacagaggaatggggctcagagccaagtaagttactagcagggctaaaaacaaaaagaaaaaataggccagggaatctacttaaggtacgtgctttgactgtggtattttggctgtcagagagcgtagtggactgactaactagctctccgaccgatcttcattattattaatcggtcaatcagtcaaaccatcaaaccatccaattcttgattccttcagacttcggccggtgagtaaatctctcggttgatagttcccgttagatagatacttggtgtgtctgtctaattttgacatccagtggtttggtttggtttgcgtcggaactttggtttcgatccgtgcattacccagtaccgtgaatccgaacgggtctggggcacggttaaaggagggtcccctcccctttccctaccagagcgggaaaggtgtgagtagttggtttgagccggacgttgtggaaattaccagtaggacgggatcaaaggctccatcatgtctattgctatttgtgcgcctaccgagatggaatgacattcttatccacttgaaatttggttgagagaacggcgcaaactgaatggagagatcgatcaaacatggcatggcaacagcagaagagaagaagcactgcaaagacaagcacaagccgtgtttgatgtgcgcacccacccactcaccccctcgtcaaaccggccatgtaaaaatttctgacatgcagaagaggaggtaagtagttagagagggagagggagaggaagcagagatgtgagtaagaggggttttttattcccaccttgccttattcaggaaggtcgatagtgagaagaggtacacactcgactaggatgatgaggactagtgtttgcccctagctggcgcgcgggagggacggagggggagggggggaggattagaccacggagtaatgatttagtctactgtgtagtactctgaggagtagtctagtaagacaattcttagctgaacacaacagaaaaaaactggttcaagctggacaaggccgcaagttccaactgtcactctgcagatgatcgggacgtatcgcaacacggccccacgtttcccctctcttcttttctcttgtctttctggctggctgtctagctgtccgtctcttccttcccttctctactccttagtttgctccactcgtcgtcagtgcaccgacttcctcactttagccaccggcaggccagcaacgccttcatcggacagggttgaagaatgcgatcgcagtgctgatcccaatatgaactgcaggtatccccatctacatacattattattagcatgccgacgttgcattcatcggatggagagcagcagggtacttacctcgacacgactcactctagccgagtgagtttcctctctcatgactataatcttgacagcagttcgaccgcgaaaatgatatatgattttccccaaaagggaacaacaacataccgaataacaagctagctagcttacaatacaatccctctaactcaaatcatattgaagatatagtagagcccacccactaagaaactaacatcctcaggtagcaactacagcgggctacttacagccccatccaaaccaaagatcagctacactaactaaaatcccctagattaaccaaatatttcccactactaagtagtctatatctagagtcacacaccaaacagggagcatttaatggtccatccaataaccacccgctaatcaactagaggcggcccgccccgaagcaaatccatcattgctctgcctctcttcccctcctctctcctcttctcacttatactagttactaccaaccccctcagttagctaaacagaatatggaaatggactaggtagatcatcatcagtttcgccatcatgattcatttctgcatgtgaacatatacatatagaccatctactctttagcgactgaaacgtcaacagggatatatagaacaagtaacacaattctccgtagtacttagtagataaaccccatccatgttaacatttaggctccagagtaaagccaattggccaacacgactagttcacggcaaattaactcacttctggtaaagtactccgtactcaacgaaggattatattgagttagatcctgaacgcggaacttgagcgagagatacacaggagttagtaaataattttcaaaccccgatcgatcgagagaaaaagaaagtacatcaactcatacactactttagcaacttcaccgcccccaaaattgaaccattgttgtagactactatctgcaggaaagaaaggccagcagatctgaaggcgataaaaaaaagcaaaaaacaaaactgaaaattaaaaaataaaaaaagaggggaaaattagccagcaaagagaaacagacaaggcgaagttagaagaagaggtggaggtgtgagagcctcggggggttctggtccattccagccggaggttccacgcccgccactgacgttgctcaaagggaaaaaaaaaagaaaaataagaaactaaaaaggatttgaaggaaaaaagaaaaattaggaaaaagaaaatcaaagggctgcggcggctgttccatcatcatcatcatcatcctcatcatcgttactcaagggtgggatggtccgagttctggcgctagactcttaaacgatgagaaaagatgttactactacaccatctatctacttagttcggaggaacttgcaggggccagaagggaggggaaagagaggaataagggagggacggggaggacggagacggggaggaacggagaagacagcggaagtacctaacactacttctataaccacggagttatagtaaaatagcactaaatatatttactagggctggtatcaagggaaaagaaaaccaaggaaatgcaggcccgggagccgcacccaattaagtgccgcaagccccgatttgcggttggcgctcgtgctgactctcgcccgttaactactggggagggagggggggaaggggaatggatctagcgcagatacgaggctccatccagcgtcatcatcatcgatatgggaatgctgttgttgttgttgctgcagcaccacggctctaggtaagccgtgctgcgtatttagcttcctttgctaactagtttagctgactagctagagagctagttagtagttagcacaccactttcataaacctggcctgacctgactccaaccaccgccccccacccacccacccccctgctagtttagtgcgatgctcacagcggccgacgccgggcttactggcgcttggactcgttcggcttttgtacgcctcccgtgaatgaggctagtgtggtttttcttttcttcttgcatgcatagggtcaccttgcggcgatttgggtagtacgatgttgggggctgaagtgggagtagaggcggaagagtaggtgaaggatgaggcgagcccattctacttagtactcgggatttgattgttaactttgctttcgaaatgcttacttcttccgttcggaatctccgactggcaaggctatttatcattcatggttgtgtgtctgtgtgccggcttaccgtccatacatacctacaagggtggtcatgccacgggacagggaaaaagacaactaaatcatgatatcgactccacaccagggtactagaccttgtgaagcaatgtaaactctatgggagaattaatttatgtctgttcggcttgacgaaaaaagaaaactagttacagcctggccttttgacccagctgggctcgcactctcttaacacgttcccaagcctcgagcgcaaaaggctccgtatttctagcatattccgcagcgcgggcactactggcctgcctcagggcataccgggccttgataccatgcataatcaccgagcttctccaggagaagaaagcatcaccccatgggatatccccagtggggtcataccccgacacctcacgataccaacggatacagtcctctcgagcgggcaagccaggcactaccttcgggacgaacatttccttcttgtggtccaccccgtccaggaaaaagggactagtgaggttgcagaagtcggacagagggtgccccactgtggccatttcccaatccaagaggccgatgactcgcggctcggatttgtggaatatcatattatcgatcttatagtcaccgtgcacgagcgtgccgcggtcttgcggctgcgtcgtcttgtcgtcaaagaaacgcaccatgtccatgaaatgaggcaactctccgacaggttccttggtctccacatccacggcttgtgcctgcgcctgtgcaactgctgtgaaggtggcgatctgtcgatcatagtaccccgtcggttttccgaacctatccaacccgaccttttgggggactacccggtggaacttggctaatgtccggaccgcatcctgccatctgttggtagggggggcgtgtgtgtggttagctccaatttttcccgctttcatgtaacagtagccgcgccaggcgggttgtatcatcccgaagaggcagggggaggggggcaagggatgacgtacaatgctgttctctctgccgggtcgaccccgggcatggcaggatcagtaaagtgtcgtccatctaggaattccatgatgtagaagggggttccgattacgctactatcctcgcagagacagtaggctttggggacgggcacgtcggtgtttcctagggcatggatgatcttgtactcgcgctcgactttgtgcgcagtcttggagagtagcttgcccgggggtttcttgcggaggacatatttgctaccgtcggcggtggtgagttgatacgtaggattggattgaccaaagccaaactagagactgtgagttgtgtggccaggacagtaattcggaagggtcattgtatacctgcttcacatccaagggggtcttgatatcgggtacattgagattgagatagcgttccagggagggaacatcaataggttggcgcaccgctccagccatatccaagacaacatgagattcagcagtatacagcgagactatgcaccaccaccaacttctataagacgtagcaaaagcggagaacaagtcacgctggggatggaataaacccggggatagctccgatctcaagccagccagccagccacggcccgcggctcacctgaaaggctgcggggagcctcggctatcctgaattccttacccatttagatctagtggcatactcactgttactcagtatcagaatcaaacagcccaaacccgccaagcccattaaaacgcgcctcgcgtccactctcaccgccagacgcgttcccccaaatcgattgccagcaatcaaaccaaaaaataaaagaacccaccatgaagggcctcgccctcgccctcgcatctcgtcgatttacacaacacaccgcatttccaacactccattttcctcttcaatatttcttcagccgaagaagaacccactctcctttctctccactacacaccacccagataatgaccaaggagaccacccctcctcctcccaccaccaccaccaccgaacctactacaaacacaactcacgagcccccctccctccccgcctctcccctcgccaagcgcaccaaacccaacaccaccgagcaatcaacagaaccgtccacaatgggttcaaccagcacccctctcccccccctccaagtgaagaagctcactcctaccggccgcgccccgacccgcggctctgccttcgcggccggatacgacatgtacagcgccaaggagaccgttattcctgctaaggggaaggcgttggttgatacgggaattgcgattgctgtgccggaggggacgtgtatgttttccaccttacccccctctacatctaccctgatgtcgggaatgaatagctgattatgatattgtggtggtatagacggcagaatcgcccctcgctccggcctcgcctcgaagcacttcattgatactggcgcgggcgtcatcgatgcagactaccggggagaggtcaaggttcttttgtttaatcattcggatgtggatttcgaggtgaaggagggagatcgcgttgcgcagttggttttggagagggtatgtcattttacctcccttcttcttcttttatattatttcaatggttgtggttggggtcaattgctaattgtgaggtctagatctatacccctgaagttgtggttgtggaggaattggcggagagtgttcgtggcgctggtgggtttggaagtactggtgtttaattgggattgcttcgacaaggtttatgttatagatatggcgtgtatggtttgaatgatatccgtacaattggaatacaatacaatacaattacacgagtgagatgagataattagcatccatatagtattctgaagattgtattggtttgtccgtcactgcatttcatcatgactggtggtatataatgaacacccgtctataactaatctataatgctcaaacaattcgcctcccatcgttaagaatcaacgaaactgcgccggcagatcctcccgtcgccactcgctcgcctgaaactccacctccggttcccgcagatactgcgcatgccgtaccacccgtacctctgccgccttgctctcccgcagatgcgccctcttctgctggtcctcctggctgagcagcttctcgctctcatccggaacaatggcgcgcaactcggcatctctcgcctctagcgtcttctccagcacgcagtgcatactcgccagcaccttccgggtagactgagcaaggggcaactccgttgcagggacattgtcgggcgaaacccatgatttggtgttgcggagggtgggatcggcgttgaacacggcctcgcggaaccgggctaccgtgagtgcggcgaacatgtcgccggtgccgctgaagtagcagtccagggcggggacgtcgatgcgaaagagacgcggggcaccgtcggagcgggtggtcgagccgatgacggtgagggtgttggggagcggagagtcggagaggctggcgatttgcacggaggtgatgatcacgtgggggatgttgtatatggcgtgaagagcggtaatggcttcagcgagggtggcgagggaggtaattttgatgccggagaggactctgctctggttagaaggagaagcaggagtaaggaaagagggatggcttactcggcttcgaattggttggggaggatgaggtctgcgtggcggatgaccttcttgtatgcggggacgacgtcgtcgttgacgtagagacggccttggtcgcccattacggggtccagaactgtgcatggttattaatgccatcacatagaacagagagagagagagagggcagctcaccccaaaagaaggaaccgggattcttttccgctttgcgctggaggtccatgccaatggccccgacggcctcgacggcagctgcactgggcgcatagccagagagcatgacatcaaagtcaagtaaattgctctgcgtgagaccctcatagagcgcggtgatctcctctgctgtggccctagtgcccttgaattgtctataaccagtgtggttacctggagtttgtcagtagggcggtttacgcagaggatatatgcctgcttactgaagtgaacggtgttcagggcggcgacatcacagcccatgagctgcatgaccgcactggccatcttattgcccacatatctgatccgtcagtatatgcaagcatgcgatgtgatgagacatcatgatagatagaggtgttatcagatatgacacatacccgtagacaacctagacccttgtcagcaatgcatgggatacgccaatggtggttggggagaaacatacatggctggcgacagccaagaccctggtctcagggacgagaagatcggcggacatgatgaaatgaaggggagctggtggaggagaagaagaggagcaggcgggcaaggaagggaactcgatgtcattccttcctttgggtcggcgataggcgaggtggacctcctggttttgccgcgctgctgattggcccacagggccggtgtgcagcccgtgctcagtcgggagtttttttttatcttattaagggattccatccggcagttcttcttagtagataacgttacttactggttatttggacaatcggtgctggagaaagaagaatatcttggtccccccgagtcagtcgtgacgctaattctggtggcgccagtttcagacgagaacacaacaggcagaataaccgaactgctcagctatcttgtgaaaagttctctgctttgtactaggagcaaggagtccaatcagttgccctgctaagaataaaccccgggagtccagactctttgcccgtcggtctagtctcgactgttccatccagcctataccacttatgcccgtttttctttggcgcacggctcactccgtcaggcacgcccctgaccctgctcgtgtgtgtgtcttgtccactatgtgccatggctttaatcccgttgtgtgattgatcccgttgtagtaccgtagcctcatgggttagattaaagctggttccctcccccgtccatgggtgccctaattcatccatccatccatcccccttgccctgccaccgagcagtcatttcaggatcatgtaatttgttcacatccacactccttttgatttctttgcctgctatatactacacacactctctttagactgaactctgattactcagagccattcaatcatcaccaccatggtgtccatctacacgccccgtgctcgctcagcacgacaacattcacaacaacaacaactatccatccttctctgcaccctacttgccctcccatccgtgctaggatccgtgctgccatccaccgcagaaataagcagtggggagatcgtcaatgcggatctctccgcagcacataccaccaccaccaacacagatcaaccactatcactatcactatcaccagatatcttcaccaccacaaccaccaacgccaacgacgacaccagcaacctcaccctgcacccccgcagcaccaccaccaacaccacatccatatccaccgacacgaccgacacatcatcatccacattccccaccgccttcgacacctccctaaccaacaacttcaccaccaccacctgcgccaccttcttccacaacctcctatccaacaccaccctgacctcctgccacgccatctcgctcctcctccgcgactcgacctccttcttccacgccctcacctccgcccccaccacctcctccatcctcgacaccgcctgcgcctcgaacctcaccacctgcagcaccgctctcacctccctcgcctcgcaacttctccaatcatccacctgcctgcacgactacaacgccggaaaccaagccgtcgtatccgcctacactgatctcattacctacgcgcccatctaccgcgccacgtgcctgcagtctccagagacgaacaactattgctttgtggatgcggtaacgaataccagtaattctgtggactatgatgtgtatttcgtgccgtatgggagtgccattgatgcggcgccgtggcccacgtgtaatgagtgtttgcaggcgacgttgaatgtgtataaggagtatgcgagtgtggatgggcagccgttggcggagagttatttgccgacggcgaggggggtgaatggggtgtgtgggagtgggtttgcggatgttaatgttacggtgggggtggtgaaggatggggttagtagtggtggtgctggggggaggtttgggggaggcagttggggggtgatggtggtggtggttgtggggtggagtgttggctgggtgattggggtggtttaggtgagggtatgatgttatatgatgtgatatggttatggttttacttgggggggaaaagggattatctaatgtctatatttaaactctaatatctacattcacttatctccgtttcatagtatgtggaaaataatgtcttattcaaaaccaggtatatccagcccgtaggcaaataaatgtatcaaacagtgcagaagaatatcacaatgtggttgccactatatcatgtcgttacaaatagtcatgatacgaataatcggagggttggtgaagaaggatattgaggaggagctaactccgtcggaaactgtcgcccagcgctacccctaccaggctttggggcccgaagctctcattccccaagcctgacgctgggctctgtgtcgatgcgtctctctcccgcttaatccggaagaaggccagcttggtgaaccggttgagctgcgcccaaaagtgtcgtcccgccggatgcgccgcaatgcgctctaggagatcgaccgccgcctcgcgcactggctggtgcggatggaacaatcccatgccgaggtagaagagtcccgcctggttctccggagtcacggtcaagagttggcagatgcctgcgtagtctttgaccgcgtgtgcaaacgaaatgtagatcgcccccgcatcggccggcgggagcctcagcgcccgcagccggtcatggtgatgatgtaggtccggcttctgaatcggccgtgagggataatacatggctgcaatatcttgaataaaggaataatacgatcgcgtcgtccgccagccttcaatccgcgccaccgacgccatcagctcgcgttgcttggacccctcgtccggccacacataaccgtgtccacggagtgttgtcggatcgagtggatccgcctgaaggccgcttggactttcgggcgaaagctcttcgttgggtccgataacgtaaagattggatgccccatagactgtctcctcgaaggctgcagcaacccgggtgaacttggcaatataggcgcgccacttcgcccggatggcattctcgccgtatcggttggtgatgctgcgctgaacctcctccataaagacattgtccccactgggatctgcattgttactcggcggtgggtggtggtgcatggcggcttgttgctggaaatacaagagtccttcggtgactggggccggctcaatgtggctgctgatcttcattcggcccgtgggcaaatcgcagagcacatcccaccattcgggatggttggcaaaggtaggatttgtgacgccagcaatgaaaccagggaccctcagcaggtcatcgatcttcgtcaaatcggtgtacgggaatgcgtgtctggtgaacccgcgcaatatgccgcccgacgcaagggcgcacgccgccaacactgcctctgccacttcgcctgaagggcgattatgccccaggaatatcactcgcttctgagtcaacatggcgttgacgaggacaatgatcggatgggtaaagggcccgctcgtagtgaggtggggatggatgggaaacggctgtggcgaggccgcatgcggagtagaaaagatctggatgagcttgatgagggaaaagtcgcccacaacctccggccaaatgaccgtcggcaccttgacaggaataggaatgtcgttgtagacgatcttagactcaaactcgtgggtatctcggggtagcgtgtatcgaggggcggctggccttttcggggacgggggctcttcgtcaaaaggcccgccatcttcaacttgtcgctggtggatcatctgctcgaatttctcaatgaacatatccttacagttgcttgcctgcaagatcagtcgttctaaaagcgatagcctcggcattaacgacaggtccatggcgttcacggcatcgtataacgatgcgagcgtctccgggtaggggttcttgaagtaatcctccagggccaagagaagtaaaggctgtcatgaccggtcagctccatcacatgcgccgttcttttgggtgaacctactttatatatatgtaggaaagaatgtcgcgtacaaatcgccatggctttgacgactgcaccactgtgattgttcagtattgaccaggcagcccggaaaccatagaaggacataccgtttgacggaagtatcttgcttcgtatttacaaggttgagcacatacatcaagggtggcccctcgccaccctcttcttcgtcgctgctctcctcttcggttgacccgcctacatcttcgctgtccccgtcgccgctctccgcgtcccctatccgggacttctttttcttctttttcttgccagtactagcgtcgtcctcgtcggcatccgcgcttgtgtccttgtgcaagaagaagatcgtccagtcctgactccgaacgtgcgtctgatcgggaagcatcagttccgctagcatactctcgtcgccactgattgcggcgggatactgatgctccatgatcgggccgcggtcgatgtggaacgaggccacaaggatgtactcgacatgtcgctcgggcgaatctcgggggtattgcgatttgcatcgtcgcggtctggggtaaagagtagagggaccttggcccagcgagcgacggcgcgccgagttccccgaactactgggggtgcgccggtggatgatggaaggggaaggggataggcggggatggccattggccttggaaggattggtcgtggccgcaagcgagagggtggaatcatcagcaggtcggtagggtagtgagatgctcattttctggccggggaacagggggtcgaggtgggcacgggggtcattcagatcgagagcggatcgggggtggcaagtgatagctccagaggaccggcgaacaatgagcacgaggataacgataatagcagcatactcgatcaattatcccagtagaaaaccgaggcgacctgactcaggcaactgatactgttagactgtcagtcattgtcggggttcgagagccagggtggacggggtgggaggttcgtcgatcggaggattagtcgggatagactcaggggaaaaagaaaggggacgagagcctccaaagcccacgcaccgacgatgatctccacagcggggaaaggcgacgggagacaaaccagcaccaccgaccgccatggcctcaatgcacgcagttgggggaagagtgcaagtagattgcaatgggacgcaatgggcacggggaaattctaggccatgagatctagaccacaagataaaacacttgcttttagatcgatgataataatagaggaggaggataccaataatctgagatggagtgatcggatctctttctccgtgcagttcgattgagggaacttcagacttgcagaactgccgcttcttgcctttcttgggccccgcacgtgccccctccgtatcggcccgacttgaacccccgaagccttgttgtttgtttggctgcctttcccttctgggaactatgtaatggatatctccatccccattctatcctgccatcttcccctcttgatccctcttcgctgtgggtaatcttcctcccccaatctgatagggaacaatcctgtacagttgcatatcatcgtcatattcattttctcaccattgttacttcatcatggtaagtgctcactctcccattccctccttccggactccgctcaccgccgtatctccaggtcacctccaacgcccccttcaggccatcgccattatcatttggctcccctcgaccctccccttttcgccgtccttctacacccaactcccatccacaaggccgctcaagcacccctggcagttcccccggccgcggttacactccggttcagtcaccgagcaaactcaaggaatcatacaccgtcgaggaagatgacggttcatcacccaagagcaagcccagaagtcccattgcacagcctcggttcacacgagaggcgcccccttcgccaacgaggggcgccaatgcgccggattcgtcgccgtcgttgatggaagccaaagctacgaacatgatggcggcgtcatctgacgcagcagctaaactaccccccgcacaactgcgggaaatccgagaggccttccaagtcctggaccgagataacgatggcttagtagataaggacgacgtggcggatgtgcttacgaacgtgggtatgtaacggaaggctagctagtcgatcattttcgggcgatgacacatgatactgacgcaatgctgctcgacaggccaagacccgactgccctttccaagttcttccctctaggaggtcctcaaaccatgaatttccccaccttcctcaataccctctcacagctgctcgctcctctttcttcccgccaagagctcatgaatgccttggcggccttcgacgaagacgatagcggtcagatcgacgtcgacgagctgcgcgatgccctcttacacacagcatccgaggatggagaccaccctctaagcgaccgggagatcaatgaagtgctcagtggatttacggggcgccgagcatttggcgggaaaggtgctcgggcggcgggcggagggaagaggggggaggtattccgataccaggactttgtcagtgggatcatgggagggacggagaatggatcgacgaatcgccgcgacgcctagtagatagccgcaacggcggagtgggaattattgcttatagttcggtaacggcgttcggatgatgagggataccgatagttagggaacccgactggctctggcagccattgacctgcaattctggatctgcgtaggagacgacaaacgacaacaacaacaacaacatgactacttgctatatcgtagatacctttcagggcagctccatcttcgggaagttaaacatgactgacagccaggaacatgtcacgatggaaataaagttgacagggcgagaataagacaagactcgtgggcccgcgaggattaaggccaggaatttcccatggcaactgagctttttttgctcgcgtcgtcgcgtgtccccgcattccgtccgtcggcaaaaaaaagcccgccatcagattgaaactctgagagggagagagagagagactaaaagttagtgatgatcccaagctgcagcagaaccccctaagaatccattggtttcttgcatcgtccccggcgtcgtttcttttctccaaccattcattctcccctcccaatcctataactactcactactttcacatgatataaatctctcaggatccctttttttcttttctttgtctatcattattattagtcttgtattcatggatcatcttcctgtccctctttgatccggtgtttcaagggaagatggttttgtctctgcgccagacgcagacccccaatccttgctgatccaatcgagcgtctgtccgtcacacctgcagcagagcccactcttcctctccctccacccccagcccagcatggcgccctccgaatcctcttcttctccctcgtccttccatcccacccaggcccagcttaatctcgctgctctggctgggtcaccttcaccgcggaccatgcgaggcttgcgcaagatccagtctcaccaaatcctctcatctcacccaccttcctcagctcatccgccgtcggggcgcttgtctgctggcgccggggagctcgcccaacctcctcagctggactcgcccgtgcgactgcgctcgcaacgccgggcgcgctccaacagcgatgcctcgtctcgggaggcccctgcgataggaactcaaaagcgatcggccagaaagacaggttctgggtttggagtcaagcgctcggtcttggagactctcctccgggacggtccgcaccagggcaaccttcaggagggtctccaggagctccggtacctcgttctctcgacacgagtcgaagcagacgcggatggcatggtataatagcccgaccccccctcccccctcgtgctcattctgcccctcgtggaatgaagagcaacacgtccactaacactatcgcgacagtccacctaccgaatctacctttggctcgtccttctcgatgtttctcctgttccaaccgacgaatacctctccctcatccaccgtggtcgctcgccagcctacacgaaaatccgcaatgatacattccgcaccatggccacagaccccctattcaaacgccgcgtcacagaagccagcttgatccggcttctcaacgctgtcgcatggaaacttcacgacgcgaagaacaaataccggtcgcgattgcgtccgtcgtcccgtcttcgagagattgagctcttaatcaacacacccccgagcattgaagaagaaccctccccatccggaacaccaggtagcgttgccagcagtcgcggcggcggcagcgggattacaaacgaatctgcgatctacgtccaaggcatgaacgtgctctgcgctccgttcctctacgccgcccgcagcgaagtcgaggcctttgctctgttccactcgttcattacacgcgaatgtcctggttacatccgcggcgccatggatggggtccatcgaggtctgcgcttggtcgaccaatgtttagagatcgtcgaacccaaattagcggcgtacctcttctccaagggcctacaggcgaaattgtatgcatttccgtcggtgttgaccctctgtgcgtgcacgcctcctcttccggaggtgcttcatctttgggactttttgttcgcatacggaacgcacctaaatatcttgtgtattgtggcgcaattgattcgaatgagggacacgatcctggaaagtccgaagtatgtttactttttgttttttcttaacattttcccttgccttttacctttcctactctggttcattcccccttttcatgtttgtttttgtttttctcgtccgcctcatcctctcgaaaaagcaataccataccaccaaaaacaaaacaaaagacggggaaaaataagacaaatcacatcccctcagagcacagccccgacacacaagtccctctgagagaataattctcctgggcatgatatgataccccccaaacccaaaacaaagcccgcagcagatatcccagagacattgtgatgtgaggtaacagcgctaacgtgatccatccacagtcccaacaaaatcctccgatccttcccaccactcgacgccaaagagatcatcgccctgacggtcctgatcgtccgcaagatccccgagccgctgtacgctgaattaatcgaccatgccaaatgatgatggcatcacttttctttcccttccctgttttccagctagctagctagccagccagccagagagcccagctacggcttcagctacagccagccagccagccagctagctagccacgaaaaccaaccctaagcacctaccacctactaccaccatctaacccaccgaattcgccacctaccactcggacccagacccagactccgacccaaacaatattccgcattgggactaatgtgtccgtcccgtccggccgtccgtctctccgtcccaccactacctgcctacttatattaacgcctcttattttacccttttcactttctcacgtacgcgcgccggatctaacgatgacctaattgagacgtctcgtacttaccctttttgtacttgtattttacatttctttttctttttcccttttcgtcttttttgaacagtttctggcgttttttttgtttttccttttctcatgataactaaccgactaacctaacctactgactaccattactgtatgtattattgattgttatgagagcatgatatcattgatggaactgactgagatatgagaaaaagatggaaaaagcagaaaaaggaaaaagaaagaaagcatataggagcagtgattgattgatggagatgaggggatgtattctagatggagatgttgattttttttgattgattgattgattgattgaccatgttatttaaaggttaactaactgactaccggtcgggttggtcagatagatgagatgagatgcgatgactcatgagtgaaatgatgaaattgattgaatgcatcatgctacttgcagacagatttcgatttctttgaattgatagaataaggatacactactagaacatgacttctaaccaaccaaccaatcattctatctatgttatgtatgtaatcaccgtttgaacgccccgggacgccgtaaatctcactctggcagtcattggaaaccttgcacataagtagagatataagaataaaacgatcatgcacatgtaactatgatcacatccaattccagagcacatcaaacatagactgattcaaccccatgatcccgttctatcccgtccttaccctctgcagaaaacaatgatgatgatgataagatatctgtttatcgactattactatataggccggccagtcaatacttccgtcagaagtagtgatggaatgtgtgcggctaagtagccactgccttggttcccgtgttggacccattgacgactaggggtccacagtggtcgcccgatttcgacgacgttgacgtcgatgaagacagcgatgatgacctcgggctgttgccagcaccatatggtccttggttctttgcgaccggactgttcgcgttagctgatggtgccgaaccggcatgtctctcgcgggtcaggctgtaagcgagatggagactccggtcgatcttgacgcgaattttcgcgtccataaagttgatgccgttgtactgcgctacaacacgcttggcttcatctgctgtgcgtagggttacccgtgcgaagcctttacagcggccggtgtcgggatccgtggacacctcggattgctccactgtggcgccactttcttctatgaaggcgcgaaggagcttgtcggtcgtggtgggactgagattctgcacgaatatagttcgtcgtggggaagaacggggacctgggcccccggaatggtagatctgcggcgcgaacgccggattgtagccgtaggaagctttgccggacatgtgggcccgacgtccgggtagactaaaaccgccatgtgctggggcatcaggaaacggcggcatggtcggaaaaggatatgcggggaagacgggaatagcgaaagcgtcgccgaaggagtggcggagaggagcgggcgagggcgggatgcctgatatgggctgttgtgtgactgggtctgtggggaaaggcatgaaaggctgttgaggcattgctaggggattgaccatggggccgtaatcagtggctggatatgtcgggcagcttggactggcagacaagataggtctatgagttgtcagttgtcgcctgaggaagaaggggagccacttcctgtacttactcgggggaaatgggagacggaggcactgccatgttttgtgttgatcgtggcggagttgagtagcctggtacatagttgggcggaattacgcaggttggactcttcgtgggcccagcaattggtcgtgtaggtgagctggttcgtgctaaagtgacaacaaggctctggccttcccagccgttggtagaaagcctatctagaagcaccctgtcagctaatttctaaccatctgagtttcatgacgcacggtaggtcctccatgcttcgtcttcgttcttcacgatgatctgtccaagaccggttgggaatccatgctggtcatcgtagaccactgcttgacggatatgtaaggctgtctggcggactaggtccttgagctcttgccaacgacagtgcgccggtatctgcacccatggttagacaaggccgcgtgtatgagatgtaccacgtgcgagacataccccctggaggaatagaacaaattcctcttctgaccttccagattttgccatccgccccttctcgcgtggagggaaaggcatgatagtgtggtatagtagggttcgatatgtcagatcccctgagatttcggagaatgaatgaagaggaggtggaccccgtgagtttaaaagcttgtgatcttctatcaaacggactagttccgagtcctttaagcttcaatgcgcaagatggacggagttagcagggggggtagtggcctagaagctagaatataagtatcggggtttggtctgacggtctcatgcccgggtatgaccaatgatgcccaaggggactatgcttactggttcgtccttgacaaccccgatcgctaatcagacaatcacgtactgtttgaaataaagaagccgatccacaggaaaaataagagatcgaagaccagtgcttcgtgggttttatgtcaagacaggaagacaagcgcccgggttgatcgacctcctacatcgaaagaggcccaccgatggcgaaaagtgttgaggtcggtgctgaaggagcagcagcagcaaccgcggcaggtagagtaaggagggccagaataagaatagcaaaggcagtaagaatgtccgaggaaatggaaacagagaggacagtaggacccgtgaggataagattagtggaacgaggccagaaagcagagtgaaaatagacgaaagccaccgatgcatccgctgacgaattaaaagggggcgcagttggtgctggagagcttgcgagggaaatccgggcctgatgcctggagaagactgggatgggtcaacttggacgagctggcaaaggcagatggggaggagaaggtggtagtgatcgcagttgaggaatcgaggaaggacggggtccaagcaggctgatgatgatatgtcatgcatgatcaacagtgatggataagaaaagatggagactcactattgagcttgagtggccgaagaagaagtgatggagccaggaaaaaaaacaagatgagaaaaaaggaagtaaattactaactagttggatgaattgaatgaaggaagagatggggggaaaagaaatgaagagaaaaagaaaagaaaaaaaagtaaatatagttagttagttatttagtatgatggctgactgacttgctgggcataaactaataatcagtcattcagtcagccagtctgtcaatcagagccagtaaatataagatgaattgagagatttctatttgtagttactgtaataataaatttcacagagtagtactgcgtgaggttgaactaactagcagccaatacgcctcaggtagcaccaggaaaaagtactgtcagagactagagaagcagtgagagagagacgcagaggaagtatatccttgatttaatcctgcaatgattggtgaagatcggaaagtaaatgacgatgagaatagggacacagtctcaacaaaacaaaccaacccaacatcatcgattcagcttttcattcaatggcactcactcttcaacaccaacttcaataacctccataggcccataactcatccctcctcttttctcttcatccgcgccctcattccaatacactcgagtacgtcacgcttggcggacagggttacaccgccagatctcagggcagccacaacaacaacaaagtccctgtcctgttctggagtcagagaagtctaataaattagtttcgaatcaaaagaattgacacaaatgcattaactagagaatataccaattgctgatgggaaataaaaagagttgatggtggaccatccgccctgcatcgccctgaaatgcaaatggcattgtcatcaccatcatcatcatcctcttcttcggtcagccctgcagtagcctggaatattgcccctcaaagaagggcagccaaccaaaataagaagagatcgagcattttaccgcacagctgatgcgataagaagaaaggtgtttcttttttttctttttgttctgtttccttctcaccctttgggtcaccttcaccatattaagaaagctgcactgcaaacaaaaatagaatagcctcagccctgaaatgggggtggtggagttacacagtcggacttgtctcatgtctgatcgtgaaagactgcagcatcttcacccgggcttgacctctaacccccctctctcccctctctcattcggtctctcattgctgcactagtaggtcgggttaattgtctcgtctcagcccatatccccacagatagtcatccaggattgcatcgcagcagagatcacaacgcattgaaatgaattgaagaaaaagcagatcagccagaatacccaagcaagcgagcttcacaagcagcctattgaacacttgcgtctccccagtcggatccagccttgccccttgattcagttcttggaccaccccgattcggccgggaagatccttgaagcagcctgcatatgaggtatccattccaacgacagtccgtcagtcatcgcctaagtaggtccgccgtcttgccgcccgggagtacctgtccactccatgcatcgaaaccttgccactcaggtcaccgccggtgctgagcgatacatccaaaagaatgtcacacggcagctggccgtatatggttaaaaaagtgtagtcaccgggaagcgttggacgggagacatccaaccaacgcccgggcagcaggcgtcaggctccggtaaccgctgcgaccaatgcggtttggtctagtgagaccaggagcaataggatgaggagggctgaaagtgaatggggatgtcatcgtatccctcttacgggaacctacagttggaaaaaagaataaaataaaagagaaagttatcaggaaagccactctaaaaagccaggcactggattgaactgccgagataagccgctgcaatccgagtctaatctgtccgattcaagtaggggtggttgtctgcttcaggcgcctgagatctcgcctgtgtgtttgttttgtccatttgattaagcccagatgagtcacgatcaagagagcagatcgcagactatctagctacctcccccccggaaactccgctaaaattcgatagtcggacgatcgacccatacaacaccgtagactttagttgggtgattactaggcacgccctcgccctcgccctccgcccacgggcccgcggctctggtaggatctcccactagcaactgagtatacgttggaagactccatacccaaccaggcgaacaatctagaagggatcgaggatttcacgacccatcagggtcccgcgggccttaaacttgaagctagaagatgctatccatcgtggctggctccagatctgtttctctctctctccacttgggatgggactatcttaaacccatccatattcccgatcagggaatacgctggaggttccgggtggattacttacttgtcgcggtcgcgtggacaactaagctttgatcgtgtcactgccgtacgaggaggttaaaatatcctgtccctccgtgcctggtcccgtctaccgattacatacatgagcagcacagtagtccgcggactattgaacactacgacctattccatgtctgagtggaacctcaacgatgtgaagatggatctcctgtgatcgtagctacggggtgtaatcggtgttctgccgtggaccgaaaagtcagattgctcggtttctttggatcgtaacgttgctttgatactgaatctcgaagtcatgacttaccttcctgactgagacaggccgaattgggagatccgtcgatcgccctcgattcctcaggacacaactcgctagacccgacaactaccatggaacgaagctatgaagaacgagctctacctgtcacatgcaatggaacttagcagccaccgactggctcgcaattggcaataatgcccttcctgtcactaacgaggctcggtcggggattatctgacatttccgctgacacggtgaccatgggataaatcgtctgccgaccatgacaccgggcagaccgttctgcaatatttgaggttttatacggtaccacgcacatatgcgcgcacatgatactcttacacttggtgacaccatcaagttgattattatctgagtctccagcgcacagccaccgaattacagtaagccaatcctgaggctttccccctcccctcattgcctgccaccccccttctgcccttcgggcggtttctccccatctcccagtgctaaccccgatagcaccatagcacagtggaccccgagcagagagtagacgagacgatgaaacgaggccaaacccacgactgaattgagccacggcccactgatcagcgacacccaccattgccgacaccacaaaaggggtcggtcaagcaatctttcgggtgtggcttgaagggccgcccgtcacaacctccattaggtaatccagcgtgaatttctctctttgctatctgagcctgcaaaaagcaaaagctagtctaatgtgagtgatctccgcgtcccagacggctgaattgctgtccctgactcgctcggggttcgaatcgggctctgaatttctgatacacacaagcgtgacaagacacctgccatcgatccgatcgcggcatctctcctcatgcggggcgacgccagtgtacttacttgctcacacttacgtgtccgtgttacaggcaaccaggctaatgtcccataactgtaagggggaagaggggtgggcaaagggaaatggaaaagatggaggggtaaaaggcccccccctccttggcgccaaaatacggagaaaatcctaggaattacggggtttgggcattacacgaactacggggtagacaccaactccaaccattaaaccaccacctactgacaattgcagttagtagggactcagtatctacatgctactaacccaacagggagtacgctcagtactcacattttggactccgcttaacgctagtcagagctagcttgagaaccggtgcgcttttagtctcttagttctttttgcccagcgtttagaccagattacctgtaatagcagcagcaggggcagaagggaaaaaaaaaatcaaataaaagagagaaagagaacgagagaataagactatgctgtccattcaccatagtgaccctccaaaccatatgaaaattttaataccaaagaaagtaacactaccaaaaccactcaactcttagtggatagtagtagaagataactagtaagacctgaaacacaaaccaccaaacattccgaacagcgggatcatcccgcttcctatctatctatccttcctcagccccggccatacggcgcgtggcttgagcaccagcaccagcaccagcaccagcacagcacaacacactaaatcccaattagtccactttttccttcagtaagaagcaactaactaaataagtaatatgtcgtatcttagtatctaaaaggaactaagtactctacctggctcctgcaatcctagccgatgatcccatccctgcccgtctgcccgcccgtctctctgtttctctgtttctctccctatctttcttccggggtttaggctctcgggatttacattacgattggcacggcgcatggattatgtgcgtatgtatgtatgtatgtatgtatgtttgtcacaggaggatggtacgtatttgttgcatgctgggaaggggggaaattggaattatgaattagaatctggggattaattgcatcattgtgcttgagtatctgtcattcttgcatgccggatgggtttcgggtgagggaggaaggggggtttactgtaggggttgatgtttgatttgagatagatgggagatttgattgattatggttgcttgctactttcttgcaggaggtgtcttgtaggtactactgtattaggtagggaggttgtggtgtggtagataaaatgaggtgggatatttcgctaatataactatatctgtgtatggtattgcagagattgaggagttgggagtaacaaagacatggtatggtgtatgtagatcatttgtgtcgtctttcacacaatcgaacccaaacggtaaacaaataaatcccctcccagataacaaatcaagataaagcaagtgcagggtatcatagtaggctaggctaaggtagcaagcaagtaattctttcaaatcaatttcacaaaacagtaatggtatctccaatttcaacagcagaaagttcctcggtgcggtatggtgcgagtggcggggatggaaggaattggatgatcatcattgagcggagcgctgttcgcatggagagtgggactctgctcaacgagatgatcatcatcatcagccctcgcccctcgcccctcccccctgcctggtcggtgacaccgccacgcggccccgcgccaatacacatcccaattccacatgttgaatttaatattcgcgtaatgtagggcgcgttgcggggttggggggtaaggaggttcgatcgttgcagtcgctggtttgtatgtttgctttgcgacggcatatgtgtcgcgccaatttgcgaaataatcggcagggcaccgaggaacacaaccaggttcaatagctagtatccatatggggaaaacgggtgacgcaggagtacaggatcaacatgcgcaaaccctcactcaatcaaacacaacaaagaatcaacaatctgtgccagcacagtaacattggtcccgagtaatgcattgttgggttgagtaaacggcgaggcgaagaaaaggtgtagaaccagcgtttgtcacgtcaaaagtcggctttgttatttcgctccccctcgcccgttgcgggatcccaccatcgagctgaaaccggggtcgagcggacgagaaatttgtgtcactttgtcggcggtggcagtggtagtggtgtagttccttctctcgttcccttgacttcgtgaagaaatgtgggttggttggctagttcgatttgagggcttcagcggatgaagccgaccatggatgcgcagcgactgcaatagtaggaattcatgccgaaacgaaccacgccgggagaggattcgttttcgagactcatagatcgttgacagcgagagcagcgcacaatgtcgaaattcatggagccgggggtcgagcctgtcggggaagtgaccccctttgtggcgccggaaggttgcggttgaacttgcaccgaggaagagctcatcttctcctttccgctccggttgagggttcgaaagaaaaaaagatgagctttgtagtggccagtgaagttgagcgcaatttcgatatccaaagttctgcaatatgggggaccgtaaaaaggtcgaaaatggttttggagaattgggggggtgggaggggaggatgagtggttatttaggcacgttcaactgggtggcggagtcgattagattgtcttgggaaaacacgggaatacaacggcgatagcgttgtatggttctgacagtgcccgggtagctttggtagctttggtagcttagtaggcagcagatattgaccacgtgtgaaaggaacaacaagaaggaggaaggataagttccagacgaccgtgaaataataggcagaagagttaaaaaggagtgaccggagaatcgagctgggttgggaagtagtgactgaaaggtatctatactaccagagcccagcgccaagcgaagtgctcagggtcagatcgatccacttttttccgcgcctgttttgcaccggccttgagctagttgggtaaaataatagtcctttatattattttctgacgaggcacaggggaaaggaggaggcggcgtttggcggagggcgaaaaaaaaaaaaaaaataaaaaacaaaaaaagtatatatataaaaaatagtgattttttttgtctctcttttaaaaataaaatcgacccaagacagggggacggtcgaacttcaagagactaataataagaatgaggctagcaattaataccgattgagggataaggcagccgatagttcttgggagaaagctgctgctgctgctgcacggaatgtggatgccagtttcagagttgaatctggaggatgtcaaccatgagagatggaggagggaaggcgaggatcagtccttcatgtatgtaggccggattcctctgcgatggaatgacgatgtcaatatcctggtctcagaatgttgtagaacgacgacatgccatgacatgagaggtggccgactcttatgacctgaacctgttgagagggggggaagttgtgtgtcttgtcttgtcttgtcctgtcctgtcctgtcctgtcctgtcctgttctgctctgctctgctctggtcgggttttgtctcacagcttggccgtaatttcagttccgggtcgtctggaggtaccagggcatgctggaagttaccagacggttacagacaccatccaatggtgcgttgactgaacccgtttctttcctgccttgagtttcctgccctccccggtcgcattatggttattcggggaccagtagagtcgatcgattagagatcggtcgacaataatgatgtgatcttaattcattgtcctttattatattttactttttgactttcaactgtcctgtcggtcaattgtcaagcaatgcccagtatcctgcatagattacaagccactactttacgtatgtagtctcttagggttctggttttattctggctctgttaatagtgcagctgccacaggactgacctaactactagatcatcaccagcctataactaactgtacttttacttacgcgtgcctatacctcacatgcaggccagcgaggcttggtttggctgcgtcaaccacccctcgtccgcccatcgtcgcttttctccctctcgttggtgcttcgctcccaaagccgagggtcgtgtcgtcatgactgatcctggtggatggagtcgtccggggcgatcgcctggacggttgggtaccggtttcgatctgccattctcctcttccctcaggaacactcgtggccttgctgtacttgtggttcagcaaatgagagcccgaacggccggtaatcggcgtatcggttcgtcctcgctggtcacctccaccacctccaccgttccgttcccactgtctttcatgccttagtcatgctgagtccatacagcgcacgagatatgggtctattggaatttttgcgagggcatataaaaaaaggtgaaaattgagaatgagaatactaagtggaccattttcaccttggcggaccatggggtaccctggtgccctggttccttttttttttttctgtggctgcctgtcgccctgtcactgcttaacccagctaaacctccattgaacaagtgtcagtcctcaaactcgatgctgagtgggtgaaccatgatacctttctcgggtctcccaagctgtcggaagtacggcgctaccaggaatctaccatggtcatgtttccggaagatcgattgcagtctgcgattggcagaccatggatcgtagctatcatcatcatgatctctccatgacaaccagaaccctgtcgattattcatccttcaaaaaggtcccttttggtcaatttaccatcaaagaattccgtacaaaggtcaggcatgaacccaccattcgctaatattacctcagcctcgtgcaaaggcctgcggctgtgttgcataccgtgactcgcgaggcggttacgggctccaccccgggcgtttcagactcttctgtcagacatgaaaggaccccctccagtcgccatgtccatcattcctcgcaggttttatcgggcagtcgatccatgttgtccggtttaaggcatttggacaatttcatcttcctgatgcaatatcggtgtaggcatacggaccataggaatgttctaccggctcgggcctttcccagctgcctaactaatcagtagcaccaacccttctgagttatccatccgggcgcagtggacattccttgatcgcccgtcactcggctttcaacggaacccgtttccgtgctctcactctgcgccgtcgtttgtcgttgctgcaccccgggggctagcggatggtctgatccattttttccctcgccagcaggctggctgctggatgctggtgcaaaaatacctgattcatttcgtatcttgagttgcgcttgggtgcccccagctaaagccggcttgtcttggtaagtgtggctagcgagctagctgcagtcgatttcttcttccttcacagtggggaaaaggaaaccaagccgaaaaccccgaatccctactcccgttcccctaccctgccatgcatttgggggaggggacggagtgagctagttggcctcggatccatgcctgcggtgtccagcatcgcagatgcttgactcctttttccttcgtgcgtgtgcgttttgaggaccgtgagatccttgaggcattttctgcttatgtacggggtaagattcttgtgctatttttgttgatctctctctagtttcgtagtgtccggtaattcgccgatccgcgatggccctgcaactacagactactagatgccttgtccatcccagcatcacggctaattgccaagaatgggaatgatgacagctatggactttgagtcggatgttcactttggtgaccccaaccaccaaccaccaccccggaacgctttgctgtctgtacctagcaatccatacagcactccacctgtacttcattcccctcttcaaccccactttggaaaggatgatgctggctgctgctccagatgcagcagtataaccagtagccacatcctatagtcttccaattgtgcatacggggactggaaagacaggtcgtctggtgcagagggaacgatgcacggcaggtccgtgtcacctgatatgccttgcccatgcgtctttttctgtcaaacggacatagccacgagtgatggcctatgggaattttgacgtactctgggactaggatcacggcctcagacaaaagaagtaaacctgcatactttaccgtgcgtaaaactatcaccccggacccatgcattggccgtatggaaacaatgtatgtattgagattgataccatactcacgatcgctaccgggtgttgcggaagtcaggcacatgtattcttctttctcaagagggccgcttttctttctgtttccatggcgattcagaggatggcttgcttgacttccgggcttttccacatcttcttcaggctcttacggaaggaaaaagaagagggccattgccgtggtgccgacctgcaccgatgcactgataccgctagtttagggtagtcaccgggtgccagcatcgccttatggaggtcatcctactgctggactctcctctggcatctgcaggatggtgtaatcgcgcgtgagcatccggtccgcaccccgttggcggtaatgcacgaggactaaaacgtcagtgcctacgacttgtcctatctagttactttgtatcttctttccatcttgagtggtggtgttcaaccgccgagggtccaacactgccaatcaccatcggtaaggcgttagtcacagtgcagcggtaactcactagttaattagttagttatttagttagcaacactctgtactagactagttcagaagtggatagttagcaagtcgtagtaggagagtatctcgtcagcagatgaagcttcccagttcctgctgcttcgagacagcgagacgttacggtgacatcatctcacatgcatccgttctctttcgtatttgcttcccctccattgaaagaccaggaacggacgaggcatcaaaacagggaatatccgcaattcataaacagtggtgtctttttcagttttcccgtctcttcagaaacttccgaggtgggatgagggcataagacgagcgagagagaacctcgccgaatatccgagcctgagggtcgagataagacttcctcttgtcgagcgggttacagtccattgagctcgttcctgcaacagagcttcccttcccaccaccccgtgttatggcatcaacaacgacgtcatggttagggtctgggactgccagatcttcccccccccaactgaccatcgcgcaattctagactatctagactacaaaccacagtatcaactgacaaaccgactatgtaacgagtgactcgtcaatccatgggaagcgaccgtcactagcgtcttcctgacgaagattgggtttcccccccctcttcttccctatctcccaaggaataatgcttttcacatcatgatgctgtaagaaaaacaataataatgatgatgggggtttcctggactggcttgtggatggcgcaggaacgtgttcccagttgcgcccgggttgtgattcgctttcggcaggtacggagtctttccagcgtctcctctactgccccgccacaccccgcctgaagctgttgaccgaaaaccacaaccaccaccaccactagctagccagcgaccgagaatactactactactaccctttcttctcttcctacaactcgtgaattttcccatcttacatctcccccctcacctttcatctcacccacgtcttatctagccgtaataatggccggatctgcccccaacctctacagcttcctcagcaacgacgctttggcccagcaattgaggccctacgtcctgcggtgtcagaactcggccctcagccgtcacagcacattccgcgtcgcagtctctggtggctcccttccgaaagttctcgcccaagctctattggcccctggaaatggatcccccgaagataccgctcagttctccaagtgggacatcttctttgccgatgagcgcgccgtgcccctcgatcacgaagacagcaactaccgcctgctgaaggaagagctgctgaacaagattccctcggagctgggtgccccgaccgtgcacacgatcgacgccgatcacgtcaacgatgaagacccgcaggagctggcggatttgtaccaggaagagctgatgcgctcctttgccgccaaggatagcgtcaagctgcccgttttcgatctaatccttctgggatgcggccccgacggccacacttgcagtctcttccccggacacgaattgctgcgggagaaggatgcctgggtggctgccatcagcgactctcctaagccgcccccgaagcgcattaccttgactttgcccgtggtgacgcatgccctcaacatcgcctttgttgctactggcggtggaaagaaggatatcatgaagcagattttcgacgccgaggaggggagagacctgccctccactctcgtcaaccagggtggtggcgagaaggtgagctggttcaccgataatgcggctgtggagggagtcgctttcccccgacgtggaagcctgtaacgtatgggtagaaattggtacgaaattacttcgatatgatggctggggtgaaggataaggagagagtcatggcgaggctacggaaggattcaactaatctcaaaatgggcccctgggctttactgtcattcgaccacctgtattaccagagcaaggggggcacggctcaggaacacgtacgttcaaggctggatgaagtgttcattgcctcttatcttctatctgttggagagtttcttttagacttgccaaaagtttgtgttatcgttatccttctgatatcacggacgggtcttaattgaacgattgacggggatccagtaatcatcattccagttatttgtctctagtactaattagtgagatgcaatttcacctatctctgaagtatccatgtagatagatgtagggagtgaatgaatgatagctgtccatgcagatgcgcccgatccacctgacgcagtgccaagctttgccctgggggaagcggaacttcaccgcaagacgggcaaccacggacctgccgtcctcagctgagctcaggcctcgtctatttacaacgacggtttccgggcagcgtatctattttccccggcgaggccccatcttggactgatctgatagctacctagtcgaatgtcacacacatatgatttgatcttcagcaatcatgccaattccaacgcgttccctttcgcttcgtgagccccgcaaacaggttagtgtcgcatctgttagtagctcattccaccatcccccccctagcgcctgagagccaccatccctcgcatgctttccctttctaccaacactactgacgtctgttatcatcatcaaacagaattctactacagtgcgcacaacgacaacgacaacaacaacaacaacgggtaagccggcatccacgacctcgacatcagcaaccagcacatcttccagtgctgcgaccagcactgagaacctcgtgactcggagcaagagtcttttgcctgttcgcgatgagggacgtgcgacaagaccttctcgtttacaacaaccgtctgaaccccgcgtagcgcagaggactagcaaggcctcggataaggctccgcaatcgcagcccgcccaggagaataccggtataacccgtcgccaaagcctgatcagaccgagcccgctaaagccctccgcacctctgaagcctacctctgcctcgtcaagaaggcctactgttgctccgagtccatcatcgccggttaaacaggagataccctcgaggcagaatggacggcctttatcgccgaagaaaaccgagacactctcgagacagaatggtccgcctttgtccccgaagaaaactgatatgcctccgcccccgcgacttgcccggtcggcttctctcagacagcctgctgccccgagctcgagcacaccgacagtgactagaggtcatgcgcggcatcgcagccagggaatcgcgacaccttcggggggtcaatctccgagaaaagttgaccctccttcgcctttccctacctccgccactgtacggtcacgggctcagctctcgacttatcaacaaccgctctccccaaagaaggtggctaagccagcgactgcaacacaagcggcagctccgcccgccgtggatgcggattcttcgttacttccctcgtcttggccggagattgcggcgctacaaacagagctattacaattgagtttggttcacctgtcttcgtgcaaacagcacaacgaatgggagactaccgcggaagcacgactacggagggattataatttggtggcaggcgattatcaagcggccttggccgatgagaaggagtaccagagacagctcaacgggcatgcgttgcatcactggcttgagaacacgcgtgagcgcaatggacaacgaggctttgcagagcagatccgcatactttctcaggtggcagaggaggtctacaatttatccgacaacttggacggccggcacacagtggctgtccaggaattcgaagtctggttccaaagagtcgaggagatccggacaatccgttttcatcatggtcgcaacttggaccaggtggtctttatcgatcctctgaaccatgggtggcgggacgagacatctgctttggtcatgaagcttgaactgtgcctgagacagctgcagagcttggacattcttggatatggagatccggggcctttaggcgactccgcgctgttccgcacagcaaagggtctggaggaaatggccagcatgatggttgaggagctgaacacgatccgtaagattgaaagcgacgtcgtaaagtcagagcgcgagtgggttagtcagctggcccggcaattgactgcaaatcaggcacatgatcagaagcgcccaacagttggaatgtggagacggccgtcgttgaactcatgaactttgtgctgtatgccgaagaattgcgaagaattgcagtgaaggttgaactgcagagttacttgtcgcggtcaacctgatccgttactgaaccccatgctaaaccctatcttccccaggggtatggcatgcagtttgctgcttctgccggatctactagcgtaagcggattcgaaccatgggagcgattcgcaggcaccgtctgcatagccaggcatgcatgtgtcatccaagggcccaaaaaccggttctcgcagaagtccagttttcaacgagagcgcaaatcattcgccaaaattttgcgctagcccttcctagccggcttctggccagcggccggacaacattcggggtgcttaacgatactacggccggttatcgtggcctgttgagattctagaagctcaaccatcccaccttaattcttgatttttgggacacggccggggcaaacctgttcgcccgaccagcggcctgtcgcgcgcttgtgacgaaaagggagaaagggaggaggagagtgcaatggcctaggtttagatcccctcatccgtgttcggggtgtctgttgtctgcatgttccatgacagtctaagatgttcttttcccctccaaaaaatcggtctgcgctgtgtgtgaatctgtgctaccaatggccatgtttcaccgcggaaaaaggtctacagcagcgcaggcctcggctcgcgacaagcatgattgatttgaccgctggctacatcaagctctgccttgtgttattccgcggacgctgtgcacatccgtgcagatcggttgggttgaatgtggaaccctccagtgtctggtgatgagcccaatgtactaaggagaagaggaggaaacaggttcttctcggtccatttcctggccgaatttgtcagacctgggattggagcgctccgatgtaggctcacccttcgcgtatagatactgttgaggtaaatagtaatgattcacctctttattgctcccctgagagaatgtgaggggtagatgacgatcgattctccgaggcgtaagagggaggacagggagtgtattgcgtaaattgctcttaaccggggagtaggaggatgggatgaccggctttctgacacgaggttcagtttatatacaactgaatcctgccatccgccaaactccccattttagcgcggtcagtgactaagcaacgtggggagaggtgtcgtcatcgccgttggtctttccgaagcatcaccagaactggaacgggattgatgcttctggatcttcgaacttttttttttggagtgacaccctcgggtggtattctaccctagtcaacccggtcaagcttcgtctagagccaacagtagtaacctcccctccctcctttctaatccaccactcagttcaactgaacaagcagacaggctccactctcagcggtgtaactgcctctggtcaacgatgcctatcgcttcagctacacaccttcgcagctggagcccaacagactactgtgggatctaatgcacctcctggcgctggccctcctccccttgtgcattggagtcactctcgactcggttcatcgacgatcggggactctcccgaatgggtaagactagatgtgctcgggaatcctgtgggagaatggaggaaaggaacgagggtcattggatgactttccttgtaggatggaggagtaggtgacagttagttagttagttttctctgtagcagcagtagtaactatttagtgctatataagtccagtcctgtatcgtccggaattctttccctctcttccttcctctccccaaaattggagacatactgcatgtgtcctgcaaagtactagctcggggctatctacttcgtctgcgtctttcattcttcttactattattatatctttttaattcaatttttttttcttttcgactcgtaaagatgaaccaacagtgatgagtcccaaagtctatgcagtgcttgacgtggttgtgacctgaactggtggttctcttcctccccccgataatctggccccggtggagctgagcagttggtggttccttttcccctcttgcttgcttgttcttcccgcaagtcttctgtctctcgtttttctttattattctctaaaaacaactctctttcgtgcccgctctgtctgtcctcttcgatctgattacttccgcttcctctccaattaacgggagaaaagtacgacaaagtgccaacgatactacccactgtcaacttgcatagaccgtcatcttctttcccccaacgaaccccagttactgctggtacgctacagcccaccccacttttattctgcctttcttttctttcatgttttgctttgacgatcactgcttgccactgttttcagccctagatgttttttcgagctattggtgttgattgattgcgttgtgttgagggatgcctttgacttgtcaattcccgagggaataataatgtctggaccgttcgccatcctcccgtcaccaccttagcctttttttctcctcactctcctttttcgtcttgctgtcttctcttcctcttggaatctctcacgcttttgacactgaccctactagccatacctctttcttttcctttctttccctctggcactgtgatcttgcccctctcctgactagcttatgtctacccttacgctcgtgagctttgcgacgcgatttgcgcacgtttgagtctgacgtcattgaaggtgtggcagcagcaaacttccactgcgcgcaatgcttcgatctcgcgtcgcctgatcgtccaccatctgtcgcctattcatcgtcccaaccatgaaggaatcgctttatgatcgcatctggcgccgggaattgggagaggactcccggttcgcaagcattcatggcatttatggatccaaggattgggtggaaaacctggatattgtgaacgaactgggtgggcattcgggctgtgtgaatgccttgaggtatgctagtattgcgccacgtttttaatttaagtacttggaggaatccttgtagtggaggatcctctctggcaaaatgcatcgcttctgacgctgcgcagttggtcgcggtcaggccagcttctagcttcgggctcggacgaccagcacttgaacatctattcctaccaacccgaatcttccaccgcgccgttctccctgaatacgaccgtcgctacgggtcacagcgcgaacatcttctcagtcaagtttatgccacactccaacgatcgaactctagtgacttgcgccggcgattcccaggttcgcatctttgacatcgaatattccagcaatggcagcaacagtgtggacgccacttctgccttttctgcatctgcacggagccgaaggtttaacaactttttcaacaatgcgcgctacctaaatgcggggaataccaacgtcagagtttatcgcagccatgccgatcgggttaagcggatcgttactgaatcatcgccgtatctcttcctgacttgctcggaagatggcgaggttcgccaatgggacttacgtcaaccatcgtccgcctacccaaagccacgaggcggccaaggatacatggcttttcgaccgggacaggaccacgacgactccaacgtaccgcctccgctgatttcctacaagaaacaccgactcgacctcaacaccatctcgtgctccccgagccaaccacattacattgcgcttggcggggcccaccttcactgcttcctccatgacaggcgcatgctgggtcgcgacttgatggcggagaggggtgatccgggtgcctcgcctggcagtagtagtcatggtgagcagctgatggatcaggcgacgcggtgtgtgcggaggttcgcccctaacggtcagcaacgaatgaaaacgcgcgatgacggccatatcactgcctgtaagattagcgacgccaacccaaatgagatggttgtcagctggtccggcgatcacatatatagtttcgatttgattcggagcccggatgcaagggaggatgcgtccaagcgccaaacctccgcccggacgacaccggtcccgcgtcggcgccgaggctctaagactaggaagcgtaagcgacagaatgggacctcgatgtcctcgcagtccagcagcaatcagactcgacctcgccgtcgacccagagagcgacccgatgaaggcgagctggccttccgagtccgctatggcaatggcgagttggaggacattcccctcccgtctctcaccgaacaccacgccgaggtcccccaaaggttgctggagcagtcacggttgtctgtccttaatgacgcgcaaaggctcagcatgcacattgccaaggacatggtcaagctccgtaaagcaatgttttcgctggagacgtccttacgcgaagaatatgagacctccaatcaagctgacctgacaccgttcaccgagtccttttccactgcactaacccttgcttccatctgtctcccacagatggatgagattatgcgtacctggcgataccctgtcaatcctacgcccgacattgtgcgcttccagcaaaccttgcggcggaaccgacagacctcctggcggttcattcaagctgcaggcacattagcacgagttctagggggtgaaatccaaaacacccccggagatgtagatcgtgacatggagcctttccaacagatacacccagcctcgctcgaacgctcggtcgatcataaggagcagtttggatacgatttcatcaaggctatactactctttgtagaaggtggtcgccaggctcttctggcaggtttcaagaaagatgcagcatcccgaggtaacctatccagatttccggtagctgagaatgcggatgaagatgcaatcgagaccgtcttgattccctacctgcagagactggcgggggatgtacctgttgtgaatgtggacgcctcgcgatttgaacatgatgacgctcgtatcctcttcccaactcagcgccacgccgtggccgcctttgccaatgttgtcaaataccccgttgaaaacctcgtagatacggaccccaacatgcgcaatgggacttcaacggagccccctagtcgtacccacgacttgttccagttaacacagtactgggttttcaaggtggcccgtggtgtccttctggagaccggaaccggggtaaattatgcgttttttagccgggcttttggtggcctgcgtacgagggtggaaagtgactccgaatccgaagtggaacccgagagatcacaaaatgatctcgaagctaatgtcgaagaagagcccatccgcgatgttaatctgaaaatactccggaggtcgcatcttgctactcgagagagttcggaggtagagacaggcgagtcatcaggggtgcagacaccactgtccgatgatgacgacgaagaagaaattgctttggcattaccagatatcatcgatgatgacagtgagaatgaggttggccttcccatagcggaagaggaggagcaggatgaggaagaagacgaagacgaagacgaggaggatgatgacgatgaagagctcgatctagacctgagcagttcggctgatgacagtgacgactccgaggctgctgatcatatcttcagggaatatggcctccagccccgagaaagggaatacgtggacgttgatgttccctgttcctcgcacacccgagtctacatgggccattgcaacataaagaccgtgaaggatgtcaattactttggactggacgacgaatacgtagtgagcggcagcgactctggccacattttcatctgggaccggaaaacctgcaagctagtcaacatcctcgagggtgatagtgaagtagtcaatgttgtgcaaggtgagaatatccccaaccgtggccattttatttggatttttgagggtcatttaagccaacggtcctttgcaggtcatccgtatgaacccaccattgcggcctcgggaatcgacaacaccatcaaggtcttttcatccgatcgacgcgctcaggaggatgcgcgccgtggaatcaacatcttggatcctgacaacccagccaacacgcttggattgggaccgaatgtcagcaccattggtggtctaggcagtcgcaagcgcttgcatgatagttatcgcatcatgagtcagaacgatgtagatcgacaaggtgggatgagcgaagcatacatcactgtaggtttacctagattcagcttttccgctgcaatacagagctttgggcttgtgttaacgaacaaaacagaggcacatgctggcccgcctggcggcaaccctgcgagaccaacggcatggtgtaacggtgggcgaaggaggcgaacatgctacgcttgttctggatgataacagctgcaatgtatgtgcaatatggattcaaatcatctctaaaagctcccatccccgccaagctaactcattggattcaggtgatgtgatctaacctttttgaccggactaatggggagatgtcttgggcggcctattacccggactgcacccgttgacaggattcgtatttccttctcttcctctaacctctagctttaccttcgtcgatgttattaatattagattctagcacccgcgtcatcactctctgtgtctgtttcgcggtcgcttcccagcagttctggtcacacccgtgcatctcggttttggagccatgggccggcgtttcctgaaggcaaaagcaaagcaattgaatgaaattatcggacattcttattcttaccaagtgtatagcagcagagcagcgtagccagttatctcaatttacgatcgtcttcctgactagggcttcaaatctctagaaaatatagtttatcaccacgtgacccttatcgattcccccgcatttgtccctccaatttttggctttttttcactttgccttccatcttcccatcttgcgcctcgaattctcagcctccacctcgattgctgctcgcaattgaaaatgcagaccctacaggaccgagcggacatcaccgctcgtctctatgctgacccccacaatccgcacctttactacaaacgaggccttgtccaccaaaccctgggctttcccgatctcgcatccgccgacgcataccgcgccctctccctgctcgactcggtcgtcgatcccgatggctgcgagtttcacgccacacggcggattcaggatgcaccagatactcccgcaacaactgaggaggagggggacgacgacgaggatgacaatttcactcccatcacacaagatgagtacgactccataatcggagacgtctacgcccttcttgtgcgcaacttggtcgactgcggctgtttccgcgatgcctttgagttctgcgtgcgtggacaggggctcctagaggacatgtcgcagaaggagcgcaatacctctgcgcaagctgtgctcaaggaccagctggccatcatccggaagaactacgaagcccgtcaaggaaccaccaccggagacgccaatatcaaccctagtgctctgaacgcccaaggcttcgcccgccgagtcctctatccctggaacgagcacgaaccggaccgcaagttccccgagactttgcagctcctaaacgagcgcctcaaggacgttgcgcctaaatgcgaagtccgcgccgtcgccttgcccgctttacacggcaccaccaccaccgaagacgaagtctctgtccaactcggcctcttcgccaaagaagtacatcgcccccaacgagatcatcctccgcgaatcctccctcctcaccgctaccaaccgcctgcacgacgacctctgcgacgcctgcaacgcccctctccctgatctctcctctcccaacccccccgtcgcctgcgacggctgcgcagataccatcttctgctcgcaggcctgccacgacgacgcacagcgcatctaccacggcgccgtctgcggcctcatggagaacctcgaatccatcggaaaagacatccccgaccccaaggacaaggctgattacctctacctccttcttctgggccgcacgctcgccatggccgctacccaggagctgcacccgctcgatctccctgaagtgaaatacatctggggcgatttccacgacctcgaccttaacaccaatgaaagcagcaatgacaatgaagacccaacagcaaccctccccttttccttccagctcaatatcctccaaccaatgcgtttcctagaagaaatggaaatagacccctacgttgccctcccccgcttcgacacctgggtcctgaataccctgtacgctaagttccggggcactgcgtcgggccggctctcgacgtgggacggtggcccggagctctgtgctgtgcacccgctttggtgtctggcgaaccattcttgtgatccgaatgtcaggtgggagtggggcggggagattacgttccgggctagggaggagagtgaacgggcggtttggaagagggttaagggtgctggtggtggtggggatgaggttcctgggggaagaaggagacaggaggcggggataaagaaggatgaggagattctcaatcattattgtgatattgggttggatgtcaaggagaggagggaatgggcgaggggcgcgttggggggttggtgtttgtgtgagaggtgtgtttgggaggcgggggagaagtgattgttcggtgttagtttgaggagtgtggttggtttgtggatagaggactttggggttggtggttttgggatttggagatgaacatagagatagatattagatatagtggtggatgatgatgatgatgacgatgaatagatagagatacccaggtcgatgaaaagagagagatgatgtggatgctattatgtctctattgaaaccggaggtttcgtaaccagtacactactatcttccactactaactactcagtactagtactgagatagtctccccatatgtcagtgtataataacagtagtagttgtaaactcatgtctccatcttatacaactacatcggtcatagcagtactaagtacgtatgttaaccactgcagtaatctgatcactactgctacctagtccatatgataacacttatttctcttacttgtatactgatgatatactttcgtgtccgtttgcaatacatccaggcgaaatgagtatatatcaatacatccttaattaatataaaataaagaaccccttccttgaacttggaaaatcttggtttcaatccggtatagaacaaccaatgccaaacctaaacatataccctgcaaaaaatttcatctaaaagcactcttctctctctccctatcacctattacatacatcctattcccaccctaatcgcgcacccgacggggaggcgttctagacggagacctgtgccgtctcggcggcggagaccgcgacggagacaacgagtcagagtagcgacgacgacgagggggagcatcgccacgacgaccaccaccgcgcggcggggtaggggagcgcgagcgcgagactgaagcatcacggggggcacgacgaccaggcggggcacgacgctccggagtacgagaacgagaacgggaaggagagcgagacgcggagacgctcctttcgacccgccggcggggaggaggagactccgagtaccgagcggcacctccggcagcctgacgtggaggaggggagacagatcgggagacggatctggagtagcttctgtctcggcgggcgtgggtatctcgcttgctgcgaggcggaggggtgacggaccgggagagcgagcgtctgggagagcgggaatcgtaggagcgatcgcgtgtccggcgaggagggggtgttggggacacggaggatcttctgcggggggatcgactgtatgagacggggcgtcggcgggatttgggcgccggggatcgggacctggaccgcgaaggggtgtagctgtagctgcggcgtgaggatccggacacggagcggctgtaggatcggccgcggctgacggagcgtctgcggccacggccgggggaaggagagcgggagtaggagtaggagcgggagcgggagcgagagcgaggagtacaggttgagcagctggttgggtgagataccacggactcggagtcggagtcggcgccggcatcgcgttggggcaatgcaggcatcgtgggcttggggaggttttttaggtgctcgcgcatgtcctccgtcagcatacccatgccgatactggtgaagtagttgattgagaagcgcgtgttgcggggattgtccagtgggaagaggccctcgaagctgggacgcaggatctcgtcccgcatgcgttcctgcagtttgggcaggcccaggtgttctccgaggtcttggaagaggatcttgatgaagatacggctgcttgatgtcgtctcctcctcgttcatgtggatgatcgacatgacatgccagccaatcgcgtcattgctaatcatatggccgaagaagcgggcaatattgcggagtcggtttgtctcgtagcgatggatggtgtcgtagtacttggcaaatgcagcttcgaagagatcggaccagagccggttgatctttgcgaagcgctctccgatcaagccgtagaacttcgaatacgtgcgctcctgggagcaacactcgatgatcattgacgggagctcgggctcgaggccagcgggcagcgagatcttcatcagcttgtgacagcattcttcgaaatcgatactcgacatgatcgtcaggtatatcgtcctccgcaggttcacgaggtctgtgttggtctggtctttaatgtccatcttccgctcttcctccgactcttcatcggagctctcgtctgactcgtcttcgtcgtcctcctcgtcatcacttccttcacccagaatctctgccttcaatttcttgtaggcctcttcgtgctcctcccattcggcatcgtacttgaagatattgagggaatcttgtgtctcaatctcgtcatcgagtccgatctgatgcgttatttggtcttcctcctcgatcaggtccaattcttccttgatcgccgggttgtccttatacctatctttccggacctggaacaacacctcaatcatatactgtactcgcttgtcgatgtcggcttcgtgaaggatatttcggaattgatcaaacaccgccagggcaataggaccgctcatctcctccagatgctgaccaacctctcgagtcaggccgacagcaatctcgacactgtcatccgtgggcttgtgaagcagcaaaagaagaatctgcgcggccagcatctcgtgcgcgacctgctggttgcacagatgggcaatgaaggtcgtggaagatatgcagactgccttgtcgtttctcttgaacgcctttcggaactggacaatgagacggttgagcaacagctcgccgacttggggcagtttggtgttcacaatagccgccatggcggcgtagataggtgtgaagggcaaactggccgcctgagctttcatgatacttctgcaaaacagaccgcgaccgcgcaccaagttctccccaaaaagctccgggacgataaacttgatgttggaaacgttgaccttgttgatgagaccgttgatcgacttcttaagagcctcccatgccatccgctggtactccttgctggtcttgtccgtaatctgcgcctgcagcgcccgtagtcgcgcaggaggaatataggtaccacccgatcgcatgttcaaaagcttctcatattctgctttagccgcagcctgcttttcctcctccgtcattggctttcgagcagcctcctgcttctcatgttggcgaaggcgctcggcgagctgtcgctctctttcaatcgcgcgttcaggatcgatgcgcggtgcatccgcaccgtcttttagtgaatcacccgggggcgagcgacgacgattcggcgaaggagaccgagagggaggtgagcgtttgcgggaacccgaggcctgaggagagtaggaagtgcctgggggcggagtaggcactcgcaccgccgactgcaagacaacagggtccgtcatgttcctttgcagtccaccgaggaaagaatgagctgtcagtcgtgatgtccgcagagaacacgacgttgaactgaagctccatcgggatgaggcgtgaggcggcgaagaaaggtcttagcgcgtcgtcggtcacgtgagagattagtcgccaggctggcgccggccgctctctactatcgccatgggatgaggaagtgccaaacagaccagccgccatcgtcgcagcaattgtcacgcaaaactctcctgatagcgcatcatcattatggtattactactcgcgtcctaccctacagcatttggaaacgtttgaaaacgctgacttgaactgcgccgtagctgggacctatcgtcggatccgccatgctcctggtcgctactgcgatctttctttactacaccacctggactctgttgatggtatgtcttcgcacctgggtataattgcttttctacgacaactgttaatcactttgctagcccttcgtcgatccgggtcaccctctccatgatctcttccctccccgtgtctgggccattcgcatccccgtcttccttactctgcttggttccgccgtggttggcacgttcataggcattgtgatgatcaacagcaacaagaagaaggcagcgaaggctaaggccgcggccaagaagaagacctaagcttcccaacaaaaagaaaaccgacgtggcgtttggaggatgagttgggtggtgaacatggcgactcgaaacaggtggcatcatcttattctgcatgtaacattagttttttctgtccttgttcttttcaagctttccccttgattgggttgttctgtcatcgcagcgttcaattacaccatccgcattcctcgcattctgcaagcgtgccgcgtggtgaggtaggaagggggaggccacggcaagtgacgagcgtagctccggatgctgcccggtcactgggtgaagcgttcctggtttctcttgtgccttacccagggcaacaggattcattgcttagccgagtctatgcgttcccttccaaatggccatagccaccatgtaatctttcagtcacgggcaggtcccaaccgatgacgattgagggggaccttacagacgatggcagtgctctttcgccatgcagccccgtgactcactcccggcaaccagccacatctggcatcggttctaccgcattccgggcctggaactatgtgattggtctgagaactattggcggctagaccgttggggaggggacccatccagggaaacggccacccatgaatagaaggtccggcccaacttgcttcgggtttcagttccagctggccctgggacgacatgttctgtttcgttccggtggtggtggtggtggctggctgtctggctgccgtgcccagggccttcacgtgatgagactgagccgtgttttggacgccagaagtttgcagtgtttgttggaaagggtacccctcatgcaggcagttcaggaccaatggggaaaggcgcccatggcgtgtgtaagaatcgtgggttctccgccttacggggtaatagccaatacggtacggtaagtgcagatcatcggatgcctcctaattccaggtcccaacccacctgcctggatgggtggacgtgggagttggacgtgggagaagagacacggtaaagaggggaaggatccatcccatctgcaatctaattactagagaccatgtatcatgtaggaaccttacccgactgcgtcatgttatgacggtcatgcctggccgcatcccccactagtagccaatgatcactggagccccgtcatgtggtggccctggaaccttatgggaaggaacgacggggggtgggaaaactactaggggaaactaccatggacttttggggggggaaagtgactgataggagataagtccggcgtcgtagtcagcctacccatggagatgtcatccatgctcctgacctgatccggttcccctccccctccctctttctcttctctcttcttccctttgctattctgtcgccagaacaacttctactttacttcaaccacttcccggttgtctgttacctcaaatctagacgcgtctgttgatccgtcactgtatctatctgccccgactactataagtggtcaacaacctagacaggcggtataagcagtgcttccgacctgtcgtgtttacacacccaccctccggcgtgtccacggatctccgctccagatacgctgttctctccgttcatccggcacggccgttgtaactaaacctcttgctacgtctgtttctcgacattagtggcactggaaccaactgtaactccccctcctggagcatcagttacccgctattttgagacttctgctgataagcgttgctggtcgatagaacacaactccacgggattcctccggcagtgaatccatactacccttgcgagtgtcgttgccggtcgaccacaccgtcagaacctccgttctcagcccggtccaagggttctgagagcggctgccccaactgagtccatattgcctctgagaggcaatccctttgaatgccaccggcagcttcggacgatttgtttcgccagcagagccggtccttaggtgacaccagcccctttccagaagatcccagtcgagccactttggagcatgatctcggtggaaagaccaagaaaaaggggaaaaccggaaccaaggggaagaataaagcagccaaagcaatcccgaagtctacacctgacgacctgtaagtctgagtctctccacgtgtctagaaggatcttgaatctaggcggacagttggctgacttgagttcacgcgtggtatgcagtctagaagcagaagcaccgtcaccgtcaccgcctctgcaggctgaaccatcgtcctgccccaatccaacactggagccgccacctagcaacaatatcgtgtcaccggtacttgatgcccttggcactctgggggactctccggagaatgacattgcttaccgcaccggtacttgggccaagtccatcccgtatggcaaaagtcctccgaatgatgccgttgatggcgagttcaacagtgggtctcccttcggtttcctcaccagtcaagacaaaggcggattcagccacccctcttcgacgtctccccctccgggagcaaggcccttgagctatgggcggggttacgcaaccagcagtgtgtctagacagcactccgtggaccgacaaaagagcaactccgtcagtagcccatttaacaaccaggcacccctaccgcatctgccgcaggcccatttctatggcgcgccagatatcgatttgcctctgttctctggccagaatagggccgcaaccgacggtagttattcattctgtgcgttcgatacgatcataagcccgccatccaaagcctccaggatgggaagtagcgttctcctggtcggcacggatggcggcttggatattcttgccattgaagatcgaaaaacgcgccctgtagggaagttggcaggtctcaatggccgcgtaattgaagcgaagttgctgagcaacacttcaactaatgacacgtctatacattcccgacctcatatcgctgtcatcattcacggccccactgctcaaccagatgatgagggccatgcatcctccaatagctcggaagcaaatgatattcccactggaagacagtcggccgctggagggcgtccgaaagaagagaccaggttttaccagacacgggtcgaggtgtattctttaaggaccggcgagcacatcacaacgcttctgtccacgccgcccactccctgctttggcaatatacctggtcttcctgccctggctccttcaccggccgggaatctcaagctctttgtgagcggaagctacgttgtcgtagcatccggttccagtggggaagtctacatgtacagcatgagcaattatcagtttctaggaaaggcatggaccagtatcaagtcaaaggaatctcggcgatactccacgtcctccagctcgactgacccagatggatctcaatccgaatctcctcatggatctctcaactctgatagtcctatcgtggcattgaagggaagatggctagcaattgtcccaccatccgcaacttacagggctactctccgtgctgccgtgccgacgtccttgttgcaagggaaggcgttcgggcttgagactcgaagtcccccgtcgcgtccggctatcacctgcgctactgatgtcggagagggcgaaagctttttcggcaaggtagcccggggcgttacccaggagctcatgcgaggtgcacggtggatgggtgaccaaggactacaagcctggaacaattactggaataaggagcaagctcaaagcatgccagcacgccgctctcctaatttgacggagttttcacctcaggggtacaatctcttccctcccacccatgcccaggacacccagtctgtgtccactaccgaacctgatttggtatcaatcttcgatctgcgaaagctagaggagggcgaggccaagagttctttgttcaatccagtggccacttttcaggtgccgaatggctgcagcttcctttcattttctcccaacggtctcatgttatttactgccagtaaaaagggagatgtccagtatgtttgggatgttatgcaggctaaatactgtcgagccggggctttcatgtcagacgatccagcatctgtgcagccgagcgtgcggcagattgcccggtacccgcgattaaccacgtcccatatagttgacgtggtctggtgtccgccgtctggggacaagctcgcagtgattacgggtaaaccgacggtgcatgtttttgacttgcctcggagcgcctttcaatggcctccttttcgacgatctctaccaaaacctgcgaaaccgcctactgctgatgctccggcagaagagcttcccgaccgggggccggctgcgaatccattgtcggcagccttcaagatggtcggcggtaagacgcagcccattcttgccgcagtcagggggcgtactccctccaccggggccgctttcccctccgtgggtggctttgcaatgccttctgcagctggagtaagagggggcaaggcggttgctgctggccttagtaaatcaatgggggccgccgccaccggcactgtcaaaacggtcaacaccatccgacatggtggtgaacatcgcctgcacctatccaatctttctcgggaccccgttgcggctcgtgtgacatggatcatccataaaggaatgccattcttgggcctgatagatgggggttacttccgtctgtacaggattaaacgctccacctcacccagtaagagtaggcaggtgcaatcggtgatcggaaacaaagaacttgagttccgcttgcctccccatatgcagacaccttgcggtcccatgaccgtgggtcccgccgccaccacagaaacaacggtctctgcaacattggctctgccatccgcggcgctacgaccgccgccagcgtcgaagctcaaatgccagcctctttcgcaggcggagatcgagacaaacacaccatatcagcctttccacaccgaccagagggtaaacctctttgtgtacagtgaggccgacgactccgtgggttcagtcccgacgggtcaatggaccttcggcggctctctagccactacgaagcttcacgtacgaccgttcagcgcctccagcgaagaagacgatgacatggtacatgaacaacaccacgggtttggagctgaaatggagaatctaatcagcctgggaaatagtacgggcaatgtggaagaagtggtcattactacacgcaggaagaagaagcaggcttcggccatggccccgggtggcggggtcgatgacggcttctttgaaaatgactgcgaggtcttggacttcgctcgggaccgagtctaatcgcgataaccacaattaccatgccgctggcggggctctataagatttaaactaatatctgtcacattctagacttacactggtatggcgttggtgtgattgggatttaggctcgctcatttccgctcttgctttggttgtcgctccatacgaacttcattctggtatgcattattgctttgcatgaattatggtttgatgcaatatgtccgaatgtctcatgccagggattctcaatctgcagagacagaggcgaagatccatcaagtcgttctgcacgtcaggggtcaatgacatcgaaaactctctcttttactgcaaagaggcagttcgacattttgtgaatgcactcgctaccgtttgtccctacacccgcatcaaggcggacgatgttgtacttgcatgagctcaatcccttggcgggatcacgggttgatgccaactttgtgtccgctgggtacatgtcggacatgcactcattcgttctctttctgcctgcaccgctgtatttccatgcatatttccgtggtcattcgatgttacaattgatgttacatacccaatgctgtcctgtgagccagatagatgaaaccatgtgggcgttaacagtaaagtacatacatatataggtaaaatagacatgtgcttgagtattaaacaatgggaacgtcatacatggacgagaagaagtcatcaataaattcgctactaaccgatgtctttcgaagaaacctataattgattccgtttcccctgctcataccccatcatgccagacaaaaaggcctatcaaatacagtaccataccgtatacacatgatgatgatgataaacaaaacaaactacaagtatggatctgcagtgcacgatgatcacccaacagtttaccgtgcccgagcccgagacccacctaggggtcgtgatgaatatcagtgggtatgcggggttgagtacacaccatatgtcaagtgccacgatagttttattaccagatatacaatagttgaatgataggctcagttatcttgccttacatgtagctacctagagcggtcatttgggattgttgtggactgggaaaatatagtacatggtggtggttcaatctaagtgggttctttcgagatggattaatgccatgtaagtgaaaaaaaacataccactgaaatatatgagtgctagtatagaaaatcagtctggtatgatactaggtggaaaagggacgaatgatcaatcaatagaatttagttggtcggtatactaatctccagagtatcaagtgaaagccatgcaaatagtagcaatcaagttagttattaaccccatgagtaagataagataaacaggtaatagtagttgtgacaagttcccatattagctaaattcccgtaatcaatcaatcaatcaatcatattaacacaagcgctggattaagtgtgcagtagacaggtagctttctccccttcctccattcgtactgtagtcatcgatcaaggcttattatttagctcatttacagagcccaagcagccaggacgaatccaagtacaccagcagcggaaacgcccagcttgagctgcgcaacagcagcggcgttctcggtgctgctggcatgagcgccagttgcggtgctagttccggaggagccagacttggagttagagtctgttgttaaaggtggggttagtcatagagcatgggcaatataagaggaggtagaagtggacgtactggagccggtcgacgaagaggagcttccactcttcgtggtgctggcgtcgttggagccggcagtggtagcggaagagcccgacgctcccgtggcactggcgggaaagaagtagctgctgtagcagctgctctggcaactggcgtaggagcgctggtcgctgggggagccggagccctgggggcaggcagcaacgcagctggtggtgtcgttggccatggcgttgtcggggcaaggaacgctgtagcagttggcgatgcagcagatgtcggtctcagcgcctggaaaatgttagtcaatttgcttatggtcgaattgtttgttgtggctgatggatggagtgtagaagacacaggtggttggggtatgcggacggaatcgaagaggagagctcaggatgccgaaatgatatagataggaacagcaatagagtagaaagaaacttacacttggtggcgcaggaagcctgaggagacaagctagcagtggtcgtcgcggcactggtagtggaggaagagtcctgggcgacggcgagagccaggagggaggagagagcgatagcgctgttgaacttcatcttgacgaatggatcgaggaaacgacagacgtttagattgactgaagtgtagaagcaagtagcgaaacgagcgcgacagacagagtagcacgaaacgaaggactgtgagggaggagaggaagaaagaaaaggaagagggggaaggcagacgaggtgaaagggaaaaagacgggctgtaaataacgggccaaggatgcgaggcgaacaatggaccgggagaaagttgcccaagcgtatcaggcgatatgctgggattcaccgcgcctggcaccaaattagggtcatccagctgtcggttcgccagttgcgattagcggggtttcagcaggccgtcagagtcgcacaggctagtgctggattcctcaagaagcgtctggataagtggattcactgggccggagctagtccacacccttacatttggtggcaactcaataacatcggaaagaggcatctagtctacagggtggatgtggaggcgccattcgtggagtcggacttgggaatttttttggtttggagcaggtgcctacgagatggggagagggaaagagaacagcgcgaagcacagtccaggttttggacccagtccttcaatttggtggtcgaggaccagccgaagtggtgaagagtgagcagccagtcaacaaacacagaccctgaaaatctggggactgcaaaggatcggctaaaaataaccctagacaagagaggcagtcccaagggtcatttcaaggcactaattgcactactccaacgctaagcaggttgctgctaagctagtaagagctagacggtctcccgctaattccatattagtccgtcactgtccaccatccggtcttatcagtggatggggttgagacagcgcatccgaataggtggagagcacccattcattggtgggctgatctgtcagaaagtgtcatgcgaacacactggaatgcactagatatcaggtaaagaggtggttggacttgggcaagtcgtgtaggcaccacggtcaagaataggggccggactttggaaagggattctgtcagattcatcgacagtggaattgcttcttcaggcatagtgtacctcgggcagatccgacaggccttgtccaaggcgaatcattctttatccgctcaataataactactacttacaaccaccacaaaagattgggatggaaagaatccggagtacttccatccattcattcatccatcctgaccatcacgtgcccatcctcaacattcttggactgtttcgacgcccaattattgacaacctggaaaccttgtccgagttagagcttcccatcactgtcatcccaattcaattgatcgactaataggccttattctaacagcggctattatactggcgctattcctttagaaagcgctgccccttttatacaaaagcaaatatttagctacacttatcgacgccctctgaagagcccgaactttgagaccaagtccggttgaagctactgaaccgattggcttgtcgattcactatacttccaaatatcgctaatagttcgattttagacgacagatactagtcacagatatatatgcaggctcacagctaatgacgggtcctgatacggaggatgccacggagggtcgaaggggagggacctagaggcaatgattacactgacactctgctactggcttcggcatcaatagagtttaattggtgtttgagatcgcaggcaaaatgccaatagctcctacaaattgaagcagcactattttacctcaaagcaactaactctaatagcccggcatgattctttcgccgcgggagggattgggatgacagtaccgagtatggaagctgaagatctcatagatacttggtcatagtcaacacaaccactgtggtaccgctagctagaacagttttgcagaaatattggagtagaatatgccttaactaagacttaacaaaattattcggagagctccctcgccggtatcctgccacgtgttttggaggccttccagtaagcatctcgtaaccaatatccctgtaataactccatctccaagcctcccacatcctactaagagtacctggggccaactacttaagtgtgtcgaaggccaagacaatcccggccggtttgaaactcgtaaggttttacttcaagcgttccttggtcgatcatgagcctgctgtactccgtatatgcagcgtgcctgtttgacagggtgagtgcagatgcaggttctgaagacctactgagcactaaattttttcccctactctctagtagttgtgtatatggggtgcatatctgcccctatttactactctgattccttgaagctataattgtcggtgttcctttgtcatatcgcccaagcaaccgcaagagtgtgaaattgattagagttcctttcaacaaataaaagttgaggttaggcaccagctcacatgtgattgctctcaacgcgtcgcgtccaggcatcttcgacggtggtcggggtttatcctacgaagcacctcgggttcgctatgttcacccttgatggtgactcctctgactatttcgacgatgatctgggcgacttgggcgtcgaccggccttcggatgcgactgaccctgacactcccccaccagccaagcgccgtcgtctaagagccggtaaagatgcatcaaacgcagacctgcaatcgcatcagaagccacgtgcagagcgtggtgatggtgctagaacagcgctaagctcggactcgtttatcgactatgatgatgacgaagtgccatctcccgaacgagagtcaccctacttccaagacgatagtgaacgggaggcacggtccaaatacaaagtcttcgctcccaagaacgcaaacatccaggagaacatctttgtgacacagctaacacaacctccctctccgccggaaatgcttcgtggtccccggtggaagaagcctgatcctggcttgccaacccgaactgttgccaccccgctaccagagacaactcaaagcagagaatctgctgctggtgatagagatgatgagtatgatgatgatgaagagatgaaagcggcgattgaggcatcgttgcaatcattcgaggaagaaacgtcaagaccagctccctccgtgcctttacaaaagcccccatcatctactcccattattggacaacagagcactaccatcgaggcctccaatgaccttttggatgatatacctgatgatgcctttgactcagacctgtcaatgtcgccgcctcctgcgccccagcctcgcccggcggctcggtcattcacacaatcaacgaatcgcccactaggtgtccgccaaaccacactatttggtatggttgctagaaacccagaaaatcagccaccgcgcggtgaacaggtgtactccccgcctgagaagagcgagccacctactcagcataaacttaaccaggaagccttgggtacgtgggtttaccctacaaatctgggtaaaactcgagactatcagttcaacattgcacagaaaggcctctttcacaatttgcttgtagctctacccacgggtcttggaaaaacgttcattgcagctactatcatgctcaactggtttcgatggacgaaggatgctcagatcgtctttgttgcgcctacaaaaccgctagttgcccagcagatttctgcatgctttgaagtcgctggaatcccgagatcccagaccactatgctcacgggggaggctgctccgggaatccgagccgaagaatggaaggcgaaacgggtgttcttcatgacacctcaaaccttgatcaacgacctcaaaaccgggattgctgacccgaagcggattgtcttagtcgttgtcgacgaagctcatcgtgcaaccggtggttatgcatatgtcgaggttgtcaagttcctgcggcggtacaatcagagcttccgcgtcctggctttgacagctacgccaggctcaacggtggaatctgttcaggctgtcattgacggcctcgatatatcgagagtcgagatacggacagagcagtcactcgatatcagagagtatgtccattcgaaagacacggatgtgcagacgttccagaattcagaggagatggtcctttgcatggacctgatgtcgaaagctctacagccacttcttgatcaattacggagtacaaatgcctattggggccgtgaccccatgggtctcacagcatacggactcaccaaagccagacagcaatggatgctgtccgactccggcagaaacgcccatttcggcgtgaaggccaaaatgaatgcaatattcactgttttagccagcttagctcatggcatcgatcttctcaaataccatgggattacacccttttaccgtcatcttctgcatttccaatccaacaccgagggacaaaagggcggcaagtatcagcggcaagtcgttcaggatgagagctacaaaaagctcatgaaccatttgcagccgtggacaaagaatccagagttcattggacaccccaagttggagtatctgaagcaggtagtgttgaatcatttcatggatgctggtgaaggctctggggcagacgaaaacaaggatcaaccagccactcgcgtgatgatattcgtacacttccgtgatagcgcagaagaggtcacgagagtactcaagagatacgagcccatgattcggccccatgtcttcgtggggcagagtagcgccaaaggctcggaaggaatgggacagaaaacacaactcgacattgtgcagaagttcaaaaagggtacctacaacaccatcgttgcaacttcaatcggcgaggaaggtttggatatcggtgaggtagacctcatcgtgtgttacgactcttcagcttcgcctattcgtatgcttcagcgcatgggacgtaccggtcgaaagagatcgggaaaaatcacactcctactcatgcaaggcaaagaagaagagtcctacatcaaggccaaggacaattacgaaaagatgcagcagatgatagccagtggcacccgattcaccttccacgatgacatgtctccgcggatcttgcccccgggtgtgcggcctgttgctgataaacgagcgattgatattcccgaggagaacactgtgcgagatctaccagagccgaaacgacgcggccgggcaccgaagaggccgccgaagaaattccatatgcctgataatgtcgaaaccgggttcactacggcatcgcatttggccgggacctcgaagcgcagagtaccaaataaaagtaaggctcgaacgccgactccagagcccgtggaattaccggcgcttgaagatgtcctgcttaccccggcgcagcaaaaagaacttgaactccattacagcaacgccgggcccagtgaagagcttttggtcagttatcccagaagcgacgccttcccacgccttcagctcgcgcctagacctacgaaagcggttaggcacgggtcattaactcgtcgcatgattgaaacgttgcagaagatggaccagatcactccagactgtggagatcgatacaaggggatcttagcgcgtgagaaagcctccatgccaaaagcctcgatagtagcgcctaagcccaacggccgtggggaggctcagtcgaggaccaaagcaaggcacacatccaaggtggtgtcatccaagtcaaggaatcaggaagagcaggatgtgactgaagtacaacgaaccccaccaggcaagcactcagtatcagcgactaacgctgaagtggaaccgttctactgctcgcagaggacccaagatggagatacagacgatgattttgaccttcctgatgtctctactctgttgaataggagtgtggagaggccctcgacacggggccggtttgttctggatgatagtgatgactgatttggacatgaacgcatagcttggttaacattctgcattggtagtactttcggttgcatatacccttgggcaatatactttgaagattacggtggagttattctttaatgccatactaaacttctccctagaacaccgttactgagcttggtagttaagactaggcggacagtaactgagaccagacgcaggaattcagttcaacccgttagtttctaagtgtataactcacagagtactcaatgaaatcatatcaagtaaaagcacctgttattcgattctaacatcaactctaaatcaaagatagaaaaagaacaaacacgcataatcatacacaatacagaatcctatagacatcgtccccatgctgcacataattcaaaaccccgagatcatcccatctcattcatagtacctaaaatcaccatgtatcccccttcatcaagcgaagcattcaaccacctcatttccccacataatcaaacttcttcgtcgaatggttataaacatacgcatactcagccacatcgaatccccaggccccagtaaccttggtattcgcattacacacattccctggcttcttatcggtgaaagcctggcaatatggcctgtccagttcattagcatcccaaaaacctccccaacaaaccactaatagagaaagaaaggaaatacatacccaaccttcgcattcttcccactcttcaccttaaacccggtaatctcgaaccaactcccgttcgattttttgttcttagaatcatacgacttgaccttgttcttctggtagaagcttcgaagcgaccgcttctgttcgtcttgcgagttgatggtcacgcctacgaggatggcgctgtattgtgataatatcttttcgttagcttgcttttctcatatagacccctcataaattggtagatagatggtataaacatactcctttcccccttccttcgtcgacgcaaagggaaactcctctgccgacacccatcccttgttatttccccaggagtttgtagccggggatgctttcatcccgtacttggtgggatctttgaagggttgcttgttggctgcgctgccggcttctacttggcggtttacgtccgctgcgtcggcgtcgactttttgcctgtgggattattattatccattagctggttatggatgtcttggtttgttgggaaagataagggtaaggggcatacatcactgcggacttgcccttgcagagcatcgcccagcaatctacgtcgtaagtgagggcatcttcgccgcggatttcgatctcgcctttgatggggttggatttactgtcgcctgggttggagcgaggcggaaggagagggagaggtcatcggtggttgggtgggcaagggtattagggatggagaggagaatggtgaggatggggagtagggttgatgagaggatcattttgattggtgacttggacgagaattggggattggggatagagagtcttgaggacttgctgctgctgtgttggattgcattgttgctcgttcactttgcatcttttatatcatgttgtagatgctgctcaggggaaggtcttgaggctatactactatagttttgtctgccttgggaggccggatttggggtctagtgagctgcttcatggctgatttagtagtggcagtggcttggctggtttgagggtggaacatgttatctcggattgtgcttctaatttgatgtatagaggagaggaaggcagtgatatgaggtaagttggggctggagaccctgcttggaggccttatcagggtctgatgatagaaaagggaaatgttgaataggaaagtacatctgcggtcagcttatccaacattctggtctgcagtgagatgagggtgagactgttgtagcatggacgttatgctgggttcaaaactgatgctcgattttgtccacattgtgtggacatactagtttgctcgaatgggtctgatccaataaaaggagtattgattacaaagttcttggtgtctgacgagtcgattggatatactagttagctagacacttctaaactagtttaagtcaatattcatagtttgatgccgcatgtaagaggatgctgatgtgggtggtataatggctacacaaattggaacggattttatggctgagtattgaccagtactggcccctgcataagagagtgaccctgacatgaatatagtagcctagcctttttgacgaaaatggggggattagtggcatctggtatgagccctgcatcgaaagttgacgatgacttgctccgccactatcactcgagcggggtgagcagcccgcaaacacaactaactactcaactgatcgtcagcctgacatcctgctagcctcgaccatccacttattggcttcacatagtgaaacagttgggatgagggattttcagctattctttgaattccgcagtcggctgaacctataagcaggcactcaatccaagcacacgaattcgcggtcatagatgagagtgcggatggaaaaaagatatacagcctaactaccctcctcaatcttgggtcatttttcaatgactatcaacaggatacttaccagctagtatccttacattgagtctccgcaagaaggatcatcttatagatctgattcgaaggacccacgggaccagctactagtagacaggtgggtggcccccacccataatgtctaggcatcagactaactataagagcctcgtctcacttccaggccctcgattctgctccattcaattctcagtcaatagcagtctcgtgttatcgctgccatattgcaaccatgacgagtattttcctgttctgcacctccaacgtgccagcaaacgtatgaaagccctgccttgagagactatgaagcacgactaacttttactgtcactatcagacgatcaaccaattcatgacagaattcgccgacgccagcgaagacccaaacatcttctgtctagtccgcactcccgaccaggaccagttcgatgaatggggcaccgaaccacccgtgcaagacttcacgactggctttgaaaacgcctctgattctgctctccgcctctacacacagaatcgaatcgatgaactcaaggatgcaggcaaggccggtgggctaacacccggatggttggctaagcttgatgagcgatcccggcgcgactcgaccgtggttctgcaataccgcaagatcaaagccaactgggcacaggcgttggaagatgctgaagagcagttccaaatccccggtcaggcggatgttgatgatcagaatatctggtggaagtggcgtgtgccatttgcggatgctttccagctgtttaacagcgtcgatgggggtgtcccggatatgattcgactgtttacccggccagagtttatggactcggagggtgtgcttcatgtggatgtcccacgtcagatcatcaagggggagattccggatcccgttacagagagtgcaagctgagggtttgctggtctatctctcatctcaactaattgcttatcttacccctgcccatctcccaaaatcttatgtaacagaaatcggctatacagtcgtcaacacacccaagactcaatggacgtgctccgtagacttagatggccttgatgggagtggatggtgtgacgtgacacaactttgtggctgacgtcccaagccttaagtcgacatatggcactgtggattgccacaaatctccagctttgataataactaagcaatgcctgttttagtcgctccaatcctaggaagcccaacgtctgtaagcgatagatgagactcatgatgaatataagctgatttaagggcggtgatgatctgccagcgataaaatccaacttacctcgataggcaggcggggagggcggcctggtgtggcagtagccccaccacattcccgatggggaaataacctagggggcggcggatcgcattgaggagaacggcggaacccgtgcctaaacagtagatagactcaaccacaatcggtcacatttcagcatatcatcatcatggcggacgctcaattcgatagtgcgctgtaagtgttatggctctgtttttgtttcaagactatgaagcctgcatagcctctgggtgcaatcattccacgcggtcaaccccgcttgttgcctcccgctgactatcatacctgcttccagggacctgctccggcgcctcaacccccgcgacacgaagcaaaacctccaggcaatcacctccatcgttcccgacctgaccgaagacctgctctcctctgtcgatcagcctctagaaatccgcaagtgccccaagacagaccgcgactacctcctctgtgactacaaccgcgacggagatagctatcggtcgccctggagcaatgaattcgatcccccgttggaagacggaactgttcccagtgaaagagtgagaaagcttgaggtcgccgccaacgaggctttcgatgtctaccgggagctgtactacgagggtggagtaggcagcgtgtacttttgggacttggacgatggattcgctggcgttatcctattgaagaagggtgagcgagtgatgtcttgatactttcaggctggaaatacgtgctgatatctcgccattataggagttacgccaggtgctaagagctctggggagtgggacagtatccacgtcttcgaggctaccgacagagcgcgcatgtcccactacaagctgactagcaccgtcatcctgcacttggctaatgaaactgaggctttgggtgagatggacctgagtggtaacatgacccgccaaggtggaggtggatcttcccgtcgagtcggatgcgagccacgtcgccaatgttggtcgacttgttgaggacatggagttgaagatgaggaacttgctgcgtatgtcttttttcttagctattgtggcgcgagagttgttacatttctgggctgcttgctaattgaaatgtccttacagaggaggtatacttcggcaaggctaaggatgtcgtgggtgaacttcggagtaagtgcagtctaaccagctggtgggcaatgccagactaacaagcgaaacaggtctcccctccttgtccgagtcgaacagagatcgggctacccacctggagatgatccggtctatgcacagctagtcgtctgtttgtcagttaaggaagccattatagcgtcattttagaggctgttattcatttacatttgttgtatgtacttcgagctcaaggttcctggggatcccaatattactcgtatacgatgaactgcaagtgctatgcgatcgtatattgtaaataccgtacactatgtgatggcatggctagccattacgacaatgagcccttcattattatcaagcaaaatcaatcgtcaaaacattcaatatttgggtatcataggctgtccgctttgctccacctgcaaccacatggcagaatacggcatataactcctgatagtagagcagttaccatattcgccaaataaaggaccaagccatatcaaaatttcgtaaatcatgccacatcaatggcgtctaatcaacctccatcttctcctgctcgctctctgtcttcgctcccgagctcacagacgccggattgctaatccgctccacgaactccctcgcagcagcccacaactccgcttccttatccttgcccaccgtgtccttccgactgttgagccaactaacatcgagcgggttcgacgatgcgcccgccaccccgccactgctcgccccgggtagattttccgctctcgacgctgtctccggcgcaagaatagacgcctcctccagagcatacacctgacgacggagtcgaacgtcaatggacgaaaggagggcgaagtattgcgaagtggcctccttgaagcgggcttggtgggatgcgagggagttgtccgaaggtgactcgcccgaccgagcgttggtcagggcttgaattgcaagacccgcggagtgaattagcttggccacatcctgtagtaatttgcggagattagtgagggtggaatgaagtcaatgacacagcataaataatgtagtagcgtggaagttgagtatccatcgctagctaggcagcatttcggtggtgtcgcgcggggaattaatcccggcctctatttcttttctgtgaacttaccttgtctatttcgttcaattgccggatacgatccgctgatgtgaagacttggtctggtttgcgggtgtctttgacgtctgtcatattgaattgctctgaatttcgtgtttatgttccaggctgccagcagaaggaagtactaagtagaagtgacaggtagaattggcgatggagtaactacttgatctggacctgcgaccaacaagctccgtcacgtgctaacccaacccggggaactctgcttacctcagccggggcccgacgcgctagtcccgaagagcgatagtgcgatatcagaacttcaaaacctcccgtgaatacttgcgcgcctcgtcctgccgtcaccctgctgttacttgcgactcgctatttaccccgtctcatacgctcactcctctctctccgtctctacgtcagaggctacaggtcgatctgtaactgatcgttcaagcgcaatgtctgcgccaggcggggcccccagccctgctccccgaagtggaagcatggggcccggtggtggcatgtctatgcctcctcagcagcccatgaccaacgccgggcctgtcactccgggtcctcctgcgcctccgccgccgcctcccggaggcccgatgtcgcagcagaacttaaatcaaatagtaagtcattaagttatcttggaatatctatgtttgttgttggggtgtactatgtttcattgcgtcatgtgcctgtggtctggattgcggtgataaggtgatgtgttattgttgatacgtgctatcccggtgtatactttacgttcatggcttgtctatgattgcgaactgtatcgcttgtgattcttctctttacccagttagagggttatggggaatggctacgtttgctgtcggggcttcgtctctatcatccaatctttgccgttcctcatgtcggtcgtatattgctactactatgcatcatgctttcaccttggacatcaacgtttgtactaacgtgttccaggttatcgattatcttgcaaagaagggctatagtcgtacggaggctatgctacgtattgagtcggcacatcaagagatcgatggccgtcctcctatgccccctcttggcgaagatgcacggcctaagtataggatgggttttggtatgtcccttcgggctttgctgatacgaaatagtgctaaccgtgcatagacttgctcaaagtctgggttgaagacaacttggatctttacaaggtaagaagcagaagcctgctcacgtgtatcggaaccatacttacatcctaaagcctgaattgagacgtgttctctggccactgttcgtctacaccttcattaatatggtgtcttccttcaagccacaagacgccaagcagttctttgacctcaacaaaaacctcttcctgcctgagcacacagaagatgtgcgggcattggagccgatcagcctgccggagcacgtgcaggccaattcaaccgccaagttatatcgtacaaacaagtaccgtttagttctcagcaaccccgcgttttcgaacctcatgcaattcctggaaagcaagcagaaagagggaggctcagatatgactgccatcttaagcagttattgcactatcatcaccaaagagcgtactgcagatgataggttcagtttcgcggcgatgctgggccaaacagacggtcagacatttcccagtgaagacgaaggcattcctgggcaccatcccggactctgcatacaccggagacaacccgaacatggcgggaactctgcctaggcttaagctaggaaagcttcccctggagcaagctcttgagactgatgttaggggcgagctggcggatgaagatgcgaagaaccctccaggcccgggccagaacactctgattcaagagtttgaccagatgatcaagaaggaagaagatgaagaagctccaactcgtgccgatatcccctatcctccgtcaactgctcgagatgtggccatagagattcagaaggttaaggagaaccgcgacaggttcaggattgagggcagaactggtggcgtgggtcccgctgtgagcgtctgcatgttcaccttccataacacctatgatgggtaggtagcatggactccttggtactagatcttgactaacaaccaacagaatcaactgcttggacttttcggatgatcttatgctcgtcgcagctggtatgcaggagtcatacatccgggtctggagcatggatggcaagaaaatacaatcgacctacgacaacgtggatgatgctccaccttcgaactcccgccgtctaatcggacactccgggccggtctacgcggtggcatttgcaccatcgattaccaagacagacaatgccatggccccgacgaacgctcgctggctgctttcgtcgtctgcagacaagaccattcgtctctggtccttagacctctggcagtgtatggtagtctataagggccacgaccagccggtttgggaccttcagtggggcccctacggccattacttcgtttctggtggacacgacaagactgcccgcctttgggttacggatcatatccgccaacagcgtatttttgtcggacacgaccaagacgtcgactgcatctgcttccaccccaactcggcgtacgtcttcaccggtagctccgaccatacagtccgcatgtgggccgttaccaccggaaatgcggtccgtatgttcaccggacacactggcaacatcactgccttggcatgcagtcgtgacggaaagctcctcgcctcggcagatgaccacggatccatcctgctgtgggaccttgctcctggccgacttctcaagcgcatgcgcggtcacggaaagggcgggatctggtccctgagctggagcgtcgaatcaacggttctagtatccggaggtgctgatggcactgtccgcgtgtgggatgtgacgggccccgctcaagatccctcccagggccgtgtcgtcggcgagggcggcgcaggcaccaaggtcgatggcagcaaccagccagcacccagcactgcgcaaacttcaagcgcggtcgccccgggtatgggcaagaagaagggcaaggatgtagtggtgacgcccgaccagatcagtgcttttcctacaaagaagagccctgtctacaaggtgaaatttacgaatatgaatttgatcattgctgggggcgcctatcttccttgagtgaggaacatgtatgcaacagcgccagataccctttattccttttctttctttccgcattgatctatatcatctttctgttcttcgtttaatacgatatcctgtctttttatccatacgtgtggcaggatactcgatggcatgtggcgtcttgggggcattgacggtgggcattggtgttggtggcggcattgtatttaatcagggatggaatgatcctactactagttgctacttatcattccaaacactcaatacagctatcactatgaaacagcacttacttcctacgtgcatcatcgtcttatacagcgggaaaatgcagtatagacctatattcaacatctagtttactatatcatatgatcatatcttcttaaacaaccctccagctccagcaccactcccagcccccttcttcatcgccgccgaagcctgcaaatccgccaccttaggcggcagaaccaacgcactgcgatcattcctcttataaaagtctaccaaaatctgcgccgtcttggccggttgatcttcctgtataaagtggcctgcttctggcaggacttgtagttgatatttacctgcagaatcaataccatcaatatcagcacataactcacagtaacacggtgtcaaagcaactaaattaaataacaagagtggaatggaagtatacgcaccttgcatctgcccaatcatcaactctttatcgagacgatccgtccccgctaaaaggagtaacttcccaccacgagcatcgaggaacttgcgatttaaaccgacgaaccagttctcccagaagggtttcgtggcggagagattggttcgccagatccatggtttggtggggtcgggtgaattggggtcttcgtagaggagggagggaacggagacgcgggcggaggttttgttgcggattgtgcgggagcgggtgctttgggattcgtttagtatatttgcgtggggggcgttaataaagggattgggagagcttactgccattctatccccgaagtgatggatgggaagcgtgatgggcgggtcatgagataggtttccatgctttggagggcgtccatagcagatcctgttattttctgttagtgttttctgcttgtagtttgcttattgggggtgaactagcttaccctctacaacatccaaaactgcatatgctagtactttgcttcccaattcaccctgtctggccacatcggtgattaccgcaccacctagactatggccgacaagaatcagatcaggaagattctcccagcccattcgggtctgggtctcgcggaccacgaatactaggtcccggttcagggtctcgaggcttagatctagctcgatgctcccgtcgccgtcctcgcctgaggcgagagtgacttccgtgctgccgtgatcgcgcgcatctatggacaagatgccggctttggggatgatcttgcggatctcgccggcgcatgcggcgaaggatagaccggatgaaccggcgccgtggtgcatgacgaagaggggactggaggagtctgctgggggtgtgaggtagacatggtgagtgatcttagtgttgttagatgtgtctatttgtgtaagatagagctcctgggtgaagtagtctgtccagggaagggttgtttgttggacggatctgataagtgtgttagtttcatgatggctgaaatactttattggtatgcggggtaaaaggtgagagggtatacacaccctcgtcctggccttgcgaacagttgtctactgggtgagggaactactgtccctgtagatgaggtcgaggaagagtcatcatcgtgactgacctcctcgtcgagggattgcatggacggcccggttggcggttggagaggcagcttggccagtctagacttggcaaaggatttttgcagctcgctcatgaaggctgcgcgggttgactgggtagatgggcgaatggggttgtggatagaatcaactctaggattggaggcgtggatgttgacattggagaggagcttgagtcgggagtttggactggagctggcgagtggatcatgcggttgatggaggggatgtttagtggcgggtgagtatatctggaggggaatgataggcgtatgtgccgtgggcggccactatagactagacacgatttttgtggattgaatagagattcatatgtcacggtatatattgtgtcggaagtatatgagtctatagaaggataagtcgacggtagtatgggtttgctgcatcccacaatggctgataccttccataccgtatcgtattgtctgatgatacttgatggtattttgcagatctgctgaagtgaagagtggagagttcatgccacattatttccaggaatccctgcttccggtgggtctttgatcttatcaaatggggtctatttgagtgcaactgattttttatccactattatgctctattttatggtctagatactttgtgatatagaagagggattccccacggtgcggcaggtcagctgaccgggcgtgtgcctgatggatcgacgcgctaatcgtgaaacttccttcttgtactctttcttactctgtggatgtctcctctcctactatacattcaagagaattgtcttttcccaccatgcacctatcccttgcaattccaggcctgaccgtctattgtctcacctactcatccctgccattgactctccattctgctccagcagatggcggtggtggttgtccatgacggtgacataagcctgccgtgacgtcacggctgagcattgccgccagccaaattccagccggtgatgctcgcaaccatcatggatcccttcttgtgttgcttttggggccctgccggttccactatccagcaattgccataccgtgacgtcagcatctgcctcatgactctccatcggcatcccgatatctctgtcgcgccttcatttcttatctcgacccatctgtccccccgcacccatctttctatagtgcaccagggtgaagaaaagcacaatggtgtcccttaagtttagacgaagcgacgagtccgacaggaccggtgagcagcgcgaccgagaggatgagcgacgacacgacgagccggatgagcgtacacgactgctcccgcgcgagcccccggcctatctgagccccgatgatcctgctgtgagtttcgcatagaaacactcccttcgcttggaagatggctaacaccaggctctgtaggtctctccctacaatctctggggcatacgagccctgcgaggcctctcctccctcttcctcgccattagcttcatctggtggacctttcttctcgtctcccttttcgtcagtccacccatgatgcactcgcgcggatccggattcttcagtttcgcctataccactctgacaaccggatatcttcttctcgggctcctattcttcgctatcccgtccaaacccatgtccgtgtccggaattatcatcgccatcttcctcctcattgacatgatcctcactctagccgtccctcgcattcggcttgaagaaggctgggtgggagttgcatcggtagtctgggcggccttcatctctctctatacaattgctcagaaccactccgtggcttggggtaagcgggaggaagaagagcgcctgacagggcggccggaaacccgccgtcccctgcgcgaatgggtcgctgttctcattcaaactgtcttcctggtcatcttcgccatcattgtcgtcctgtttaccgccaccctgattcttcgcgcccgcgacgcatctctccccgctcccggcaagaaatactacgtcaacggcgacagctaccaagttcaccttcactgcgtcggtaacactacccacagtctccagaatgacatgccgacgatcctcattgaaggcggagactggcccgtcgaacatactctacagcccttcatccatgatgcataccagtccggtctcgtccctcgctactgctactgggatcgtcccggtttcggctggtctgacaacgctccttcccccttctccgccggcatggcagcagacgccctatccgaagcactcgctctcgccggcgaagagggtccctggatcctcgtctccgccagcgttggcggcatctacagccgcatcttcgctagtcgtcacctgctcgaggtttccgggattcttcttatcgacagtcttcacgaagactacctcagtaacatcggctcccccggccgcggcttcaccctttggcttcgcggcgtcttctccccgctgggactggaccgtatcgccggtgccattttcaagggacgcacgcgcgaagaccgcgtctacgggcgcagctcttaccaaacggggaaggttgtcaaggcgaaactacaggagaacctcgttgctgagtcgatgacctcctcggagatccagactgccagacacgtccagatggcggatacgccactcgtggtgattagctcaggtgtcgaggtgcggaagagcgagaagtgggcgaagagacaggaggagttgacgaaaattacgaagaatctcaagaacttcgatattgtgaagggtgcgccgcacgaggtttggcgggatgtggaggggaggagagttattgagaagagattgggtgaattaattggaaaggatgagtaggaactgtatcttcttaacatcatttctggccttctttttcttcttttctctcatattgtgtttgttttcgtctttcccttttcggctcattttatttctctgccgctaccgtctctccacttatctatctattcccctgtttattactccgacataaccttttgaaaattgtcatgaatttacgaaattgacgacacattacgcccttacttttttttccccatactgtacgatatgtactatatgatacgtactcagctcaactagtttatatatttttcaagtaacctgatcatcccgagaatacggcattgatatatgatattgatggtagatgcaggtgtgtaatatccacgtatagatcatattcacgtggtttgaatgtaccatgctatacttcgtagatatatccccgatttcgccggctccccctttccctttccttgcgtccctccgtaccgttccgttccttctttcccttgcccttcctcccggcccgtcctccgcttaggtacaacgtgtgcggcacggacaaacgcttgtatatgtattggaagtaggtgatcgagataggatggtgctgattgagactttttgaggttgaagttgagatgatggagcccgagacacagagtggtagtagacaggcagaaagagatagagagatagatagacggagggagatttggtaataggtgggattcggtaaatcgggctagtcaacaaaaaagttcattctagactagctcccttaaacctcttagcaagacgttcactttcagatttgggagactcgggcctgagatgagaggaggaagaggaggaggggagggaacgttttccggggttgtagggcactgaacgtggcgggtaaggctcgggtgtgggcagccaggggcgcttaggggggcgctcaccactttcctgaagaatggtcaccagggtagcccatccaggggtgttgatcagctgcaggccatctgcgggggcacgttgcgtcgcgacgcggcagagtagtgcttcttcgtcctgtgagaaggtgggtgggtttggttaggagggtttgttcctgaatggaagaaagtcatgtaggcaatgagggtttaccttgttgaatgtcgacagggaatgcaggaagcacagcatatggaagtccgagacggcttggatcgctttgtccgggtcgccgtgggtcactagcttcttcgccacgtggacgagctcctggctctcgccgatgacttcgcggttctcgatggggaagctgctgtcggtgaatagaggagaggcgtccgttgggaaaccgtgtgtcaaggtgaccaggaggtactcaacggggaagctgggtttggcgttctgctgagcgctgacgccgtactcgttgatcttgcgatagaagacctcggggatataccgcgacttgttctcggtgtcgtcgtcctcggattgcaccagcatgaccgagggttccgccgatggttcgacaatgtccgcgcggaccatctcaacggcggctactgacgcctggtaagcactgactgaaatggcgccctcctcgtcgccactcagcacacaggtgacaaaattcgagccgaagcggcctgtccggctccatttcgtggccttggggtgttgcgcttgcatccgcgctgcaaaagcgatctctaaggaggacagatagtaggagtcgatgtgtcgtttgcaaattaccgaaccgtctccacgacccgcgtccagtaggtcggtaaagatcacgccaatcctctccaaaccacagagatgtgcgacctcgtccacctccttctcgttgggccattcatggagcgtaactccatccacctcatccacttgtggtggctcatagatggcctggaccacggcctttacgcccagcggaacctccttatactcctcataggtaccgtagagaaaccctaaccgctgagcgcccgacttccgccaaaagtcgagcaacgaattaatgagatccggcgaggagaactccacatggtccaccatccggaactcttgcggctgcagactgatcgcgctcggctggcacttggtgcaaataccctccggccactgcgggtgtccagagggacagtctcgccgtactcggtaatacggctcactgagcgggggcatgaacgagctgttgagttcggctttgttggtagaggcgttgattttccgcagatacgaatgaaacgagaggtgcttgatcttcttctccgccaaatacttggggtcgtaaggctcgagcggcatgcagtagtcgcacattcccttgggcccgtgtcggcagaacttcgtatcgaggcctcgctttatcttcccatccttcttatccaacatatcatctagcggcgattgctgcaccacgtcccaagggttcttgattgtggctgtgggtgaggtcggttgtggggggcggaaggttactgtttcgctttggggcacaggagctccatttagacgtcgcgaagcgtcacctgcgctgggggttatatggccgttggctgtgccattctgctgtccttggttttcttgatacccgatgaagagcttatcgccgtgcctgacaggaaggaaccgagtagtgttagtggctgtgacaggtaacctagatcggcgcctaatctattaacatgcaggcctcgactcacttgagaccaactttgtcgaaacccacgccatctaagctgttgaggagtctctcctcaccaccggtgccgatggggcggttggagagggtgatggaagagggatcgacgttcggagggagacgctctaggatctagaagagcaatataagcactcgttcgagctttccagtgctatgccatgaggcatgggatacacacctgtggctgcagagacgggaataggtcttgcgggttgaccgtcaaccggaactggccgttgcggctttcgaacctcagtacgatcgggcgtgatgccatggtggtgacaccctagaaagaagggaatggacgaaatagagaggttgtatcaatatttgcgcagcttcagtaactcatcagactcatcagatcatggccgagacgtgggggggaatgaagaaagaagagttgaggcgagagagagagttgaagagagcttggaggagagccgaagaaggcggcagcggagctctatcgtcattgcaccccgttaccgcctggtaccaccccgccgtttcttctccgctgacaaatggtgtatctttggtaatccagatacttccgtcttccaagggttccatagatcattcatgactacatagatcatctacagcacatcctgtaagtcaagtattatagatttatagatgtagtttatttattatgattctgttctaagtatattatgggaatagcatcacaagaacaagaaacctaatcctccgaattaaacgccagtatccaaaccaacccggtcaaagcaaagcaaggcacgaatgaaactgcagggtatcaagagaaatccgatttacatgatggtgcacttcttaggcaaaccacatggtccctcgttactcttgtctgcatcactcgctccctgagtgccctggccgtttttggctggcgcaggctgggatttcggagtctgagtcgtctgtttttgcgacgctgctgcggccgccgcaggttgcgactccgacttggcctgctcactaccatgcagtcaagcgaagttgtgggcagcaacgtgctcgtagaaggccttgccctgggtctcagcaacctcgagctcgagagcagagggctggcgggaaccatcggcaccctgtagggaaactttatcagtatgttgtcgcagacagaaatggtccgggatcggtgtaagtaggaaaacttacggcaaaggtaccagcaccccaggcgctaccaccgtggacctcattgaggttggacagctgggcaaagacggtcttgtagccgagaggaacgtagacgaaaccgtggtgggcgagagtgctcatggcagcaaggcaggtagattcctggccaccaccctgggtgccggtggaaacgaagagaccggcgtacttgccccagtaaccaccggaggcccagatagcaccagtgcggtcccagaaggccttccactgggcggggaagttaccgtagcgagtggggataccgaacaggacggcgtcgtactcaaggagagtgttggcttcggcaacggggtagctggacttggggggagcgtgcatcttggccagaacatcgtcggagagggtctcagcgatcctagaaggattatgttagtcaccgtgacaagtgcaattggctcaattgcagccattgacatactggaagatgtcggcggaaccgccagcagcctcaatacccttcttctcagcctcggccagcttgaggatgtggccgtacatggagtactatgattaattggcacattagtcatgcgggttttccaactggtgaagtcacaacacggtggagtatcactcacgaagacgatagcaatcttgggagccatggtgatggtggggtggtggggtgaacctggcgggtaaagagagagagaaggaaagcacagaagaaggaagagacttttatcaagaaggttgcttctggagaagaaaagaaaaaaacaagcaaatggatccggtcatggtggccagactttatagcctcgaggggggaggagggaggtggggggaaaggtactgtgcttgagaagctccgcaactcaaagcagcttcttctcactcagcgtttggcaagcatccgtaatcgattacttactacgaccgttcgcctgttcccgtaggggccctgtctgcccgggcgcgatgattggtgtcgaggtacctaaaagtggaattccagagccactcatcgtgcgtgccatccaatcaaccgcgatagtggagccttacggatcattgacaaatggagctcggatgaactcgactggcgctgaacgatctcttattcaccatctcataagctccctcctctcctccccgtgggaacagatatggggactcttttggcggcacgggtttgatccctcctcctttcgggaactggagctccctagcgaagattagacgataatattgacaagctactttctcatttcccagtcgctagaggaatctgtctgttctgtggtctgatagtcatgatgtcatctggatagcaccttatcactgtcggctaacgcaatgtctctcacatttctgccctgggataactgtctctctttgtttctaggggttgctgctgaccctcaattgacgctatctacacagtatctactatctagttggcagttgagaagcggcaatccgtgcacggtctggctagaccctatatcgacccccgttcccggcgccatgttagattgccccgatgtctatagcagacaccatatacccaatcacacaattgaagctccagctctgcttcttcttccattttattacattcattcatctatctacctaccatgtatcctctgatacacaataaagagacatctaagatgcaaccatgatagattcaaccgtgtaaaataaagcgtaaacatgcctctcagctgggtatctcgacgattctgtaaacacaaatctgcaaaacaaacacaaccaaccctattccttttatcatcatcaacttcttcttcttcttctttctctactgtccacgtccacgcccccggtaccgaccccgcatgaaccccccaccacgaccacgctcactcctccactccctctcacgctccttctccttctcctgttcctcccgaattaacgcccgttcccgttccagctcttcttcggtcttctcgacccggatctgcggacggggaaggttctccgaccaccgggggtgagcatccacgcaggccttgccgtccggacagaacccagccaagtagtattgacacaagcgccgacgaacatgccgcttggcacacaggggtcccagctcgcagaatccccggtcgtagtgttcacaagggggcagacgcgcctgctcccgcacgtgctgatacaggcagtcatcgccattgggacaatagccggaccgcgagaaggactggcattcgggcatgcgacggaggttgtattcatgaagatactcgcacttgagaccctttttgcagagtcccttgaggaaatgtttacagaccagagatccatgtgtggttgatggtgctagtcccgacgcggtggtggtcgacgtggtgacacgcgatggggttgggtggcgatcgggacaggctggtcctagagggcagtggccttcgctgtaggctttgcagacgggcacatcactggcaaggccgaagccatagctctggcggaggaagggtacgaaggagaactcatcatagctcgggtcgcgggggctgttggaggtgagcacgcgtgatgctgcatggctcacgtccgccgtcatggtgattggtttggggttggacgacaagagggtagaaaggatggagtcgaggtaggagcaggagcttttcgctcgtcgacacgtttgagcggaggcccttgctttgtttgcagtcaatcagataactaagatgggctaggatatagacccgattaatgccctattgccttgcaaagtgattggcaacctcagacactgagcatatggaagaaaatggtcttgaagaacgatgaatgatcagtctgcatcgtatgagtccaggaaagcgactcctagccttgaaagggcagtatgttgaaagaggcaggcggtggcaaatttaacatgcttattcagcaatctcatcgtggaagtccatcgaaccatgtaaactggcggtagaacgcatgaaaggagcagaagaaggtaatccgtagagcatctagttacttctacagtgagatcgggctgtccaaaagggatcctcgtcgatgcttattccccgcccttgtttgggcacagtcagccatccatgctgcagcgagacgcaccccgtctttccttgatggttgacggcagcctggggggagcgccgggcccagttgcagcaggccaatgggtacgtttcccaagcgcgggcaagcctggctgcccctgcatacgagcattcctacgacttacgagatcacatggtccgttgcttgatgggtctgacgcccgactccctgctcgactgtgagaaggatgcatgttgtacggtgtaacttgggactagggaacagcccggggagtaacccagttccgatggacagcacaatcggaatgctttcatgcttcttcctcccaattttttcccctatcttcttgattttcttcgtagtgaatgactttaacaacaataccggtgcggttgtcggcgctctggagcggctcctgtcgctggcgagtaacacgccggagaaaaagtgtacttgacgctaagaacccgaggattgtctcacccctcctcgttctcggtgcctattcgctcggggatcagatgcacatccaatatggggtgaaaggttctcccactcagcatcaaggtaattgagtcgcggtccttcatgcggggatggggcgtcactagtcctacaggttagtcgtccgcggctgcgtctcccccactaccaacatttccctcagacgaggatgcaaaagggaaataaataagaaaaaaaagcaacgacggtgggaactctaactgcagccataagaaaatagtgggcaagaactgcattttccaacccagtcgatcccccagtccgatccggaacaaccgagcgaatacttcatgaggattactgagcatctcccccatagtggccaatcgctgcaatgctgatacatcccggcatttgctctgggtatattgcatcagcagtcgatcgctgaattgacctctcctcagtcgccttcaactcaatagtcccgtgcgacgagtctataatctcgtcgcgaggtattcggatttgggagaaaaagaggcttggtaatcgacgccactgtcattggatttttggagggtctcgaagcaccaggatctcaccggagagtatcgagagggtaagaactgggccttaaaacaaaccttagcaggccgcgtcctctggccggtacaccagatgaagggggagaacgttccggggcggccaataatgatcaacacgatcgcttgatctgctcctccgacctgggaacctgggacagcaaaaggcggggtgacaacgtttggaccgtgtctggggctgtggctggtcatcatcagatgctcccatagtcggacgttgatctgattgaccagcccaggccactgctgatggaggaggggggaccgaccgaaataggcccctaaccttagcagcctgcatgacaaagctgcataggatgttgcctgcaaattggccgcattgcaaccctagagacgagaatacgtgagtagtacgtggtagggtgcagggaagggtagttgtagaaaagccaagtacctggatcatggaaagagtgggatgatactgatgtagccactgcgtcgggtcagctcaagtggttgtacgtggtttgggccggaggaacgacagaagcagctttcgttgttgttgttgtcgtcgtcgttgttgctgatgctgatgctgttggttcatcctggttgccttctttccttcctgccagtccatccatcatcagttccgttgcagtgtctctctcctcccgttgctcctgctgcttctgctgcagatcaaagggtttaaattgctcaagacctcagcggagaaaaaaagaaaatatcactgccacactaatcgtacgatcacttaccttctccaaactcgcgtgggggaagcaaatcaaaaagtccctaaatcgcatcgccagaccaacaggcactcccacacgtgacgctggctattctggggcttgttccatctttaatcctcgcatcacgatcttaagcttatttttgtttgtatttcgacctcacatcctggtcttcagagagccaatctttccccctctagttctactgcaccctggtttccctcccccctcaccactaccggtcatgttctccggctcctccctctttccgcactggcggcgcaaagcagccgaacgctccagtaatagttcctacgaggtgcccttcttcctgaacgctgcctattatcccaattggaggatataccggaaacagcctccgtcggcccttcgattgggcttcatttctcatatcttctacgcgtttgcatggtactagtaacctcaagtcggcaccatgctgatggtcccagtccatacccagagacagttgttaaccagcctgcttttctcgttcatagggtcaaagaagatggtaccgtttatgtaaccagtcctctctccccattgtgaggggctgctctggctgacaagacatgacttcaaaaccagcttagtgacgaatgggccgatgcgcaaatgcccgtcgacggcaccaacggctgcctgcgggccttcgcgcaactgaagccgcagtattccaagatgaaactcattctctcagtcggaggaggcggcaagggcagtgagaacttcgcccaagtggcccgcagtcaatcccgcaccgagacgtttgttcggagcgcgagagcactggtggatcaatttggtctggacggcatcgacggtacgtgtaatggagccgagcccctctccccttatcatcatggatgcgtcatgtcggtatagtgaacagaaaataaggtaaaattgtgtgcataccctaaggctaaccaaccttgtgctggcccaacagtggattgggaatacccctccgacccacaagaaggatcggactatatccgtctgctggcgcgactgcgcgaagtcctgccggccccgcgttatgttctggcctcttgtctcccggccggaccatgggctctccgtaacatcgatctttccaaggcgcaactctatcttgacctgatcaatatcatggcgtatgatttctcgggcccttgggagaaccagtcgggtcatcaggcccagctcttcagcaagcatcccgcagccatttcatgccaaaactctatctcgtacgtgctcaaccagggcgtcgaccccaagaagctccttctgggcatccccgcatacggccgctcgttcctgggtagcactggagttggtcagcggtatgtaggctgtggcggtgaagacggcgtcttcgactatagccagctgccgcgaccgggagccaaggagcatcacgacagcagtctgggggcagcatactgcgtagggggagatggcggcttcgtcacatatgacacaccccagacagtgcagcagaaggcgaaattcgtcacaaagatgaagctgggcgggttattctactggcatattggaggcgacgcacggggaccgcgaaagtctgattgaaacagggtataacacattgcatgatatgtaatttccttctattccactgtcagtatattcaaggttaggctggactttatttttgtcaaaggagggcagaagaaagatgatgaaaagaaagattaaaaagttataccaggggagaaattcaaaaggaggcacacgtgacattctgtttgtttagccattgttatcctgattgatcaaaagagagagagagagaaacagaaaataaaaagtacgacattcttatggcttatttggaacaaacaaattatctcgcttaagcatcccagccggggaaagatgagacaatcgttgcacttattgataagcccctcccttttcataggggggtggtttcaccatgtaggtagtatgcagcaaagcaacgtctgtgcatccgcgactattgtttattaagctattcatccattcatagttatcattctttgttccacccttttatttctagtcatcataaaagttctatataagagcaacaaaacgttagatgattatatcatagattattacatacactaatactatactagataaaagttacctacctaactaccaacgaggacacaagtccagctcccatccatccatccattcatccatccatatataaaagcacatgggaatcacaacatcatcgtaagcagtaagttagccatatataaacaaagaacaaaccatcaacccctcccacataacacatatgtctcatttatatcccacaaacaagaggatatagaatccgtcagtccgttaaacaaaattacagacttttatttagagacgagaccgactgtctgattgacaagccttaggctagctcaaccgcccaatgcctgcgtcacgttcaattgaacttgaagtttgagcgacgccagcgcttcttcaatgtagaggaggggctggttgttgtagatgctcgagttgcctgtgatgtcgatggggagcatgtagtccgggtagctgcttagcatgccggcgacggtgagggtgctgacgttggcggtcatggggacggtattgttgcctgggccgatggtgaggtcgtagatgaaggcttggccgatggcggtgttattgacctccaggttgagagtcaggttgccctgttggatgtggggttagttggatgctgactatggtggattaggggaaggtgggggatatgcataccacggcgatgctaatgtcggaggggttggggatgtagacggttcctttggcgttggtgccgtctgtgttgttggttccaattgacatgtccacgagatcaaagcccgagagcttgttgaggcctaggccgaaaattatgggttagtgggttgtgaagggtaattttcagatgaggggaatgagcgagcttacctgtcaccatggcggtcttgttgtaggtgaccgtggtcttgggtagacttccctcttttagctggggcttgccgtagacgttgagagggaacttctcgttcattatggcggccttgcagaactcagcgaatgccgtttcgttcgtcaggttcgcacgctggttgacgtcgatgacaacgccattgtggccgttgaactggggcacctgaacgtgtgtgaagacagcggaacccagcaggctgatagctgcggagaaagtgtagaaggttgggtgaaaagagctgttggacccaatgacctgcagctggtggaggtcgaaggatgaaggtgaggggtcactgatgaccatcgatgtgacggtcaggttggaatcactgacgatgtgttgagccatcttggggtatccgacgtaaactctgttttcccacgtttgtcatgtaagtcggagaccggaaatagatagggggtggaggggggcatcttttgtcatgataggaaacttacacaggaagcaccaccacaagaacaatcacgatcaaggcaatgatatacacccaccaccatcgcttgaagtgtctagccacgcgagccccaaagctgggcttggccgtggccggcacggccacgccagcatcttcgaacacttcaggcttgctgtcgctggccatcttagttgcaatgcgccgctatctcaggtcgtactgaacctctcctcggacacaatggaccgatgatgtcggtgtgacaatggcgggggtttctccttccgcgaggaccgagccgaggaatgtgggatggctagcacaaggattgtctctacacagagacggatccgaggactcagggacttgattaaagtagacaagctgcaacgaggtcagcaacggaccggcgggtacggggggggagtactatataatcggctaccatggtgcgacagcagcgaagatacatacccaccagtctggtcgaggtcaagtgacgggcaagtgatatgcaagaccgacaatcgatagggttgaagaatgaccacggaaccaggagaccgaatcaagggaggcaagggaggagaggagagaagaagaacccacaatcagccaggacgagggaaaaagaaatcaaccgggtctaaacacccccctgcccgaacgctaggtcgctagatatatcttctagatggccccgggaagaaaagagaaggggaaaagaaaaattgaaaaataaaagctgagaccatcacatgtccgatttcagcaacctcgatagtcgatcaggtctgcacaccgcgggtcatactagtgtacagccaggcttgagacggcgcggatgagacatgccgctactggccctagtagataggagtgtaacggcgtagactaggttgagaggcgagccaccaaagggacgccatgccaggaccccagtatgcgggaggacgatccagataatgagaaccagatccattaggcccggccccgcgcaaggaccatggccagcttgagatcgcatggagctacacacacagacacacacatacttttcggccgtacagtgggtgggttagatcaggcattgttcatgattgatgatgttcacctgcaaatcctgattgagaatgccagtgaaccgaggcaagaggtgagccatcgcatcatcccgctgcgagtgattggagggggcgcacgagaaggaagaggagaaggaggagcaggagggcgcaggagggcgcaggacgacagccggagcatgctgaagtgtgaagcactaatgcaaccccccaatttcccccggacgatcagggcagctttggggtgggaccaaatgccggcgcgatgcgagaaggtcgagctaaggctggctttcttcctgtttgggtcatcaggcctgcatccatcgccactctttctctcctttgggccaattctccgtgggctgcgctcgagcaccggccaatcgcccgacttggacttggactaatgaacccccggggtttaatatcgcctgccaatcaaccgagccggtcgcgacggtcagcccggacttctggtgcattcgtgctatattattattgcatattgctccaatttcttctgtcgaattcaagctgacgccggaatgagggggaggaggttagttgtttccccgcttagatagttagtctccagccaagctacccggtgatccaactactgaatagtccgtggtgctagtcaggacctgccctttccccccaaaatcctctcacccactaagagcaaaaagctattcttcctctgctggacacttagttccgagtatttacttgtcttcttgtctcatctctccccccagtggttcgtcgccactggaggacttggtttgatcacgctggaacagcaagcactactaacttctcagtggctgaggtattcagaagcatatccaaaactctatccatcattgatggatgaacatccaattatgtagcaattcctcgtgagtatcatcaggtatgatctcggtcgacacaaaacacacggctatctctaagaagaaatggaaagaatggtattacaggagtcaaaaaagaaagataatggaagagatcccaacgatcgaacatggacaagcgtccacggtaaataaaaagaagaaaagaagtaagagaaaaacaagtggagaaatgaaaatggttatagagggaagaaccacagaacgaaggaaggggggaatagtgttaaattccaaaagagaagaaaagaattatcacacagtgattcgaaaatgatgggtatccaagaaacgaatatcgctgcccgcaaattggaacgcgaagtcaagcgagagccactcaacccggtgacccaaaatgtggagcagctagcaaggcctgctcaaggagaaaaaggaaaggtgtgaagaaatagcgcgaaatgcgaagtaaaaaaaaaaaggaaaagcaaagaaaagagaagagaggcaacccacggatgggtccaaacgaatggaacgaaagtcaactagagaaatcttcctcaatcggcagcacatggtgcgtgttgatactgaccagagacactgaatggtcgaggaaggacaagaatatcaatggaaatgcatgccaagaccaaatgtagaacaagcctttcgcctttctttttgctaacaagatggcagatgcaagcaggccctcgggtcgaccacaagggtgctgcacacccgttcatgcttctgtcgcaaccgacttctttcgatggaaaagactgcgggttcgggatttgctgcgctgtttcttctcgggagtgctgccaggttgggcccgaccacgcgagttcgagctggactcttcgtccatgtacttgtccttgtagatcctatcaaagcccggttagacccaccccaaccatagccgacccggtggagcaacttaccaactattcccaaccatgctgatgcccttcgcttccgcctgccggtagaatttcgccgctttcttcaggtcctttttgcatccaataccttcggcgtagcagaagccggcctccgctagggcatcgccgtcgccccattggcccgcgatctcgaagcaacgcaaggccagggacttgtcctgttcgataccccatccattcagatggcttactccaagctcgtagatactcaaggcaaactgcgctcgataagccttctgtagctccttggcgcgagcgggaatggtcgggtttgaatcgtccatcaattcgataccaacggaatccacggccttgcgcaaccactgcacaccctcccgctgattcggtcgcataccccagccatgtcgacaagccagcgcataaagtaacattccggtcggatggttttgcttggctgcaatgcgcaggtgatatgtcgattcattcaaagatcctttctcatggcattcgatgcccttggtcacatgctcatctgcagtaattacagccgatgttgtcgtgtttgttcgcgcggtttgcggacgaacggtggattcagaacctgcagaggaagtggcatcggtgtggtctaccttcggagcctctgcttcccgttgttccgtaggagtatcttcggcgggagcgacctcggtaggcacaggctcggtaggctcaggctcggtaggtgcgggctccgcaacagaaggctcaggctcaggctcgacaggtgtcgctggagatggtctgacttccggagatggcggagtttgttgaggcagagggggctccggagtcaacaagtgacgagcggaagcgggagactcatacatcgagcgcgtcttcgagtggaacgaaccctggagggagggggaaggcgacggggtccttgcgggttgcgggggtcccgccgtgctgtgccgagttgggctctcaaacagcggctcctgccactcaaaatgaggggtttggaggccggagaagaccaccgaatctctcgatactgcacgtcctcgaggcagtgcgtacttggcataggtgtagcaagaaacagcagaagacgggtcttcattgggattgatgggcaagtctgatggcgatggtaccacgatgggactaggcttgtgtccacggttgagcgcgccttgcgaattggcaacgggcggttccggcgaggccctgggaccgggggcagagagactcgtgctggatcggctcagggggcgcgagaagttatagggccgttgaaggtaattacccgcgtttgaagtctcggagctcatagatggcgaccggggatgcgagcgtgttacggaagaggacatcgaagagtatggcagtgatacggcactgctggcggacatcttccggggctttgagaacgtcgaaccggcattcgagctgctgtagtcgtcgtcggagctctcaggctgtactcctcgagaactacttgaaggcctagacagtggcgatcccggaggtgctaggcctcgtgggggaatgttcaagcgagaaacagaatcagtcgaagaggtccgagagggtgccaccatcgagacccccagagaaggaggcgggccacccggggtaaggccagtgggggagacagcataaaaccgaggagggccttccggcggagcttcgggtgcgctgtgtgaggacatggcatcctcgggtgattcggcgcgtggcaggtcaagggcgttcacgctcggctcttttttgggggtcgtgtcttcgtcctcggagtaatctcccacttcgctggtaaggtgcgacaccgcactcagacgaggatgttcagactgcgggcgaaatttgggttcctccacctcggggcttaatttctgcgtaggttgtcttgacagttcattgcgtccgccgtgacctcttgcgccagtagaagaatcgctcgacgacggggatcgaaaatatccagggcgaggttgcgagagggaacgagcgacgctagatggaggtagcctgctcatgcgccggttccttcgtgccgattcctccagttgacgagccaggagccgaccttgggcggcgaaggcatcgagcggggagagcgcaggaggaatttcaccatcataatgctcaatgcgtggggacggagccccgctgcgcaggacgtcgtgggagggagagcggtgttcaaacttgggccgggaggccatggttattatccagggttcgtcgacttggttcaaaaaaaagagggatgttcggtttcgttttccggggtcaagacaggaaccacacgtaggttccaatcgattaaatcattaaaccactaaggacgagcgaggggttcgattgttcaatcgcgttgcatgaagaatgtgggatgacgggagttggaatgggggggaaggagtcggcagcgcttgatgctctgcacaaacactggtaagccggaggcgcgcaagaacagtcttcgaagtactgcacagctgacagggtgcggacagaaggagggggcggaagacacaaaggaatgacagccccagtgagtaagataagcaagagggtgtagaagagaaaagaagcgaacgaacagctccgaacagtagataataggtggaaggtgtatgtggatgggtgaggccggtactagaactgaagagccggaggggaaacggcacccaattggtgtggattgtggtgtgataaagtgagggtggttttcccggcggataacagtcactacttactactaccactatatgagtagtacagagggagtgataaggcagttgaacaatcaactagttgacagttcaagagtcgtcacacaaagagaccatgaacaagcattgcggagggagggagagaggggagagggagggagggaggtgaggcgagcgggggggaaagagagagggaaaaagggaccaagaaggagggagtttgaagcgagcgaaactggaagagcgtgtgaaggacgttttggcccatttgatcaggttcgaggcaggaggtttcgttactttactttactttactttacgccctgacgatccccaaacaaggaccgtcgttctgggcgtctccacgcggaggggaagaaaagaacggtaacgccattaccgacgggtgccatgcagtctgccccccaatcgcgcctgttgctgctgccgacaggcccattctttcaggggttgccgttcccccgttacatacccataccggacagctgacagttcctcggtcttggcatccgcccaactgcaggcggatcttttaccataccttcattacacacctatttttcgttttattttaccggggcgaagtcaggggcttgcattactattgttcgctttatcgatgattattgatgcccggactcacccccaaaggtacgaaagagagtttctatctagcacggggaaagcctgtccgtcgggggttgaccagcttctagaaggcaatagcattctcgaccatcgtcagtctgtctgtcgggttagtggttcagcctgagtcgacggtggagtctgaaccgcaccgtggctctgcaatgctgctatttatattcgcttcgtctcccccctgcaaattttcgtatcccaaccttgagattcgctgctgattcgttcatcgcgtcccatgggttcttccctctcaggtaccatgtgttgctccaacgaccgccgttcgtttcgcttctgccatggtggcctccggctagtgttgttattgcgatagtcgcccgttgactagccagccggtctgtgtggtgcaaggaggtagatcttgtctaagattctgggtagatgctttccacccacttttcatcatcttcatcgctggtgaaatccaaagtaaaaccagtctggggcaagatgatgactaccatctggaacagatgtctcatctgactacattcttgttctgggtaactacctgttcttagtagagactatcacgattaagcggtgttctgtatttcatttggctgagaagaacggcaccgtgagggggtgcgcgtcctcagcatggacgcctgagtcaaggagtcttagccatcccacatcatcgccaaggatggggcattattcgatgacgatggtgttgatgatgtttttcttcgtgtccccctctctaaggacccaacaattggccccggggcaggtgctcgttttgtcagctggtccggattcaggtacaacgttgcgggaacgccaaacagtctaaaacgatcgcttgccagtgatgattggtgcgacaattaaaacactggagcatcggggaattctaccgctggacctccggccagcttcttcttagacttttctacgcccacattgactcgtcaataatcaaatagtaataatatcagcggcctgaggtcctcattgagccctcgtcgtggctctctccaaggctgctgacactcgtctgagtccatattgaagcttatagggtagcgcttgggatcaccaactgcatacttgcttactcttgaggcacctgaacatgtcggcaggaagccccgctcgatcttatcgtaagattgactatctacatgcttagcaggagaaatattgaacagggatattcctgcagccaatcttgttcctgacactcagtggctggcaatagcgcaagggaacccgacagccgttggaatgtctccatccactgcagtgacataaaacggattccatccatgggaagggcaataaaataaaatgaaaagaaaaatctcttcaacctcacagaccactctccctatcgtgagctaattgaggtacggaggagcagcggagacaaccatactccgtcttgcccaatcatgacgcacgccaggccgactaattgagtatttcggcgacgctccgccgaagcttaggtgttagcagcatgagtctaatcaagtcgagatgatcagtcgttaaggagaagaatactaatgtgaaggggagggggcgtgtgaattttgacaagggcacaaagaacaacccttccacccaatctctctgtaaatcatctctggtcgcgtgtcccttgcgctttgttcagccctccatatcgagcaaatccccatgtctatcaccaccccatgaaacaactgaaaacacagccctaatttactatcgctcatactatactacgctatacacgcgacaccgcgacagccaagcccaaagcgtggagcctttcaaaatgctgaaccgattgagaaaccgctccctctacgacctcctccacgtcgatcctcctcgagaccgtgcccacgtctacgaaacctcctggcttctcccacccctcccctacgccatcctccgcggcaccatctccctctacatcttcaccagcatcttcttcatctggggttggagcggcactcatggcgaccgcgcagagatcggagagagcttcagctacttcacctggctgacctactggggactaggtttctacatgctcttcgcctccatccacacagcctgctatgccttgaaaggtcactcggtcctcttcgaccgctggcctcgcgcccttcgcgccctccacggcctcttctacaccaccgtcactacctacccattcctcgtgaccgtcgtcttctggggaatcctttactcgggaccttggtacactgtgacttttagcggatggcagaacgtaaataccccttctctacccactacattccctgtgccctacccctcaaaatcttcataatatactaataatatccagatttcccaacacggcctcaactccctctatgccctgtcggaaatcatcctcccaaccacagccccgcacccattcctcagcttcgccgtgctggttttcatccttcttctatacgtctccctcgcctacctcacctaccacactgaggggttctacacgtactccttcctggatcccggtccgcatggcgagaagagcgcccatgttacgggttactgtttcgccatcctggcgatcatccttgtcttcttcttgttctcgtggtgtgctatttggttgaggcggagggtgacgggcgggaaggtgaagaggtccgtttatgatagggattatgcgggtgctgaggtgggtggtgatattgaggaagaggtgggggtagaggagatgagggaggagaagtgaggtatttatttacttgactcttttgttggttgcttatgggctagttaaggaggtggtggtagtcggggtggaggttgcgggatgtaatgtgatgtgatgtggttaatatgatatgctgtgggttgagttgtattgatgggtatagtggtaattatactaataaatatgagtttactgtattatacagatacagatgactatcactttgaccacggataagttacatacagttagttcaattgaaatccctcatatacctacttactgtgaagaagaagagaggccgtcaagaagaaatgtcaatatgacgctatagaaaagagaaagagaagagatgatatcatttcacactactccgtatcaaagacccccatcattaatatgcttaatccattaaaccttctcccagctcgtctcgctactccccccgcttccattctccgcgggtgtctgctgtccggtccgcaaccccagcatccagcctaccagtccagcgggaacccactcgccaatgaaatggtacgaccgtgccccccgaccaacatagatgacggggttcttggccacctttctgccgaagatatccttcgatggcgggtccagtgcgtccaggacagcgtagtgtagagcccgggccggtgatccgcggatcgtgctgggccctgcggacgcggcaggtcgttgctcgatgctgttgagatactgcgaggcgtacagggatcgctgttgcacactccaggcgaggacttccgtaccggtgatgtgactctgagcgttgcggtactgtgggcctaggtctatgttaccgagcttgagttccacgacgtcgatgttgttttgttgtaggaggctgagttctctgcgcagggaagttgcgaaccctgacagtgcgcgagttgttgcgacttcgggtccggtaaagggtgcggagagggatgaggagatggacgggtaggcgacgacgatggtgctgttggtgttacggagggtgaggagagggaggaagatctgggttgtaagaataggggagagaagacgggtgttgacggtgtcgatccaggaggagggtgggattgtagccacggggccggaggcgtagtttggagagggtacgaggatgaggccgctcagttggcaggtgtgcgggggcacaccggccatcggcgactgaggtcgagaaatgagggagtagatctcattcaaggaggggtgtatttcggatggtgaggagggtgtctgttcaaatcgatattgtcagtttgacgcgagattcctgcgagatttattgcgcttacggccgagagatccaaccaaagggctttgatatctgctcgattgtccgactgcacgatgtgctcctcctctgcggacgtgactgtcacgtagactatgtatcctcgacgttccagatcggcggcgatcgctctggtcatcggctcatggggcgacccggcgacgactgtcgcatatatcagactgcgaagtataagagaagtgggaagtttacatacccactatttccttccgggctccatttccagctcgcctagctctccgtcgctttccattcagcttcttattcccatagtacagcacacagctggtgcccaagaaggcgataagggcggcgctccatgctcggttgcgcaagacccaactgtgcacgcgatcaacaagtcctcgcggtataggcggactgggtcgatttctggatacgggccgaacggaggtgggtagccatgactggctagagagggtatcgcggagtgcgttggctgcgtggtccacttgtcggtcgatcgactcggcgacttggagggaatatctccttacgtcatgcggtatcgaggcaagctggggaacaggaaagcgtcagtacaaaggtggcaagcagagggcgcatgctaccaactcacgtagtcgaagaaaaactggtcgtcactagtcatggtgatgctgtctgcactcaggaacccgagctttctgagataaagaggttgatgaagattcgccggcaatgaagaatccgattcttatcggcgggcgggtcacatgagtctttccgccctattggagcgcccggatctatacggctgcaccgttgatgtgaatgctgcagtatatacaacaagcatatgatgggtcgtaaagggcttgttggtggtttccaacatgcgttaatctggtacttaaatctcgaaaggtggggttggaacaccgacgatagtcgtgtcgatatgccattgttattggctgctacatattcatatcatttgtctgcaacagttagtgtagtacttcgtactggcaagaagccccttgggtgagataaacgcaacgggcgtaatgatacatcgaaagccgcaaataccagtagcagcatgtctactatagaaatactatagcattaccaaatcccagaaccaccatgccaaagagctggctccgtcacaagactcccgtaagaccctagccagtgacatcggtgtgaatgggccgagagggtatagtaaggatgagtgtgaagtgtatccaaataagatcttttggctattagtatgcgtatgtatattctcggcaattctcgctaccgcgtgagctatagagagacagtaagctgaatctgtgcaagcttgttgtctactggagtagtccggacacatggtagctacctatactaatacagcggctcgaggaacctgtctgcgaggtaaaggaacactaaaacacaacgtgaattgaggaagctcatcgacgtctctgggaagagacgatggatagattgatttccgtgtaatttgggccctccaggtatgctgtaggagccatgttaggggactaattcaaacaggcacgcttcagaactctctgtggcgatcatttcacacaaataaaagtaatagaaaagaaaagaaaatactcgatcatggagatgcaattgactggaatcagcatatatatcctatctgtatctccgcgaacaggcaaaaaatttaaggggtggaaaaaaagtatgaccagactggggctcgatcccaggaccttatcggtgttaacgatacgtgataaccaactacaccatccggccaacttgttgaaaggatgcggtaaatactgcctcataaattaaaaatacctatcaatatggctacgccatctgtcacaatcaagcatgcaacacacccatgtagatgctcttttgtaactcaaagtaatgataattataatagctacgttactaggagaaagtttccccaaacctacctgtgttaactcatcccttaagtgggttgggctcagctggcctagcctattcgtgactctgaggtgccatggaaggccggacgcctgaaagaaaatatatatgtgggatgtggttaaagtaggatacaagccctgcattgtttggccatgtttgctcacagatgtatcgaggagccccagtcatgtgcaacactaaatccaccagcaaccacgcaggaacgctgcggtactcccaccagctgtaggggaccaacttgcatatccttaatctaagtacctgcctacatcacatacagtcaacagaatgagaatttcgtgttaagagccaaaggtacaaagaaatgtcaccggaagaggaattccccgctcatctatcctaggaagtctattcgcagtggctcaccaggttttggagtatgctaacccagcccagaaaacatagattgcggatttatggcactgttcagtcattaatattgtctgcgttcaaagagattcgaaatctcccatgcctgatctgacaatctgaccattaaaaggagcaagtacaatccgctcagtcaattccttaccagatgttactcggatccgattaccggtaaaccatacgagtaacgtctgcgatgaatcaatcacagtagcatcctctttcgcagcatagcattactatgcttcccagcctcattggtaccacattgcctggaacatgtctgcaccacgctgaggtagtattgatgattggctgaccactaaaccacaagcagtctaatatttacattcttgatataagattgcgatgctctttcacatcagatggtatggtgtttatcatacataagtcgaatccggcaactccgacacgcctgtgcctctaccgtgggtctcggcaaagcgagaaaactcgagtgttcccggcttcagagatcagcacgatgtatcgataaccttcacatttctaggttttctatcaggtcgctggatcggaagcttaaatcttttcgaataaggtagtgagttgaatccgcaatgccgaaacgtacggaagagttgaccgatgtttcgaagtggatcattgcccaagatgtgcgattcccagaccgaatcattgcggggcgcctcacccactgccgagtcattcagcctaaggacttatctagccgccgtctacatcggccgaaccaattatgtctgagttcgagatggccaaccacagactagggatcgcccacagtgttctgactgcgtgtctgtatggtgagagaacaatcggatgccccccctgagtgctgggtacttagctcggtaccctatcgggagccaaatctagtcaccctgccaagtgccacatcctctaatagttggcctgctatgagccgctaatcgctgggggtccgggttggtgatgtcaatattgttctgatcatgcaagcccctcagcctgtctactttcatggtgccgtaaggtagccacttggttgacccgcatcaaaggcaacttattaagtaggaggaaaggaacagacaagtttatgctacgtaaaagttcaggtagaaaaggggaataaggcgggagccaacggtcccattcggcaatatacacgttccaccttagcttccatgcagagcttcctcggtatataagcaaggaaaagcccctgcttaccgactggaccgaagacccgttttggtaagttgccaatgctgtgtttcagtttttcacaattaaccaagcatatggcacatcttttagcttgattgctctcttagccgttcacgagctttaaaacccacgactttccctttaccaaccttgccacccctcagagcatgttttcattccctcaccagggttccttcaagaaattggagaaggtttgtacttcctattcaggggacaaataatgaaggaagaaattgagggttttctggtggcccaagtcgctaattgtcacgttagttgggccagggaacgtatgcaacggtttgttcagccatgcgttgatttgtggtcgacaggtacagttagtggtccctgacagcgtatctgccttttatttcaggtttacaaaggacgcaatcgcgagacgaatgaattagtggccttgaaagaaatcaacctcgatgctgaggaaggcgcaccctcaacggctatccgggaagtctcattgctgagacgtcttacacatgagaatatcttgaccttgcacgatgtaataaatgttgaagacaaattggtgctggtgtttgaatacatggataaggacctcaagcgctacattgacactcatgggggccccctcgatgccgccacggccaagtccttcgtctaccaattgctgcgcggtgtttctttctgtcacgagaacggcatcctacatcgagacctgaagcccgagaacctactactcaatcaggatggacgactaaaacttgctgattttggacttggccgtgcgttcggtatccccatcagcaaattttcgagtgacgtggtcactctttggtaccgtcctccagatgtgctgctcggaagtcgcacgtacacgaccagcatagacatctggtccgtcggatgtatcatggcggaaatatatacaggttctgcattatttactggaacaacaaatgcggatcaactgttgaagatcttcaatattatgggcacaccaaccgagctcacctggccaggcgtcagtcagttgcccgaatacagaaacgatttcccgccttgctccccacaaagtctgcaacaacttataccgtcattagaccctgtagggattgacctcctgggacgcatgttgcaattatgcccagaagcacgcatcagcgccactgatgctttgaatcacccctggttccagggttttacttagaaggttgcgtcgaaaactgccttctattatagatactgtctcttcagtcgtttcttcagtcatacatccaggcgcttcctacacctctaatcaactacaatctttctattgcgttgtttcgtgtattacgacttcaagattttccaggccaggatgccgtttaagttgattccaagaattgcagaagaatcctgcgggtgattgcaaagcaacggttgggtccccccacctccccctacacagaagccggattgccgtccggatccacactgattatcggcctctatttcgggtcggagttcaatctcgtgaagccgatcacgttatgtcttcaggaacattgcagcacatttcatcaatgactctgatagattacatgtatcatacttctccttcgcccgttactgttggaacacctttctaagtttgtgcataatgacgggaccttgataacatgcaatggctttaggagctcaaatacgcagtgcttacaagctgcaatgcatagcacttcagtcatatatgctctatcgaaatgccacgaaataggtactgtttcctccgttcttcctaaagcatgtgattctgtttcaaatgttaacgtttcgcagtcaaacttggattctaagagtctccacacatatttctctagcctcacggtccatgtgaccgcggactatctgttaaacaagcagcccagcgcattcacccgcatttggccaaatgccctatataagacaatcgaagatttactgaaagaattggttcaaccgggtaacgcagcattgaaggaccacaaaatgatcctctaagacatagaaagtctattcatagatatatcttctagcacagacctgattgggggaatagggaatgtagtagatcggtcagaatatatgaatgctgaagatctgatctacgacctccctgagacatttgctttagtctgttggtcatgaccgaagtttggccaagtaacaatggcacatgtatctgatacgattacatttaccataaatccgtgctaaaatagacatcaatgcaggtcgataagaggaactacaactccttaaacgccataccaaatagaataagcacctatttaacctaactccgtgctcaataatcaaccccaaccataacaccaatcccataatcttatgcacaatccataagctccacaccaatctgcccgcaaaccggtacttctgtctctccctccctcgtccaaactatttcaccttcttcaagcttcaatgaacttcttgtcatcttccatgtcttcacccttaatcttaggcacaagaacaggagaagacggcacctccgccttccccttgatcgccttgccattctttcgggccctcttgggagtaggggtatttggcgcagaggatcccgatccatcaggagcgcctcgcttgcccttcgtgaacctgaaggtgatggagctgccgggcttgcggtatttgcctagctgctcgctgagagccttgccagtgggcttgtcgtctccggctatggggttcaagttagtgataaggtcgggattgttgtgcgtgtctgtgaggggtgtatacttacgccaggcatcgacgatcttgtcgagatcaatctggaaagtctgagtctcgaagatgagacggaggagctggtgtgaagcatgttagttcgtctttgtgtatattggtattgtaagggtgtgtgtgcttggggaaggaggttgaggagggacatacagttgccttgttctcatcggtccagcgagtcattttgatagtttatagttgaacttgttcaaggagattctagtaggtgagcttggaggttctgtgcgtctgaatgtgtgggtggtcgagaggatgaagaagagagtagagcaccgaggagagagaataatgaagattaagagagaaggaaaggagaagatagaagtagtactaaaaagtgggaaagagagatcctagtgaatgtctggaaaagcagatcacaggattgtggtttacttcggtgttaccggtgaagtgggcctggtttattatcgtcgagagcggtgttgagtgataggaagaatctgcttggaacggataatgatcctatcattttctgctcacttagcagattctctagttgtattggatttcctgactaggtttcatggggagcattactcactgcagtgctctggatgagagcagcggttgataatttggagcagatgtaaagaactaataggaagggtggtgcagggtcagaatatctttcatacatcctgcattccaggcatcagttagtgcagttcaagtgttcttgccactgttttccctatactcctcgttcaaatgccttgaacagtctacattgaaagcctctcgggtgagttgccatgcagcgtcactcaataacttttgtctataatataagaataataaattctatgcacttatataattccagcatagacagtatatagtctatcttctggaaactattccatatgttccacttctcttgtagtttatgatatcccaagtgctatacagagccatttctaagatataccagaaaattatatggtggagcaggagacacattccgcaactctaagcatagccataatagtacgtctcaactatgctaccatctaaccacactatgtagacctcaatagattactaaacaagaagaagaccagagaatttcccttcgatcagaatgaaagtcgttgagtggctaaccacccgattggccgtgccagcctcaggcacatatgtatccacgtgattcccgttcctggatgcctggatgcctggattagcaatcgaatcggagtggcactcagttcctattcttccaaatgattctttctgcctgaacatcatcatcatctttccccctccaacgcttggggtcatgtctctcatttattccagcgtgttgctatcctgttgggacacgttttccgctcactgacgcagtccaagtgtggaatatacctggtggaggcggtagcaagcatctgcatctagatctgtttccgctgtacttcaaataacgagtcactttcccgaagttccttgatatcatatccatttatcaccctcatattcatagcgcggtttgaagactgtatcttcaggattttcgccaccatgcgcgaaatagacccgctcgttttcgaataccagcatgagaagcagcgaccacgagaagcggaagcgttactaattcttagaaaagtcgcttcgctggtaaaacccatcatgcgtcgacgagactggaaagtcgggacgctctgtgaattctaccctcatcagcggaacctgcttggcttgaacgtcaacgcgggccaaaagatctgtctacggctgcggtatccttctgatcagcgccagttcttacctatcgagcaggtagtggatacgatgcttcatgagtaagtgattatctattttctatcacgtttcccctatatttttctctgcttagagagagcgttagtggttgatggtagtgtataggctgtgtcatatcgtgcatggacctcacaaccagcagtttcatgcactttggaatcagctacgagatgagcatgaagagcttgtcatgaaaggctacacaggtgaagggttcctttctgaagggcgacggttagggggacggaaaatgcccgtcgatgaggcacgccgtgtagccagagcagctgcggagcagaggcagtctctatctgctggatctggacgacgacttggtggagcgcctgttctgcgcggaactaatatgcgccgggtcatcgctgatgctgcgcagaggcgcatagaagtgacgaatggatgtgcctcgggcgctgacaacagtgccgaacttgcagaggaagcctccaggaatggcttccgaactaaggcagaggaagacgatgccaatgagcgagccatcatggaagcgtacatcgatctgattgaacaggaggagcgtgagagatacggcccttcttatattccgccgagccatgataatcccgcaggtccgcggacaacgctgtctccgccacctgtcctggagagcagcaggccgagagggccgtcgcagcctgcagatactattgacctcgtctcggatgataacctctacgataagccatggtcatgtccgacatgcacccttgaaaacccagcaaacttcctttgctgtgatgcgtgtgcatcagaacgtccgcggccaacaaccacaagatctgtttctggccctcccactactactgctagttcgattcagccaaacccagcagtgagcaagaacaagcggtcgattagtccgtcaacccgttacaccgggttcaaaaaccggactcgtgctgttgaatcattagccgctctcgaacggaacgccaacaagcgacctctcggatggctatgcgataactgcggggctttcatggaaaccgagtggtggacttgttccaactgtggcttgatgaagcgcgcatcatgaattatttagcattttgagcgtaggcgtttggcgcgagagaggcgttctcatcggatttgtatccggcaagaaatcccattaattttgacctatcacgaggtatgagtcttatatcacatagttgcatcgtcagacggtcctagatcatctacccggagcacataatgtaaagactattgtatcttcgacaggaacatcaaagttaacatggcaaagctattttttgacagaatcacccagtaacagccacctgcttctcctccgccgtctgcaccctcaactcccccttcgtaatcttccagatcatccagtcgctcacagaccggtcgtcattaacctctccctccctcaacagcggaatcaccgcactctccttaagcctatgcatcgtaccagttcgatgcgggtgagtcagcaatgccacgctttggcgcgccacattcgcctgctcgccaggggccgtaacaacacgatgaaatgcactatgcagcacatctcccgtccacttcatcagggaaacacccacattgatcagctcacacaccccggtctcggacgaacatactcccagttctctgtcacgttctccttccccgttggcagaatctggagtccacccgagacattaaacagcattgtcagggcgcctacatcggcatgcactaacctaaggatagaggaccgaagatgaagttcatgttgctactgctgatgatatatctgtgccctgagaatggccgggagggcaaaggccaacatttctgcaacacatcaaatgtacatgagctcgattagggcgatatggggatgatgggtgtcaattagtcgtatctgcttagcttagagcttccttagcttgttttgcttttgttgtgtgactctccgaggagccagccaggtaggaaatagtggtaggtagatacggtgacatcaagctaagattgttctctcatgtcagctactctggaatttaaaaaagtgctgtttgcttattggtctacgtctttcttattctgatcacctagatactctacagctttacgtatagagtttaatcatgaagctggcttgatgcctggctaatataactaagtactactagcggcccaataccggatgaaagcacggtatagagactattatacgccactcgagtttgcagatagcagacacgtctatatcgagtctcgaattcagattccagtaatgaaaacccagaattcagccccgctctacgcttgcttttctcatctggtgctcccaatgagttttggcatctactatgacccgaaaaaagtcaactatggctcgtgagtgttctgagccagagcctctttcacctcttccttacagatagctttcttcatagtgcccaacccctcacaccgaaccaggtcctgacagctgtttaacactaacacccagcatcataaacttactattaacatttctatggcttatggatagagaaaaaagatctgaccctgccacatcatacatcatccatgtataacatggcaaagtcccattagatatcgtgtcaataagctatatcgccatttactggattttaaatcgcgcagaggcactaattgcatactccataactagccaaaggcggacattaggtgatggcaactactcctaccgctttattgaccgccatatgcggcagaaactattgaacctcgttgaaaaaacctcggatttagcgggatttggaaacatacagctcccaaagaagtcatctcagattctgtatgttttggcggtgtggtgtggcagtatgttgggatgaggcggccaacaagccaatagttaccagctgactaacttctgactcacccacctccccggcgcaacacttccgccgacgaaaaatagctcccccccccaattttcttcattttctcacacttttcattttcccacagctggagctactttttctctcagcttgactctaatgctcgagtcgcgtattacatcgccacaattcgacattgtcacactacacgactaatgataattcaggtatgcataccaatctcagtttatttctccttaatacagctccatatccaaaaccgaggggtagaaccaatcaacacacaacctacacctatatgatgagaatttttttcatgaaccggtatattaggaagagccggaagaggaatggcagggacccctctaaaataaaaaagaagggtgttcactgtcgtcgatgcttataatggttctgctgagtggtgtttaaaagttgtgatttggttctatccatccctctcggttttgggttggattgactggctgaattctttctgtccgctctatgtgtgactgccaatctgttgggtacttgtgctgacaggtttattataggttttcttgacgaagctcaggtcaatatactagtagatagatagatggaatacaagtgtatagtatcatgttggaagctattgacggatcgttttcataatttgacatatctctatatcgatttacattgtatcgaagccgttcgtaaacgtgtaactccaggtataaaacttttcgtggccaaacaatccaaaacacaaaattcaggtctcaacgccattcagatgcatgtgtaatacaggtaggtatatatcgctggcccgcgcgcaatcaggcaatgctcgtgaattgccgcttcttgcccgtgcccgtctgcctctcctgctcctcgtaggctgcttcatcaatgtaatcctttgtgctttgttcctggatctgttggccgacgaactgcagagcggacaagttgaagcccatctcgtccttctggcgagccaggacctcgcgtagcgtagctcggataccatccagcatcggcctcatcatcttactagcgacgatctggcggtggtgcgtcttgaggatgaagaagagtacacggcaggtgaggggaatgttccactcgcggctggcccagatattgaggaacgtgaagagagcaggcaccttcgagaagggcaagacaagaagagcgtcctgaagcgcggctgcggggatcttctgcacgacgttcaagagataccgctctgccgagatgttgttcagagccatgtactgggcattacgctgtgggggtgcagcgttaggctgtctggccttgagggcgcgccattggcgcatgacctccaagtcctccatacccaaatccaatgcctccatgatcttttcacctgccattagcgtctccgcggtttgttttccggcgtcaacagcttcagccttctctccatcctggccatcctcgtcctgctccaaggaggccatcaggttgttgtcgtacatctcttccagttccttctctctttcttcctccaggaacaagggctcatcagtctgctcccaggtacggatgctcttgtcatgactggcggtgacgatgaaatctcccgagtgactgatagtcagagcccagatttcaccgtggtgaccggccagcttttggatgtgttcgaacttgtcaccatcccagtacttgataacacggtccttgctagcgctgaagaagttgtgcccgttaccatccttgttgttcggaacgaaagcaactgccatgacactgtcctcgtgggccaagaaagacttgtggcaatcaccaaagtccaagccccagacacggactgtcttatcagccgaacacgtgacaatcagcttgctgtcccaagaaatatccatgttgagaacaggaagcttatggccgtaaaggttaaggaagagtttgagggagtcgacaaagaagaccttgaccgtgttgtccagaagtgcaacagccagcagccgagcatcaggggagaagcgaacattaaggatgtcatccgaaaccttgagcgttctggtgtgcaccagcttgagtcggggggttgttctcttggtaccaggaatttcttcctgaaccacctggaagttccagaacttcgcagatttgtcggcactaccactcaccaaagacttgccgtcgggatgaacttgaatggaccagaccggcccatcgtgcgctttgatcgtatccagaagggttgacgaggcgatatcaaaaacctcaagctggccatccttgtttccaacaacaacaatcttgtcaccaggaagaaaagcagagcacagagcataaccacattcaagggtacgcaggcaggtttgagtccggacgttccagatcttaaggctgccgttggaggccgacgccagcatccgatcgtccgagctcaacgcaacagatctgatgtcggtgcggtggccggggatgtcgactgccaagttccggctgtagtctggctcctcctcatccttattcttcttgttcgcggtcacgacgctgtaagcttcgagttggttgtttgtggtcgcggccaggagttgcagacttccacttgactttgtgcgaatccagtcaaaggaccggaccttaccgccagttcgtacgatagtgtgaggaacaaagacttccgagacaggcgcagatgaggcatcctctgatttgtcgttggcatcctcagcagttgctccatccttgtcagctgcacgctgcgcgtccttctcctttctcctcttacgcttcctagccaggctcttctgcacctccgtctgcgagcgaatgcgccagatctcgactgccttctcagagccgtggattccaatatagtccgctcgagggtggaagctgattccgattgtgcggtcctttccattccggtagaatataccccggtccgttaggatcttttgtccctccgagccgaccttctctttggaaatgtgaatcatagcactctcatcaatcgaccagaccttcagttctccatcgtttcctgccgtaatgcagccactctggtcgggtgagaggccgaggctccaacactcgccattagactgtgccacatgcgtttcgatgcagtgttgcgcagccaggtcccagactttgatcagagcgtctttccctgtcgtcaacaagaagcccgcatgctcactgagaccggcctcattgagcaattcaatggacggggtgaggaaatggagcgacgtaatctgatcggtgtgtccgcgcagtttgaaaagtccgacttccgcaaccagatcccatacgatgatgtccgtgtctctcgaaccacttgcgaggcggacccctgtgctatcgaaggcaagctgagtgatggccgacttgtggccattgaaggagataatcaccgtctcggtccgcgaatcccaaattcgaatactgccgtcttcataactgtatcacagagggacatccaagattagcaaggtagcatgaaaggttgctaccatgatgagagaacttacccgaccgcaaaaatatcctcatccgttttgctccgtgtaattatcgtcacctgggccttgcaagacgtatcgtgccatctgcctagtagttcacccttcttgatgtcccaacagagaacctcctcgctcgcgcccacgaaggctcgcccagagcctgtccgacgtgcggaacccgcgagttcatcgtcccgggcccagatcgcattcgacgatccggacgcaatgagcccgaaagtcttcgaatgctcgaatttgctgaagaagtcagtacactgaaataattttgggaaaaattgctacacccttgagcgtctcacttacaaatatgacttcaccatcgttgggtgttttgcgacctgggaaaaattttgggagctcggagaatgaatgctatcgataggcgcaaatggcggcggtcgctacggagggcgacagcgaccactgccggcctcccccaccgcctgccggttccccaaagcccccatcaacgtaactcccatcgtggcagtgaccctcgtgggattgacagccagaattaaagggaaaggaaatcgcaggtcgagaatctgaatctattactcattatcattggatgcgtccgtcaacatgcttttgctagactatcacaacgttctcatccactccctcctgacggagcggttctctgggtacagcttcccccccgcctccggtatacgccaggctaccagctaacagctccattcatgcttccttcagaaccccgcccgtatcaatcgatcagatcgtttccgactttgacggagtgacctttcatctgtctacgccagaatccaaaaccaagatcctcatctccatcaacgtgaaatgcttccgggagcttgtccagtacggcgcccaggaggtgctggaaagggaatacggcccctacattgtcaccccagagcccggctatgacttctccgtcctgatcgatctagagaacctgcccgccgagcaagaggcgaaggatgaactcatcatgcgcctggcgctgatgaagcgcaacgccatggccgcccccttcgagagagcattcgatgaattcgccaagttagccgaagaggcttcgagatacacaagcgagactgcgccccagggagttaaggagggaggagaggttatggccattcactatcgagaggaggaagcgatttatatcaaggccagccatgatcgtgtcacggtgatcttcagcacagtgttccgggaggagacagatcgcatctttggcaaggtgttcctgcaggaattcgtcgatgccagacgccgtgtcctcaccctgcaaaatgctccccaggtactcttccgaaacgactgtcctctggagctggccggtgtgcctggccttcagaacggtaatgacggtagaatcagctacgtcactttcggtatgtattcgttgttatgcatcacccaccgttcgcagtcactaaccgcttctagtcttgttccctcgtcacctaaccccccagagacgctatgagaacatctcccacatccagatattccgtgattacttccattaccacatcaaagcatccaaggtagctttatatgtcataatgcaggccagttcaatatgcttactaagtctccaggcatacatccacactaggatgcgcaagaggaccgcagacttccttcaaggtaagaagcgacccctaacaattgtggtatgtccagttcactaatgaatgatagttctcaaccgggcgcggcccgagaacgaggagcgagaaaggaagacggccagtggccgtactttcagggttcagggatagagagctggctcaagaatataatctttgtaaattgcaggcgaggggtgacatacgcacatgcataagtccatttttttttttttttctctaggatgtatagattgtcgagcatcataacttttatcttcccatttttccttcctttcattacttttattattttttcttttttggccctctcaacctcgcattgtcaaaacgcatgacagctgcatgtggcttgaagtagtagtgcggctgccttgctttgttttatttgctgcaatataattctactaaccaacccataaataccgctggctgctgcttcagctcttccgttccctcccttccgtgtgacggatgttgacaagttggtgcagagctgcaaacacctgaaatgaagctttgagggagtctccttaatccccactacagtgtttcactttccccatctgtcgcaacatatttatcggtctaacctccaagcttgtcctgcacgttaagcacactggcgtgggtctagtcactgcgctattccgctacggccgacgaacactcgcgcaggatgcactggttcggaatcgagcctcagatcggccgaagcactccgatatgttaccgtggctgtcttctagctgcagccacaagtccagctgggtgaaaagcacacagatgaccgggtttaagcgtgtgaaccatccgaaccgccctatcaatgcacctgatcgtcaaatatgactcggatcgcccaacaggtcgccttcaattgggcaaggcattcccaggggattggttcggtgtcgcacattgactgcaaggagatttaagtggtgttgactgctggccaggatccgtgggggtcgtcactatctatctagccagcctcgatcggagaaacgggggggctgtagtggtgatgtgatctcagctcgggtctattctacgatgatcatttccggtgtctccgcaggttctcattcgacacggcgatgtctctgcctatttgctggctggctgggagtttggaggggtatggccgtctcagcgtgctgtcctccatattgggtctatctatcatacggggtacatgccgataaccgcctcctgcgaccttagtgagattaccgcataatttcttttggaatccgacaccaagggattcacgctgcattggcgtccccattaaatgcgcaatgaccaagaacgggcaacgctgaccccaatccgtacaattttccagatatcagctcctctagctcagtctaggcacgagcagtggggagaatcgcctattatactggacacccgctccgttgaagctgtacagcgggtgtagtttagcctgacctgcactaacaaatgagaaataccgcgacgggtcgcgacagaaagcatgcgcgaccaaatgtttgagctcgacggtgagatgcaaacatgttggacgtgagccacgtcctatcccaaccaggtcatgcagggtttttgtacgctcagcactgcctagccgatagtgcgctgtagacgagggcgaccattcgccttgatcatgccaggtcagctgtctagttggtcaagtggattttctagtaaaagcgccgtctatatcgaacctgttcccacccgactaaaaaggtgacagcaatagtgggagcccgagtaaacccttttctatttttctgaccgcaacccaatggcgacacctgttcgtggctatttggttttcgcttacgtttcccctttcttctacctggctgcgaattattactgaggttttaattagagcatccttactcgctacttcgtcccagctgagaatgtgaccatctcttcggctagagtagtcagtctcgacggtgagaactactaaaacagtcggggggaccccgcctgcaaggtatccctgtcagggcgcagattagcccttcagagcgtcgcaaccctgcatgctatatatcgcaacgtctctgctccagcgcgaaaaattagacgtgatccgcagcaatatcggccacggtcttgctctacgatcagcgctatcaatcgttgcgctcctcctgcagtttctcttccctccgctgccaacaaacagctctctagaccacccaagccaatataacgatcctaaattcaacgctaacaccaagggtgttagcttcttttatctttttgactggctctcccaatccttatacctttattggtttgtcgtagcttactcccgcttcatcaccctctgggccggccatgtcgtcgaggggaccttgatctgcggacaaacggagtgggcgactacgcagcgccaaaagtacaggcgacaacactttactggcagccagaagatcttatggacgtaccgaaacactcagccaagtcttacaaaatgtccgacaagattagcttattacctctggaactcatccttcacatactctcctaccttcccttcgagtccttgcttgccttcggcgaaacatctcgcaccaactatgagtcccataccctctgtcttgagtgtctacgattaggagtttttgagaagcgcatccactctgtgatttccttactccaggctggctggaccaccccggatcaaatggcacagatttccagtcacaataaacaagcgaacgactacacaatatccatcatccaacctgctatgagccggcttgcaagcgacctggacagcaagcctctgctaaaaatcaaaagcttgaaaagacggtgcccagcactactcgaaaaatcccggacattggagcagatgactcgggagcagaacagggtctttgcccaagtggtgaatcggtatggtcgaggccttaggaaactggagttcatggcgtatgatcttgacagcgagggtgccatggctctagcttctaaatgccagaatatattgcatcatctagcattgcgcttcgagcatccacatattcgggatggccccatcagacccagcacttggatgaatcctgccccaggaagtacggcatggaacatgttcctcggtataggacggtacccacaatttggcctttgcgggctacagactttgatcctggagcgggcgggcatcactccgtggcagttgaccatgcttgtgaagaaaaaccccaagctgactgttctcaaactgagaacatgtcgcggtgtgcagcccgagtttctaaactggctaggtggagtgtactacgagccagaagagctagggagcgatgaggacagtctagctcctggtcggaatctgaaagtgctgtggttggaaaattgccaccagatacttgcccatcccatcgaaaactatgagcacctgcccgacgaaatctgcgactttggtcttggatgggttagaggtctgactagcttgcgtgtaagtggaatcttgtcccgtgatacctgcattcaaccagctgacagagttatcttgacagtctctatctttcagcgagagcgcgaatatcccgcccgaatacattgacagagctaatagtgtgctttggaagataccagaagtcatcttgccttattcgggtcatggggacaaagcccccatcgaagttgatcctggattgttgtagtccacaccggttggcttatttttcttttttttcttggagggttggaggcatcttggtgttgcttcttgcaggtgactggagagggattctcgtttactgtgtttttgaagatagaccattatgtgcaaacacctgcatgtctgtgctgatgctacaaaataatgtaaatcaaatacatgacagcacatgatatgtatgataaggcaatgctagtagacgtgtatcatatggttctgtctgtatggtgattcacaagtacactacaagttgtcttactgaagtacttgtgagtggcacagcagaccccagatatttgccgactgggtgaccacagctcacaaagttgagaccgtagagaggcctggctagacctttaccaattccctgattaacgtgtccactttcctcccaggtagtgccaactgctcgcctgcctaaatcatagatagcagtgaggataaaatggctgaagagcaggtacttctctggctgttgaccccgtgagcgccttctcgtttccctccctgcatcaccctggccaaaccacaagaaactccccccaccctgtgtagtgttaacacccagcatgatcattcactatctcccctatcagtcaagcaggcatgggtctgctcttgcaaacgattgaaactcactgttaaccttctcatctcgtctctcatcggcggctccaccactcatacggactccgatacccgccgcactgtgacattcatggaaccatcttgcagagcgagcaaaatgataccgagtcacagatccgcctcccagctatgggccattgctcggcggaagctctttactagacgagagcccaagagcagcgagcatgactacccacaacaccgctcctttgactctgtttcctcttcttccttcagcgaacacaccgacggcttctacaagtactcgttggaagttctccaacagagtgacgaagaatacagagatacggttgagagcaggggaatgcggtcttcggacagtaccgggatgtcttacacgtcagctgtatgttggctttggcatcttgttgtgattctgtcccccagtttagctggaagctaacactggtttgacagcgaacggcccctgccgagtttcccttctctccttacgccgtcggcgctgtcgagtggaattctgcctcgggttatgtcaagaatctggatgatgcgcagggtcatgacgtttcgtcctggaaaaatagtgtgttggctgtatacgtgagggtgtacaccgtcgctaaagtggtcttcatgtctttcatccactatggaattgaagtaaggagacgatgagcccaaagtccgacacagcaagatagctgctaaccattgggcatgtgtgtttctagttggatggatttaacggcggcctaatggtttgcatcagggacgtagaagatgccatcgcgtccacaaagattgctcccttggttgaatgtgtcgagaagttgtaccatgctctttatgcaaggcttgtgatggagcttgtcgttgtcgacttatgctcttgcttcaagattgaagtttcccgcgtttcttcgcataacaacttcatgctccctgagccacgccacttgtacaacatattcctggcttgcaagcaagttctcgacagctcgacagtctgcagattctttaagaaagactttgtccagaactatcaggctacgttcatccaccgcgctgtaacaaagctcaacagtatgccgtttgtgatggacgaccttattggatatcgtcgattcgctcttgggattatcgacaacccggattctccatttcgccagaggtgggctgggagtggcctgatctatcatatgccaccgccaagggtcctgatcgttcattctgagaaatacatgtctttcaccccaagacagacttatcagtttatgatcccacaacagcccctccccttcattcagcggcacaatgccgacccaacattcatggaaaatgcacgtacatcggaccaccggcaggctgcgctagccatgcttgaaggcaagactgtgggggatcttcgaaacgagggcaccattcagcagctgatagaatacgccaaaaggagaaagtgtgtatgccaatcgtcctgcagttgcggccaggattgtacacaggagccggaccgactctgcccctgcgcggagtggaatatgatcctgttactgactcaggtgaacgcaaaccgtggggctcttgggcttcgcgaccgatgcaccgttctttcgaaggctgtgtttcaggagcttgcttccatccgggaagatattgacgtcttcgtgatcggattgacactgaacagagccattgggattttcggcgaagagatccagaaggaactatttgccgccataatttaaccacaaaaactgcaattgagtagatgatctgggtttttaccggcgtttggtggcatgatgagtgcgttgaggcgttcatggagtgaggagtgtgttttgctttttctcctttgctgagattacgttaattttccttggtcatttcccctttgagtagacatgtctgacgatcatcatatttccgaagatctcggggttgtacaacggaaagtgttggggaatgcgaatgtttccgagagggaaatggagcatgtcagatcagtggatggtttatcgacgaggtagatacatcttacatggtttacgtaggagtgggaatggacaatattcgattttaggagaaaacccaaactagaataaaaaataacataaaataagacagacatacaaccctactaagtgataatatgggccatctgcaagccaatgctagctcgtgttacatggtagtagtagtatggctgcattttgatgtgggggggggatgtgatggatgtaatgtcaagttgtatggggaattgagtgcctgaatggaatgtatgatggagagagatcgatcttcgaagatcgctcatacttcatattccaaaaaacttaagctcaagctcaagctcaagctctcctttctcaacaactttttgtaactcaaccgtgaacaaggtcaggtggggcgcaggtgaccggggatggggcaagttggtcagaagttggccgtggttcgcaagtctggcaagattttcatttggctctggccgaaattcagctccccgaaagagtctgtatctgcgcctgtgtgggatttccgcccggcacagcaatctctgggaaacttttagcgggcatggtgcccaagactgttgctagttcgacaggttgtttatcattcatcttctcctcctcttctcctctcgcttcgccggtaattagacgcagcccactgtggagcgctcattccggggcccccagcatttgggtgcgacgatatcgcgccgtctggccttcctacggcatcaccactcccatcccggatcctaatccacagttccccatctcccgttcgcctttctgcttccagacaggctatgctctctgcgccaaacggccctcgcgtcccttccccccaccgttcctgtctccgccctcttcctccttttccgacccgctgaccacccactacctgagtcaggataagagattatccgtccggggggatctggtccgcggcctgaacaacggcgacgatgctgttttagtggcggagaattacctcgccgtgaacgatggggtcggggcgtgggcaaccaagccgagaggtcatgctgcgtacgttgtttggtccctcagtagcagtctccgcggacacccccctactactgaccctactggatccgtctcatcccttcccgcgtgctgacatacccttccttgtttacataggctatggtctagactgctcctccatttctgggctttggaagtcgaacgagaccccaatggacagtccgaattagatcccatcggctatcttcaacgagcatacgaggaaaccatccgggcaacgacttccccaggtgaatggctgggaactaccacatcggtcacagcgttactgcattggaagcgcgatgctacggggaacatacggcccctgctctacgtgaccaatataggtgactgcaaggtctttgtcatccgacctagcgagaagagaatcctctttcgaaccaaggaacaatggcattggtttgactgtcctatgcagctgggcacaaacagcgtcgatactcctcggaaggatgcagtcctttcattggttgatatgcaggaggatgacctcgtggtggccgtgtcagacggcatcctggataatctctgggagcatgagatcctgactattatcctagatagtctggagaagtggcagcaaggacgtcatgaagataaggactcggagtgggcgcccccggctgtaatggcggacgagcagatggtgtttctagccagggagctgctcaaatctgctctggagattgctcaggatccctttgccgagagtccgtacatggagaaggcggtggatgaaggactggccgtgcagggtggtgagtgtcttcgcataccggttcagcgcagtagactaatcttggggcagggaaaatggatgacatcagtgtggtaatcggttcttgcaggaggaggcagtaggcctttccgctggtaaaccttgcacgcaggcggttggttaggactgaagtagttcttacacagctcatgccagcacggagttgacttgcatagcctttcatactttgacttcccgcacaaacctccgtcttgatttctgtgggagagggcgttctgtaagatggtagatgtccgaatcaacttcggctcggccgtcggacagtcgctcaatcatatcgcatacgcactatatgtgcatggcatgggtggtgtatatgttgcatgttgggatccggagccatttggaggccggttcgagaggtggtaatggcgttcgtgggacattttacgtttcgggctatatatattcgactggcacagcgagatagactactgcttattaacattgcattaataccctcgacatattctgtcaatttatcaactttccttgtgagacaaaaagtaaacacgcatctcccacatgccctaattccaaattttctactccaagccccatacagacatacatacacatactgcatatgtaactacacaatctctcaccatcacaaaacaaagacaaaaacaaaagagaaaaagaaattgcctccacacgggatcgaaccgtggacctcatcattactagtgatgcgctctaccactgagctataaaggcgctttgatggaatggtggccccatatttgactccatcaacggctgcttaacaagcccacgcacagaccacatcccgagctttctcctccgcccggcaaaaaaagtgaccgccgacgcaaagaaaaaaaagtccaattgcaccaaacccaatccccctcacaggttatacatactatattctaacgcacctcagacgacccgacagtcaagatgagggccaagcgatccaagaagtaccgcaagctcatgcaccagtatgagcttacgtttgggttccgtgagccgtatcaggttctgggtatgcagacatccattcaaccaatcactcatactatcatgtccaggataagggtatactaactaatatatgtgacagttgactctaatttcctccgcgccgtccactccttcaaaatggacttgatccccgctctggagcgcactcttcaaggcaaacccaagcctcgtatgttgccccggatatcaactttcgactgcaatcagtacagtatactaacaaattggatcagtcctcacaaaatgctccctcgccgcaatcatggcctcccaacccatcaaccccaggaccaacaacccctaccgacccgaccacctccccccacccaccacccttcctctccgccactgctcccacaacgctgactcgacccccatcgacgaagtcgagtgcctcctctctctcctctcgccctccgcggagagcaaaaagaacaaggaacattacatcctcgcgacggcggacccgcacaacgccaaggacaagtccgcgacggataacacagccgccggtcggaaacggaagcgcgacgcagaggacaaggctgaggcggcgttacggaagtcgaggttgctacggcgccaggctcggtcgattccaggtgtgccgattgtctatgtgaagaggtcggtgatggtgttggagccgatgagtgatccttcggatgcgatcagagagggtgtggagaagggcaagtttagggttgggttgaatgatgaagcgagaaagccgacgacggctggggacggggagaagacgaagaagaagagggatttgaagaagcccaagggaccgaatccgctgagtgtaaagaagccgaagaagagggcgccggaagatacttccgggaaggcggagaagccgaagagagaggctgaggagagacctgctgcggaggagcgggatggagaggatggagatgctgcgccgaaggcgaagcgcagacgtcgtcatcataatcgcggtgctgggaagacggatggtgatgagggtggtgcgcaggaggctgccgcgccggccgatgccatggatgattgattgttttgctaggggctacttttcttttgatttgacttccatggtacggcgttcggcggacgagataaaaaagtgtccatatgtattgtgtataggtagttatcatcgatattgatagacgattccaacatctaacatacccatcccaacacaacacaacacagcccaaacaagcataaacatacaccgtcaaagaagcagcataagaagagagagatatgatatagtataataatcccgaacgccaatcaatgtaagtaacccacatgcacccagcccatcagacacatacatcaatcatatcatacaccccccaccgccaccaagcacaaccacaaatacatacacccatttatttctccgccgcacttgaacccgaagaagtcgaagcagaagaagccaacgaagaaattgatcccgtctccgcaagcgccttctcttcagcccaaatacgctcaatctttttgcgcttctccttcgcctcatcccggttgcgcttagcgcgcgcataccgctccgccgctagacatttgttcacgtcgcgcttgacatcgttgcatccgcccagagctttgtgaatgaagcctcgtgcatggcattcgtcgagggcggtcatgatttcctcgcagtctgttgagggagaaagttagttgagtgcttggtatggtatgatgagatgtgatgtcggtggagagattggggggagtgacgtacttgcgttgtagggggtgtgaagatgggaatgcatcgtgactgtcttttaatagtatattatgctaggtgggattgaatgaagatgccaaattgacgttgtatatacaccaagttcaactgcactgatgatccgcatatggaatggaaggatttcttccgtaaaagccgggcggtgaagacttatcgggtattattctgccgggcgggggaaaagaagaaaaaattattcttttttcttaacctctttgattagttcaactaattgcttgtcaacggtgtttctgttggcattcttttgtttggaccttcgaggaatttgtgatttcctcttttgtgtctatattggttcgagttcgctgtgtaggttgatcaatcgcctgcggcaggatcttcgatctatctcttttctttctttctctttttgactatctgatttacgattgattgctctcacgatgtctatgattaccacttccgcttgggtgcggcgcggagtcgctgctcagttccctacgaaatatgagatcaatgaggaggaaatggatcgcatatcgaagcttgcgcgtatgcagcttgaagaggcgcagggtgatttgaaggctgcgcaggaggatgaggagatggaggaggataagaaggagggtgctttgatgatgaaagtgacgacgacgacctgaaggaatacgatctggatcactacgatagcgacgaggtcgacgaggacggcgagaagatcaccatgttcggcaatgtcaagtcgctcgcttatcaccagcccaacgaggaggacccgtacctggttatgccgccggaggaggaagacgaggagagagaggaactgcagattatgccgacggataacctgctgttggcgggtaaggttgaggacgaggttgctcatctggaagtctacgtctacgaggatgccgccgacaacctttacgtgcaccacgatatcatgctgcccgctattccgttggcgctagagtggttggacatccccgttggcaagacggccgagggccgcactaccggtaacttcgtggctatcggaacaatggaacccgacattgagatctgggacctcgatgtcgtcgacagcatgtaccccaacgcgatcctgggccagggtggtgccgatgccgagaacggcgcgaagaagtccaagaagaagaaggccaaggccaacgacgaatatcacatcgactcgatcctcgctctggctgcgaaccgccagcaccgcaacctcctggcctctggatctgccgaccgcaccgtcaagctctgggatctccagaccaccaagtgcgccaagtcgtactcccaccacaccgacaaggtgtgcgcgctggagtggcacccgaccgaatcgaccgtcctgctgagcggtagctacgaccgcacggtggtggcagcggacatgagagcccccgactccaaggcgcgctggggcgtggatgcggatgtcgagaacgtgcgctgggacgtgcacgacccgaactacttctacgtgacgacggacgccggtatggtgtaccgctacgatgtgcggaacattcccgcctcgcccaaggagtccaagcccgtgtggacgctgcaggcgcacgactcgtcggtgtcgtcgttcgacgtcaaccccaccgtgccgggctacctggtgaccgggtcaacggacaagtccgttaagctctggaacattgagaacgacaagcccagcatggtggtgtctcgcaagatggaagtgggcaagatcttctcgaccactttcgcgccggatgctgatgtgagcttccgcctggctgtggcgggcagcaagggcgtggtccagatctgggatacctccactaacgcggcggtgcgtcgggcgttcgtctcgcgggtgcctaccctggagggcgaggtgcaggaacgtctggtcggtattcagcccgaccaggatgagtcggatgaggaggaaggcgtgcaggaggttggagcggcgcaaggtgcggatggctgggaatcgatggatgaggattgagtagatgcaaaacaaagaaaagaaaggaagcctaaaaatggacgccttcaggttggatgactgcaacaaaaacaagataaaaaagaaagaatgaatctacggagttctacttatagatagatagtttgagtgtgacgctttttgcaatgaaaacgttgtgataccccataccattcacctgactagttaagttattttgtagttgagttgacgagaacggaagagagtcgatgaataagccgaatcctaagctgcagacaccaaaagatgggaagcgatgaagtgatgaattgatcgaccggcagaatacccaaaccagatatcgtctgatacggtctcgatcaccaatcacatgcctgcgatgaggcgagtggacgggtccggtgattgcattttattaggttatctcgtctgcaaggccgaaagtagatgaagaggtggtaagtagatgaggatggtcgaggtgaagaattctaatctgcatagtacatgcgtcggtgaatgggtagtcgctgtggaaacttcatccgaggagtggtactttgtgattgaccatggtgtaatgagatcggagggtctactggttattggcgtgcggtaaggtgcttacctactattaatcaattagatagttagattactctgtagtagtagtagtagtaggtcgtatctatttaattttaacctctcaacctacaccaaaaataaattcaatagaaacccatcgtacagcattcgcagaaagtatactcctggcaaaaaggacatcaaagcgaaaagcacaggtcaagtgtataagcgggtgaaaaccaccgcccagtttattaagttgacccactggtggggaaacaaacgaaaaagaaaaaagagaggcactcggtggtttgacccgcccggcatctccgtgtggtcttagtttttagtttagtgtggtggtacgtacaactccattgttccaagaaagaaccctcatggaacggattgcggattctatccgaccgacgcggtacctacattagagatcaagtatgtaggagattaagcctgtctgtctaggacggacgtgatgtatgtaggagaaccactcacacactccccccttcctttcgacgtcatgtccagcttgttggttgcatgaatcctttcccccccttcagctgagacggcagattgtttcaattccccaccgctcagggcacatggcggtttccaatggccagccgcgatgccgttcctggcgttaagccgacaccacttggcctcacttggtgtagcctcggtggtgctgccgtttgacgacgcccatttgggtttagtctgtgtatcattttgctatcgtttttgagttcggtcggcttttaatctagactagactttcttacggagtatactatctatcctatcaagggttccctctctctctctctccaaggtacgcaaatatgtaggagggagggagaaaggaaggaaggactaagggattatctcctaaattcatcacgccaaatacgcgccgagcgaagctttgggttggtccctgaatttcttttattgtttttttgtggccacccgacaaaagcaaatgaccgggggagatggtcaaggctgtccgtccgaccaccaaatcgcatcgcacgactagccgcgcctgactgtccgtcggagcaccggaggaaaataatagatgttaggaggaggggaggaatcagtagtactccgtagttacgttgttattattatgctggctacttcgcttgttctttgctgcgtagccccatagagtgcgtatccatggttgacttctggcgaacaggtggttctcgaccatcgcccgcatcattacaaggcgccaggcgaaccgttggagaaaataccgaaggcaaagttttttccacatccataactctatcccactcttccagttggtcggctaaagaccctggcgaacgagtcgcgactcaggatctgatccaagggtgactgactgggtcgctgagaaaagagagacgtcaaatcagggcttgctattagcccttttctgcgtgcttaatttgatcatcttgaattttagtacccactcagaggacttgaaagagagaagaggaggaagtccgagaaaagagcaacagcgaagtagaggaaaaaagaggggggtaaagacaaggcccagaatcacggcgggaggtggttccatccacttcatccatcatttcatccactcaactcgcctctcttcccttttccctcgtttccccctcttcccttttctttcctttcccttttctctctcctctcctcttcctttcttctactttacttttccctttccccattcctccctgggggactccgatttatttcctgcaccattcctttttgatccttttttcattcttccagtcccagatctgtgtatcctggattctttccttcatacttttattctttcccaccctttatttactctattcacatctcgcccgtggcgcgtcctggttgtccgccccgatcttccctgtaccattatcggtggtgctaccgtgttgctgcagtatctcttcgcccccttgagtctagcagcccaccttccatttcccgagcaccaccactcattccacccgtcttatttattatttttctctgctgtgcaagggaaaagcaaaaaacagaaataaagaacgaagagaaagaagaaactagaggaagttttgccttcattcagacacggcttccttttccgctgcgacatcttggttctcgtttgacagctcatccactgtatctgataacggacattccggtgatcgatcttccattccttctctactccaccccgcgatcggccatcagcattctttccttataccgtccaaaggcgtcagtctctcgagaacgaggagacggttacggaaaaccctaaaatagcaaaaaaagcaatatcgcttgtacaactatcgacctttcccggccagctgcatatctgccattatatctgagcccgaccgcctagtctgcaccttccagcatttattgtcagttgcgttctcgactacaccttaatttcccgactatcgtcatcatggctttggctagagctttcaccaagcgcagtaagcgccccgaggtctcggccccgatgccataccgtgaatcacataaacacgctggtccgatcaatcgagacaagatctcggctcccgtggagttgttgtcgacgacgaacatgctggcttacaatgcgcccgacatccattcggcgacttcgtcttctacctcgtcattgcagtcgcccgacgattcggaaatgtctttcacgcagcgcagttttggatcgcttctgactacccccgatgagtcgccaattgagccaaacccgctgccttcctatttcccgaagcgatctgcgaccgtgacgagccaccctcgctcctcgacatcgaccaactcctctacggatgcgccgctggttcccaaacgggcgctctcccacacaaagcggacccaccaagagcttgctcgccagcgttccttgtcccggctatctccacctccgttgaactcgttgcgcaatgcatctgctgcacgtcagacacaggatagctacaaggccgagccccatcccttcagcaaggaacttgagcaagtgaacgaggtggtcgaggagttcggtggcacccgtatactcgacgacgaggagttgattctacgagataagggattgatgaagttcaccgcagatgactacctcgtggagatcgaggccctttatggcagcgtctttgatgattatcttggcccgataggtacgggggcctggctctgaatcgtgaccccgttcgctgttttactttctctaccatcttttccttattttgactcccgagggattccgcctggagggctctggataggaactggatatttccttccctcgccaggattgactttgccatgacccactcatattcactctttaatgtcttgtgatctaattactcggtttcatctttattttgaattagctagataccactgggaggagcttggatctatcacccccaacattgcttttttttattcttttcttcatttattggttgcaggttgatgcttccatgttgcgtggatcgaattattcgctctgctgactggctatgtgacggactctgacatgtctaacgaggttctcggatctgtattcttcttccttagcgtcgttttgaatgcgaaagacactgccagggttgctttttgtattggattagtcttgtaacaatgacacgatacatcataaagttctgcatctcatgcatgtgcatacgtctgcgtacagtacctcttgttcttgatccacctagtggacattgaagaattgtataacccgatcgggtaaggctgttgcgcgctggtcacgcgctggtcacgagctggcagcctgaggctccacagccgccccacacccaaaaaatttcacgtcgactttctgcttctccgcttcgtctgctttcttcctagttcttactccagacgggctcccctccaactgctggtctgtctccctctcacacactcgtgcatcgcagcgttttcagggtgcgtgtgttggacagtccgatgaaggtatctctcgccttccttactcccaagcgcgcttgttatctgtagcaacagcaggtggatcatctctcgactcgcaactggtcgggtcgtgtgctctgcttccaagatctgtttccatctcttaatatcccaccactcctcgcgtgtgatactgtgagagtgcgactcatgattggatttggggtcctgtttcaagcactccccagccatttcattattatagaaccgtcgatcctggcatggtcgtccttgccaccgcctcccgcaccgcaacgatcgcacccaggccgacgactaatccatccaagatgctagttacatcatcacctgtgtccattctaaaaacgcctaagagcaccccatccacgactgggattaagcacaggatgatgatgggagacgactacagcgatctctccctgtccccgtcgtcctcgtccgacgcggaacacagcccgagtccccggaagcggacgcgagtgaagtttgataaggaggtgttcatggtaccatataaagaggaacctgagccggaacggaaaccagagaagagcgcagccgtcgtccgcgaggaggtgcgcagggccatccaacggcatgtctctggcaccgacagcgaggcgtacgaccgcatcaaggagacttttgcggtggacccgcggcgccgggatgaggacaacatgtttgcctacgatgtacctacacatacgtccttgagacatcatctcctgggtcttttgtcaaatgttgcgtccttggatcgcacttgcaacggactggtccaagctgtgctgaatagcgtatggctgggccgggacgagtcgtacatcaagttgtatatacgctttctcggtaaccttgccgctgcccagggcagctatctgggggctgtgctcaaaatgctggtcaactatctgggagagcttcccaaggacacggggaagatcccgggttacccgtctgttcatgtgccggtgctctactcccgcgtgcacttggctttgcgccatgtcatgcagttgattccgtctggtagtggaacgctgtcgcctcttttgtctgcacagtttccttttgcttccgattcggccaaggccaacattgcgtatacgcggaatctcatccgggtgatcagctatgccccggagcttcagggtgatattctttccctgataacggaaaagctagtcaagattgacgtccacatccaagtggatctagaggacatcgaggatgaagtcggtgaggatgtcctgcagggagtctctccggaatcagtcatgatcgaggaagatgatgcggatgacgacgatgacaacgactccgttcttagcgatgattcggtagacgatgaatccaagcggatcaaggccattcgggacaacatcctcaagctggatggcatgattgacaccatgttcgaatattatgcccctccgttcacgctgggctccctggacgacaaggaaaatgccttcgatcttctgatgagccatttccagaacattattctccccacgtaccgctcgcgccactctcaattccttctcttccacttctctcagtcatccccaattcttgtggaccgcttcgccgcgatgtgcaccgagcttatctttaacaagacgcagccagccattatgcgccaatcagctgctgcttacctcgccagcttcgttgctcgcggggcccatatttctggcgaggttgtccgggatgtgttcgatctgttgggcacgtatctgaacagtcttcgtctggattatgaagccacttgccggggccccgacctccgccgctatggccccttctactcgacggctcaggccctgctctacatcttctgctttcgctggcgagacctgaccaccgctgcgctggagggcgacactccggaccaagtggacgagcttgagccagaagacatcatgttcccgccgtcagtcaaggaagtgctgcaccaagccatccactccaagctgaacccgctgaaggtgtgctcgcccgcgatcgtgtcccagttcgcgcggatgtcgcagcacttcaacttgatgtacgtgttcagcatcctcgaaacaaacaagcgactacgcgtatcctcataccgcagcatcggcgccatggccgatcctcgcttcagccaagtcgagcgggagatccgcgccggcgacgaccttggctaccaactagacgcctacttcccctttgacccctaccagctcccgcgcagccgacgctgggtggaaaacgactacgtccactggcgcggcatcccaggtctagacgaagacgacgactcggacagcgaagcggacgacaacgagtcggacgaagacctcagcgatgggaccgaaacggatgacgaattgtgatgcgtccaagaccttcaaaagaacaactcaaaagtgcttctctgtttctctctctctctctctctctctcgttctattggcgagcacaatacccccaatctgtttgcgattctgccatctcagcaggtttatgtttctctgaaaaagaagaaaagtttttttgtgagatctatgtttgttgttttatgggtgggaatttagcgtggcgtatggtgattgatttgatttgatttgatttgatttatacacgcacgggtgcatgtagtatgcctacacatcgcatatgcctgcttgttacctgcctacatccgttaccagtcctgcgacattgagactggtaccatgttggtatttataatgatggacgatggatgatgatggacagatggatggatgtacgatgacatctgcggggtagaagagaatgaacaaaataccaaaattacaacgttcatattcctgaagtgcacgtagatatcaaagatcatggatacttgatcgctgttacgacctatccggtatacttagctcaagtatctactactacttaagcagcatcaacatcaatattcgacgcatatgaatcagatagaggtcaatttcccccctctttcctgtctcaccttccttcacccacttcgttatttcgtctagttcgctggttatcatggaaaggaggggcaggcttggctatttctacatatgagattgagcgagtgggttggtctggtaccgggggtaatttgatttagaatatggtaccgtaggaagagtactactattggtagaaaaagttcagttggaaagatcgttggttgataccccgccaattgtgtttcttggaaagatgatgcaagttaagtcgctcatgcatgaggtacctcggtagtaatcaatgatcgtcgtctagtgtacatgtagatgtgtgcgtgtgtagtaaggatgatgtaacgattctagtgatggacgaaaacccaaagtaacgctaataactccaaggagtaataataacaggatgtataagaaaagaggactagtttatacaaaccggagaattgaagggaaaaaaagaaaatcgcaatgagttatgtaggaccgcccatccttttgggggaatgggtttacgcaccaaaaatatgcttcatatcagcacaggcatcgcggtagagaatatcaactgaatcttgatcgcggaagggattgggtgatttatcccacgcatggggcgccttttcgatcatcatggcgcggacatgtttgttgatattctgcagacgccgcacaaacacctggccctccttgagaagcatatcccattcgcagataaagaagaagatatcgtgcggcagggcatcggcgaggatctcatccgtggcgtgcacgggcgacgcatagggcgagatccgctcctcgtgcgtaggcaggtaggattcatcgaagagatcggtgaagaaggctgggagggtcttactgggcatgaggctcatggcgcgacgatggtcacgcgactcctcaaagtcgaggattgggtaccagcaaaagagggcgacgatgttgagttcgctggtggaggcggcggatactagttgctgggtggagtcgtaggggcccgtattaggtggactgctgtgaggttcgagggcgtcttgttggtcctgttgttgctgttgctggtgctggtgctgctgttgttgttgctcattgagaatactgcgcaggcggaggggcacggtgatggcgaggttcccaccagcagaaaagccggagagggcgatgcgcgaaacgtccaaacccaactcgacggcgtgggcagcgagatactgcagggcgagaaccccgtcgtcgacggcggcgggaaacggatgttcgggagcacgacggtatccgacgctgaccagcacggcgccgacttccccgagcacacactgcgcccagcgactgtcatccgtggggcatcctagcgtgaagcctccgccgtggaaattgaccacgacgggcagacgacggccttctttgcggatgttgagatagttgggtggcgtgtagaagcagagacgaacctgacccgaaccggtgggaatagtgcgaacaaaggcaggccggggaggtcgcggaggagtgacatcgtgcaggaacatgccaatgcgcattagaaagcgccagacaacggcttggacgtagagccaccagcgggaagacggcatgatggaatggccatacagcggagggaggagtttcaaagaggtaagtaagtggtaactagtagtgaaaagaaggttacgagagatccgaggcaggaacagacggaggaaggagagggagagtgtgagagagagtctccaaagagtaactctgggagagagcgcccggaaggtcggaggcaaaccagaccagaccttccgttccagtagaatagtaatcggttgattggaatgaaaggctattaatttacgtttgagggaggtttaagggccgcctgatccacggaaagcagctgccgaggaagacgagatccaaagcgcagcgcagccaagccaagccggaggaggaatagagatgatcggtttagaaatgacacagaaaggtagtcatgcagttcatatgcaggaagtagtagacaaaacgtaaagaattgggaatgaggaacggctctagtagttggcaaaaagaggtcttggaccacatcatcggtccttcattcctctgctggaccctgttttccactgctggaattcccattcgatgtgatggagactcttgatatcccggcttttgcatcatcacaggcatgacatcacttgcctcgggatcgacccgccagcctttatttgcgccctcgtatttctcacttttgatttgcaacgcttttgctactagttctattacttctctcacgttctggccgactcttgggtttgtaaggccctgctaagctctcctcctaaccttaattgtcttggaaaaccctgtgcccaactcactcttccttactacttataagcgctgacggtaccccccctcccattgtcctctcctctcttctctcccccgtcattgacggtgattctccctcaccttttctctctggaatatcctcccctataccccttcaatcctatcatcacatgggaggtgttgactcccatcctcccgcccccatcatgtctatcaaacgtgcgctgtccaaaatcaaacccaccaagtcgtctcccgacgatgagtccgctcacagcacccccgcctcggctacttccatgtctccccgtcgcagcatcctcagcaacttcctgcgcgatcgcgactatgcctcttcctccgatgacggctcagatgactcttcgtcgccaggcagcatcagtaaaaaccagcaaaaacgcctggcacgtaaacagcgcaaagagaagtcccgtctgagcgaggagcgtcattccgacgagtctgattcgcgtcggaaagaggaagtcgccaatgccacccgcgaggagacttcggagatgaaggctcgctacggcgaattgccgctgctacagtctcggacacgccctcgtgaggtccgtaccaacctagatgccatttccgaatccttggtgggccagcagatctgttttacggctcgtctacatatcatccgtcgcatgagtgccaagctagtcttcctagtcttccgccagcagctgctcaccttccagggtgttctgcatgaggaggcaggtgtcaagtccatcgccatgattcattgggctgagcatttgcggttgggttccattgtccgcgtgcggggcaccattcagaagcctcaggtgccgatcttgggctgtaccatccatgacgtcgagatctcgatcgacgagcttcatcaggtcgtgcgtcgtgaggaacccgtcccctttagtatctatgaggcagagattcaaaccgccgaggaggagcgcatcgaaggtcgtcgcagtcacatccccgatcgcgttcgtctcaccaatcgtctactcgacttgcgcaccccgacctctcagtccatcttccgcattcaatccgccatctgcaacctcttccgatttgccctcgatgagcagggcttcatggagatccatacacccaagctgcaaggctctgccaccgagtcgggcgccagtgtcttccacgtgcagtacttcgggcgagatgctttcctggcccagagtccacaattggccaagcagatggctattgccgctgatttcggtcgtgtctatgagattggagcggtgtttcgagcggagaactccaatacccaccgtcacctgactgagtacaccgggttggatatcgagatggccattgaagagcactaccatgagatgttggacgtgctggacgcggttatcaagtccatccttcaaggtgtgtatggccgctaccgccgcgaggtggagaccgtgaagcaccagttcccgtcagaagatgttgtgtggctggagaagacccccattctgcgcttcgcggacggtatcaagatgctgaatgactccggctggcgcgacgaggacggcaacccgctgccagaggatgaggacctccacacccgcgatgagattcgcctgggtgagttggtcaaggagaagtatggcaccgactactacatcctggacaagttccccgccagcgcacgccccttctataccatgcccgaccccgacgatgaccgatacaccaactccttcgacatcttcgttcgcggccaggagatcgtctccggtggccagcgtatccacgacccccacatgctggaggagaacatgcgtcgctctggcatcgaccccgataccatggaagactacatggagggcttccgctggggtgcgccaccccacgctggagcgggtgttggtctggagcgtctgctgatgctgcttctgaaactgggcaatattcgcctagcatccctcttccctcgcgaccctcgcagtttcccggccaagccagtgacggcacagctgcggcacccggagtcatcgactattgatcctccgtgggcgcgcgacaggaggggtgccatcgcacaggatacgagtcagctgcagccgctcgagcatctcattgccaactacggcgatgccacctccacctcctggggtgatgagcgcttcaagatctggcgcgacatgggcactggtgccgccatctcctacgtgcccagcagcagcaactacgtgatcattccgggcaaccccttgtgcgatcccaagcagtaccgccaagtgatcacacagttcctgcagtggctgcggcgcgagaccaagtacaagcccgtctggctgctctgttccgccgaagtcgagaccatcctgggcgagcgcatgggctggcgaacgctgtcctgcatcgccgaggagcgcgtgaacccggcccgcaacatggcagcctcggacggcgaaattgcccgcaagatccgacacgccgaaagtgagggcgtcaagctcgtgaccgtgaccagaggcgagatggtctccgacgagatccgccagaagattgaccagcgcatccaggactggctcaacaaccgcaagggcacacaagtgcacctgtccgagatccgcccttggcgcgatcccgagcaccgctggtacttctacgccgtcgacaaggagggcaccatctgcgccttcgtcgccctagccacgctcgcccccgtccacggcatgcagatcaaatacagcttcgacttcccgggttcccccaacggcgtcatcgaacacattgtcacccacgccatccaaacggccgctgcagccggtgtcaaatccttcaccttcggcgctggtgccatgtcctcgctgacccccggccataacctccgcggtgcccgcatcaagatgctccagcacacctatgacaccatggctaagcagttccatctggtgcgcaagagtgagttccgggccaagcttggcgccgaggacgacccgctctttattgcttatccgccgcatggcctgggcagtaagggtatgcgtgcggtgctgcatttctttgaagattaatcaatctatcaaacccgatatccatcttccccactctatctatctaataatgtctggaaatgtgatcatggcttatttgttacaaagatctaattacaggtagatcaatatggcttttatgtgttttgctttcgtcaaatttgtgcttttgttacttgggatggatggttcgcattagatattccccctattgttttgttgcctgggacgtggagcgacgattgtgacggattgattctggggctctttttgttctgtttactctcgtttttggatgtgctttcatacaaagacggtaagatagacgcagcgcctgtgtaatgaagccatgttgtatgtatgtatgcgtggatgtgtcttgatgaagaaattgtgtcattataactcattaataaaattgagtacaatagtaatattcaaagagtaatagtacaagtaaaagtaaccatcatgatagtagtatacccaatatgcaaatatcatccacagtaaccatgcatgcatgtatgtacctgttgagaacacaatcataaatcaccgcaccttcttcccctctctcatcccatctactatcgccccatccacatcctcatctccctcttccttctccctctcctcagccatatcatccaccactctccccaactccccaaccacccatttccccaccaaaaacgccaccccagccacgatcaccccgtaacacgccgtcggcaccaacgaccttggaaacacattccccaggaacggatccagaatcacatccaccgccacgggcggcacatgcgtcatcagctccttatccgtggtgtaatagtctgccgcggcgcggatacgtagaaacaggaccgagtctgtaatgggttcgttgctgtcgaggggagtttcgggattgaagttggtggtggttgagtcgtcgagattgaggtcaaactcggagtctggagtgctggcgaggcgcgaggaggagtagtttgttatcgatgagaggaggaaggtatctgagagggcgtgcgggagggtgtatgttgttagggtgaaggatgttggttgcttttttgttgattgtatagtcagtatataagaatgagggtagacggcatggaacacgtacagttgctagccaacagatgcgtacttcatagcgtcggccaggagtgaggttttggagaaagaaccaggattcggtccctggtgaggattgggttgggaaggatgcgttgaggtgtgtgcggaggatggggtgggagggggagaggcgcgcaagacctaggtcgtcgattgggggatgtggggttgggattgtggtagggggaggggcgaggaagatggtcttttcgacattggcggctgcgagagttgtaaggaggaggagcgcgaggaggatgtaagggaggaaggaggggacatggcgggggagggaggggagggtgagaggcattgttggttggatatggtcgatgaggggggtgtttcgtggtgtgtaggactgatttatatggtcattgttggaggtagagtgggataaaatctggaatgggtctgcgatgttgtgttagaggattggatatcgtatgagaggtgtgggattgggataggtactcgaatgaagcttgctggagatctagatcggagctggagtggaggatggaagatggtatattcttggtgtttgttttcagggatatccgagttttgtatgagaggataagttatagagccagacggtgcagggcaatgacgagtgatcaattgagagcagaaaacatggcaattgcaatggtaatggtggtagcaatccatggactgcgatgatccggctgatgttcggcgatctttcgtcatgccgtcactgctttacacgtgaccagatcttaaccggaacagggtgctgactcagctgttgaccgccaggtgggcagcagccaatcagatggctcatagcccaacgcgacccaacggacggatcaaccacggcggcatcgttgggttgacagcgcatgaaagaccacaaacaaatcgagtcgaccgattctcgtcctgctcctccattgtcactaaccaaacagttccccagggttcgtggcctctccctccctcccccccgtttttactaatttcccacctgttccctttccctcgaatctctctttcccttccccttcatcaattcaccatctccaattaccccctttcgtgccctgtgttgtggtggctcgttaggttactaactttacccctgaaacccccgtacagatcgcccttgggtattttaatttttccctctgtccacattccacgcccactccgtgtccctccatcaatccatatctgaaacttatcaattcgactcgccaaaatgagagaagttatttctttgaacggtgtgtgcccagtccctccctcgccgccgcttgatttttcgcgtggtcactaatgtttgtgttttcccctcacagttggtcaggctggttgccagattgccaactcctgctgggaggtatgtttagacacgggggaatcgacccctcctttcctgaaacagtcatcagaaaatcaaacaacatcggcatatgccatatattcttgggataaacagtggactaacggtgttgtttagctctactgccttgagcacggtatccaggtatgtgaaaacaaacgcctaggcacgcctctgtcgagagttgccactccacaccgatgagcaatcccactgatctttgtttgttgatgccaggccgacggttacttgaccgaggagcgcaagaaggatgaccccgaccacggattcagcaccttcttttccgagactggtacgttcccatagcctttccccccgtgtatcccgctcctccgtttgcccgcagcacaccctaacatgaaattgggctataggtcagggcaagtatgtccctcgtaccatttactgcgatctggaacccaatgttgtggatgaggtccgcaccggtacctaccgcagtcttttccaccccgagaacatgatcactggcaaggaggatgcctcgaacaactatgcccgtggtcactacaccgtcggcaaggagatgatcgaccaggtcctcgacaaggtccgccgtgttgccgacaactgcgctggtctccagggtttcctggtcttccactccttcggtggtggtactggttccggtttcggtgctctcctgatggagcgtctgtccgttgactacggcaagaagtccaagctggaattctgcgtttaccctgctcctcagaacgccacctccgttgttgagccctacaactctatcctcaccacccacaccacccttgagcactccgactgcagcttcatggttgacaacgaggccatctacgacatctgccgccgcaacctcggcatcgagcgccctagctacgagaacctcaaccgcctgatcgcccaggttgtctcttccatcaccgcttccctccgtttcgacggttccctcaacgtcgatctcaacgagttccagaccaacctggtcccctacccccgtattcacttccctctggtggcctacgcccccgtcatctccgcggacaaggcctcccacgagtccaactccgtcagcgagatcaccatgagctgctttgagcccaataaccagatggtcaagtgtgatccccgcaacggcaagtacatggccacttgcctgctgtaccgtggtgatgtcgtccccaaggagacccacgctgccgtggccaccctgaagactaagcgcaccatccagttcgtcgactggtgccctactggtttcaagatcggtatctgctaccagcctccccagcaggtccccaacggcgaccttgccaacctcaagcgcgctgtgtaagttcttctccatctgatatgcgacgttttcaagacataagaaagctaacggaaggtcaaatgtagctgcatgctgtccaacaccaccgccatctccgaggcctggtccgctctcgaccacaagttcgacctcatgtactccaagcgtgctttcgtccactggtacgttggtgagggtatggaggagggtgaattctccgaggcccgtgaggacctggctgcccttgagcgcgactacgaggaggttgccagcgactccctggaggaggaggttgaggccgagtactagatctgaccgaattttggaccggagtcgcgcggggggtccggccgggccgtccgggtggaagccgtggctcgccctgaagcaatgggaattgttccgttggggacaggcgttggccaaggttgtatacccaaatgagcagcgggactctggctgcatgcaaataggaaggagaagcttggctccgtagtacagactatgttttctttttgtctgagtatatttttctaatatccctgaagcagcgatgaaatttacccgctcgttcgaaactcatatgcaaaatttttttgggcgcctaagagaattgtaatctacattttgcaagtttcgagcgatttgatgattatccctgtagtggtaaaacaaacaggaattgacgatgagcggggatgaacaggctgttactagtactcccccatggcttatttgcataatgaaggggactgaaatgggtagaataataggagggtagatagcttcggcgaaagtaactctgagaccctactttaagttgcgccacatccaggaatggaggagttgcttccgccgaggtgcatccatcagtcggattcgtgccgaccgggtgagcctctagggagtagtaagtaatccttggaccctgaagggtggagagagatggaaaatgaactggactgacgtcggtgttggagagggagggagggagtgactggctgaccgcccgggggggttgcatagcagtactccgtagtaaattaatgtaggagctgtcctggctggcggcccctctgcgctgctcggctcgctctagttgctctggtcgccagttcctccctcctcctacttactcctcccccttctcccctaatttgattgacttcgggattactatcctctttttttttttttttttatctttcggttcccctaccccctctgatccgctctcattcttcagctgccggaccttcccattctccctctgctttgtggcttttggcaatcctgccttttctcagttcccctcagaagagctgctgctgccgccttggccatccatgccccgtgctgtcttccacctcgaaggttgacagccgtctctcctgctctgcttcaacgctcccccgttcggaatttgtcggtcaattttttggcgcacagtgtttctacggaagggaggctagctcctcctgagctataattatggctgataacggtgagtcctcgtgtcctgcctgcacaatggtcgcccgcccgagctctcaggggacaacggcccaaccccgtcgaatatgacgacgaccgaacaacggaactgacggatgttctcttctcccccccaaacagctcggaacctcaatctcaacttgaccccggaggagaaacgggtcttctaccaactcttccaggccgccgataccacaaacctcggcgtcatcaccggcgaggtcgcggttcctttcttcgagaagacccagctggccccggaaaccctcggcttggtatgtcgttgcctaccactctcggggaaagctttcccccgcgcaatcgcaatcggaatcggacggctaactggatcatggcgacgtgatatagatatggcagatcgcagacaaggaaaatcggggtctattgaccccgtctgggtttggtgtcgtcatgcggctgatcggacacgctcaggcgggtcgcgcacccacagaggaactggcctttcaacgtgagtgaatgctaggtgcccgttctgggccccgatagaacaatagatgatgagaatgcaacttttgctgacatggttcaccgttgcagccgggcctctgcccaaattcgaagggatcgttgtcgatgccaccccgaacccgcgtgaagcgggcactaccagccctactccgggcgcaaacgcgccgatcagggtccctccgctgaatcccgacgatgtgaataagttcttgtcgctgtttgagaaatcggatgtgtccaaaagtggggtactgccaggtacatacatatgcccctccagctagcgccccgaggccgaccaggcatggaccccattgctaatcagatcatcatgacaggcgagacagccaaacaaattttcgagcgtgcgcggttaccgaacgagatccttggtcgtatctggaatctggcggatagaagacaacagggtgctctggatgctacggaatttgtcattgccatgcacctccttacgtcctacaagtccggtgcgatgaggggaatcccccagacacttccacccgctctctatgatgctgccgctcgccgaggctcgatccgctcgtcggtcggttcccgtcaaggtcccgaggttcctccggtgcctgcgattccaaagcaattcactggacctcagcgtacgcagagtccgatcaataggcaacctttcggctcccccctctccgctcaagccaccggtggtgactggctgatttcgccgcaagagaaggccatgtttgacaacatctttgctacggttgatacggccaaggcaggttcaattagtggtgaccaggccgtcgccttcttcatgggtgcacagttgcctgaggagacgctagctcagatttgggatctcgcagatatcgatgcggacggacagttgaccaaggacgagtttgccgtcgccatgtatctggttcgcttaacgcgtagcggaaaggaggcgctgcctcagacattgcctcccgccttgatccctccgagcatgcgccgtcctggatcttcgcatttcggcccagcagctcctattcctgcccaggcgccagccccggttccagcgccagccccggttccagcaccacactcggcggctgacgatttgtttggcctagatgcgctttctgcgccggcaccggcaccggcaccgccggtagctccttcccaaatcccccagtcaaccgggggttcaaatgccgccttccagactcctggttcccccggctcgagagcatctccccaagctccctcaactaccttcaagccgtttgtgccaacttcaacctttggacagagcctgcagccacagatgactggcgcttcagctggtgctccgccacccgttcgatcacccccgcccccggcggatgatcttttgggagacaacgaccccgaagagtcaaacaaactgacccaggaaactaccgagcttgccaacctgtccaatcagatcggttcgttggctactgagatgcagaacgttcaaacgaagcgaacctctgccgagcaggatctgtcgcagacctcgcagcagaagagagactttgaggctcgtctcgctcaggctcgcgctatgtacgagcaagaagtgaaaaacttcaaggctttggaggaacgactcaagacctcgcgggcagagactggcaagttgcagcaggaatatgcgttgattgagggaagccgtcaagatttacaaaaccagtacaaccaggtatcagctgcactcagtgctgatcagcaggagaacgtaagcctgaaggagaagattcgtcaagccaacgctgcggttgctcagctcaagcctgccctcgacaaggctcgctcagaggcccggcaacagaaaggtctggtcgcgatcaacaagaagcagttggcaactgtggagggagagcgcgacaagatccagctcgagatcgattctctgtccaaggagcaacctgaagcatcggaggagagtgctgtcggtccaagtgatgctgcccctgttatgagcccagccgagtcgacgacgagtcaaaacaccaacccgttcttcaagcgtacggctactggatcgagcgagggcaatgcactatccccgcagatctctggcgatcagcagcgtgcctttgatagcctgtttggttccgccttcacgtcaccaccgacgaccgctacaccaccgcctccagtgtctttccgagctgaatctcagccaacgtctggggtgcccactccgtcagtgtctccgcctccattcactcctggtcctgggttagagcctccggccccggctcagtctaggcaattgacaccgggtgtgttgcctcttggagagacccattcggcgacctcttcaacgaaggtttcgccgccaggcagcagatttggtggtcaagacacggccagtctaggaactgcctcgcaggcagcaactagtgaagtggcaggcccttcgtctccacagcccgccacctctccgtttgatgaaaccgtggaatcaaaggagcgattccctgagattccatccatcgccgcgagtgaacaacctgcagttggcgccgtatcgccttctggagaggacaagcctgcagagcgcaaggatctcagctttgatgaactgttcggcgggccagcacatcagcgctccaagtcacagaaagagaatgactttgaagaagcctttgctgccatgaagagtgggcctggagtaagcaaaacgaacggagccccggccgctcctgagtcagaatttcctcccattcgcgaacttgacgatggtgatgagagctccgacagcgaagcacccatgggcttcgaggataacttcacccccgccttccctccgcagactcaaatcgccgcagcaccccaccccgattctatcgagccatcccaactggcagcgttccccactcctggcaatgcggccactgcaagccagccccctgcggcggaatcgcagccaagccccccaaagtatgaggactccgttgaaaaacaggagccgggagacttgccacgcgagtacaacggactcttgccgaaccgtgaagacccaaccactgcccccgatgctccacactcagtagagtcaagcacaggggcaccgatcgtgggtggtgaagcccaacgtgacggtacaagggaacccgaagctgctcccgaaggggccaaggctggcgcgcctgactttgaggctgctttcgccggcctcaacctcgcgccagcaaaggaggccgaagatgaagacgatgactttgaagcgcccgataacgccagagccaacgtggacttcgatttctcgttcgacaacccgtcagcacaaaagacgtctccccatccaggtgcggatgtcgcatcctcggaatttttcaactttgataagaacgtatcttcctcgcctcccggctctgctgcatcgcctgccgagcccagcgcgaaacctcagactcacgactgggaagcactttttgctcctcttgacaacgccagtgctgctgctggcggggcaaacggaacgggcaatgcagaagccagcaaggaacccggctgggctctccagacaggcaccgaagacgaccaaatcctccagcggctgacaggcatgggatttcccagagaggaatccctctcagctttggagaaattcgactacaaccttgacaaggtatgttttcaaaccgtcaataggggaatcccccgtgctaaccgctttccataggccgtagaccatttgacttccaagtcttgatttgcatccataacctcttattttattttctgatcagtgcacatatttttcttctatgagcccttcactcgctccaaatgtttccttcctccttaattcctcccacctaacgtcgcccccttctttactttccttttctttaactcatacgtgatccagcttgcatgttgttattgctgcaatgtatatcccttttctttcagcggtgtgcgccttacccacatcacagtcaactacattatgacctacacttatcatcatcgccccgtgtaatttaggaacacaaatattggattagttatgaaacaagaaacgaagtgcagaaggacaacggacccataaaggaaacaacgaccaagatcaagggacagcggccacgggcatttactatttctgtatactgtaccttttgatctgttcttcgcaccttgttctgtatttattgatcgcatagctcattttcggcgaagtaatccctaatacactatcgtcattgctgaaaacacaacaatcatctacttgacaatcgatccagagcaacatatagtagtaaaatatctgaaacaggccgtctgatctccagggattttaagtttggtccgagctttcttgcccaggtgtgggtgtgggtctgacactttgacaaaatgggcataccaatgtagatgtgatgcgggttatagagagtatgcaagaaacttacatataacatttaatcaagattgatggccggttgtgaagatgacatgtcatacaatggattggtagtctttacaagcagaatgcagcggaacagacaactatactctcctagtcaaaggaaacctatggaacgcctgagagcctacacttaatcaccgatatccattgttcacggtcttctagctctgcttacaatcatgataggaaaaagtttggcagacaggagatccaaggaaacgtataggtaactccgagcaataatagagatgttagtaagaactagacctctaataagcgcagcgatccacaatttgaacggcctggaggatatacatgacctcggaccacgaaatgagcccaaagaacgaaaaggagttgaacagaccgaacagacccatttcaaacagcgctagacgccacgggtgacttgcccactctccatacttttcagcgagcttgtcacatgctgcgaagatacacgttgcatcataaccactgtgtattgtattgagtcagtccttgtatctggtcacataagtgaggagcaattcttactaaaatcttcgatagaacgttgcttagcggttctcacaggactcttgccatgcataatattgtcgaagctcttggacccctgcagcagataatacaggccacccattatgcagaataccccaaaggagaaaacgtagatgcggagaattgtaggccacgaggttggtccaccagcaaaccagccaaataagcagaagcaggtcgccacgagatccacagctgcaatagctcctactagcttccaggatggccgttttgaagcccagaaagccccatctgatcgcgttatgaagatgagccagttctctgtcagcgaaatttcgaggaacaagacctcatctcgcttcccatagtcttgcattatgccaccattctccccagcagtcagaattgtagtaagtgtgatccatgtgcctacggcgagtacaataccgagaaggatagacatcccccaaagttttgggaggttccatttcacaggagacttggaaaatggagcagtgtcataggcgatggccagagtcgcaatatcggcaaagatggcgatgaataccacaagctgaaggttaaggctttcgtttctggtggctatccagaatcctagaaatatctccaagtgtagcgacagtgcaatcctatataccacgtaagcgtacatacggtggaagatctggcgcgaagtcttcaaagcatcgatgatcgcagacaagccaggggcaagaaacacaatgtcagccgctgagcgcgcagcatctgaggaaccttccactgcaattccagtatcggcttttttgagtgatggagcgtcgttgacgccgtcaccagtcatagcaaccaaatatccgcgctgttgtaaaatgtccaccacgttgtacttgtgctcagggaagacttctgcgaatccatcggcagcttcgacgaagtcgtaaacttcagaaccggacattgttcctcccccaccgagcccaaggcgctctgcattgtagacatttgtgcccaatccaagctgtcgtgaagtttcgcgagcaataccaacagcatctccagtcagcatttttatagacagccccagagtctgagcttccttgatagtctttgcagtatcatgccgtggaggatctgaacatggcattatgcccaggatctcccactcgccatcaccgcacttccgagccaccccaagcgagcggaacccacgtgttgcaaactccgccactttgttcttgtatgcctgttcaatatcctcctgtatctgatgatcctgctggactgttttcagtacaaataaaggggatcccttgacacacgtgattcgttgaccttgaggagactggactactgccgtgaccttcttggagactgggtcaaatggggagaactcgagcaccttgaattgcggaagcatcgttttggcgtctgggtactcgttcaaggccttgaagaatgctctgtcgatggcatccatacccttcttctttctggaagcagctaagcacgctgttagcataaggtcctcaggattgactccagccactgtgtaaggctctgtcaatgataatttattcttagtcaatgtgccggttttgtcagaacagagaatctcgactccagcgagggattcaatagcagatagcttctgcacaatcgctcttttctttgccagatacgctgcaccaacggccatcgtggttgtgacaacagctggtaagcctaccggaacacctatcatagtgatggccagggtgaattcgagaatggttgttgtattgtttgaacggtaaaatgacgatacccagacaacaatcaaggttatgacgacaaggacaaggaggacaatactgataccatggaggacttcggtgaagtggccggtgcctgttgacgcagcattgaccagcgcggcagcacgtcctacagatgtccaattgccagttgctgtaatgaggattcgggcgtagccgcgcttgacggtagatgatgcgtaacatacatctcctttgtgcttgtcaactgccagtgactcgcccgtcacagaagattgatcgacttgaataggcgaattggtcatcactcggccatccgcaggaactatggtgccctgtgggaatgatcagagactgtaggcagtaggagacgtggcaggattgttacctcgtcgactttcactatgtctccagggaccagttcagctgcatcaacatctgccatcttgccatcccgcaacacaacagccctaagcgccagtgatttcttcagctccttaacgatagacccagcctggaaatcctggacaaaccccacagatgcattgagcaaaaggaggccacagataacccctaggtctacccagtctcggaggtaagcagctaacacggctgccgcctaaaaacgtcaatattagcgaaaagaaaaacaataatgaggattcccatgtcggggtgcacttacctccataacaaactgcacgggtccaacaaagaacgacacgaatttcactacgaggttttctttctcctccttcatctcattggagccaaatttcttgcgacggagtatcgcctcactttcatcgaggcctgtcagaaaatctgtttgcagtaggttatctgagacggggcgaagtcgaccggcttgatggctctcctgtgtgtttagttccgcaccgccatccacggactccaactccccgatgagagtatcgatatcctcttcttcttcaccctcaccatcatggatgtcggaaggtgtcttcgcctctctcgatatcttctcaacatactcatgctcggtatccatgtccttggggtaaggcaaggagatcgcagtcataaaggggacacttggatgctataacgaggagctcagcaatcacacatgagcgacaagggtctaaaggatagacgcggaagatgttaacctataaacgtgtaagatataacatcctttaattgaaagtggaaagaaaatgccagtactagaatcgaatgactcggtaggcatacaacggaagggacgccgacaagagcaatgctataattgattcctttgggaaaggcaagtcatcattggtagtagtacaggaaggaactaccaatatacgaccggcgttattgtatctggcgacaagcgatttgaaatacgcattcaactactcgagcgcttcagttcaaagagaaataacagtgacatcagcttgcaaacctgatagtagtgctactagtactagaactgcctgttccatttcggttgtcaagtagttgtagtgtagtatatagtatagtaagaggagtaagcgatgctgggggtatcattgttgatttgacaataagaagcccaatatgcatggtgacaataaatccagtgattcaaagttcaagtaatatatctaatctcggtcgaaagcaatgtagaatagtgaagagtagaactgtatgaggatgaatgtatacaaagaggagagacaggatggaccaatgaggaccagtagattacataatcaaacacccgacgtcatgtcggtttcatttgatggctctcgcgatggagaactttacgtttgcagagtcttactgatcaacgcggtccctgatccttagttaaccagactgctcgctagctgtgaataggtcgacttgtgactgttgtgggtgaggaaggtgagagctgtgctgtttctagtgcgttgcgcatgatgagcaggatcacggtcaagtgatctgcaccgacgccgacgacttcgaaactagaatgcgtcaaccctgagacgtgcccctcagcatctaaagatacgcgccctcttgctcttttctgatcccttctacatcagaaaaaatgaatagggaaattccagggttctactatggtaaatgacgtggttctgtcttcatccggggcaacgatgattgaccgctcaatagaccccgaaaagaaaaagtacttcaagatccaggccaatcacaaggctaccccaggatcgcaatatacccaagactctgttaaacggaagcgcgtagatcaagaggtaggtggtcatgccttccagttctcttcgatcatactgactctttaaatagaagcaccaaaggaagatccatctgacgaaaagggccacgaaagagaaaatcaaaagggcggcttttctgtcaaaccctctactgggagtgcagagggagatcgggtctgaagttgtatcttccagcatccgacaagaacagagaagcttgatttgcgcaagccagcttcgtcgaaaccaacttcaccaattcgagccctggcctgatgagtataccatcaagcatgtgctgcgcaacaagcgctcaggcatcttgatagccagtaagctttcccctacatctagaccattccattgatgcaatctaacaatcctgaaggtggccatcgtggtggtgaatcgtctgtttcgtaagctcaaccttccgtcctgcgcggtcgtgtatccggcaagctaaccgccgaccaagggtatgcttcccggattgcgaccaagataaatggacatataaccgcacgatggagcgtgttctcttcaaagaaccctacagagtatatctaccagcttcagtccccttcaaaaacatccacactaactagcttccccacagctatcctcagtctcactaagccacactggctacctattgtacgaatcaaagacaccatcctccccatcctgtgattgctagctagctgacaggatcagggcgacgatggatagtggtccgaacggcgactccttcctggcaccgcgaatgctgcccgatcctgacgaaggtggagattaccggtggcccacgtcgtgtacgtacctacatagcaagcccgcactctcagtcgttacacacttaccacaacgatcaagcttgctaacccccgaccctactactatgcagtttaccatcccatccgtctccgcacatcatcatccctatggtgttcatccgcctgcccaaccggcgagatgccgcttttcgccgtcggaacctcagacggactatacacactcgagggattcggcagctactgggcattatcgaagaagtccttcccgaacgatatactaacagggaaaccaatcctacatcgccgggtagactcttcccatgctatcgtctcaagtgtcgaatggctctcatccgacgtaatagccgctggtctcaaagactcggctatattcctccacgacttgcgcagcggaggcagcgcaacccgacttcaacacccccacgcagtcactaagatgcgaagagtagatccctaccggatcgtcgtggcgggtataaactcggtacgtgttatgcccttcccactcacacaccggcatatagcccgacgaggatcgtatctgacagaaatattcgttcaaactataacagctccaaatgtacgacatcagatacccggccaacggcctccaacgcaatccacaacccaacaaaaaacatcacacgtcaactaaaccatatcttacatttgcggactattcgccagaaggaataccggatttcgacatcagcttggaacttggcctcctcgctagtggtgtgtatcccctctcctacttgacactctctagctattctactttgcagagtcggtaatgacaagagttaattaacccttcatgctagcatccgacgagcgaaagatccaactcttctctctccgaaccggcgcacaggtcccgtcaccattatcaggttatcaatacgcgaaccccatttcctcagtctgtttcgaacccggggacggatccctgcatggacctcaaacacctagcttattagtctgcgcgcaagctacggtggatgaatggatctggtcgaacacgccaaagacgaaatgaacatgattcatgtgataagaagagaaaaggagaaaaaaataaaaatgctctattcgatgcaacgctcattgggaatataactagaaatacatgagtgttaagaatggatgaatgagcatgaaaaaaaccagattgattccagattgcatgcgtcacgattatatcccatccattgagggggttaatccaaccctcccgccaaccattcgccaacctcgacgcctactgtcttggccaactctccgatccagtcgcccgagacattgacgcaccatttctcaccagcatccgaggtcgtgttaccgctacttaaccctccggacccgagccccatgcgaccgccgctctcgcgacctgccgctggcaccacgagtcgtaaccgacgtaatgtagcaagctcggcgtatatcgcatcggaaaccgccgccaatcggatggggtttgctgggggattggggtcaatggcgtggtagatagcgatcagtcgctcgagcgggaaaggacgggctgttaggatcgttgacggaccggtgataccggcgttgctgcccacagccgaagtagtggcagaggaagtagcaaaggcagactccagagtggatttcgtgatgcgagtcttctctcttttgcctttcttgctaggggttgacgggcctcggctcgcctcccgactatcctccgcctgggctcgggaaagcaccttcaaccgtcgccgatgatgtgcgcgtttattccgagcagataaggaagaggaagagaatttcgagaagaagatggtatcgagccgttggggtgtatgtgatgcaaggtatgcggaggtcaagatcaaggtcgggaagtaaggtaaagaaggaaggggtgaaggggccgagacggccgacattgacggcttcgatagggagccatttgcgggagctgattcttcggtgacaatgtgatgtacaagagcgccttcgccttgatggcggaataaagcacggtttttgaccagaagtcgcgagaagtcccattcattgcttcccccaggcgggatatcgccgttggtgatgggagcaacgaactgaggccatatcttctcgcatatcgatctgaacgtaggaatagaactcgccgtaggcccaaccagagagtcatatatagcggacacaaaatgcgggtataatctcgaagctgtctcgtcatccagaccactcacagcaggcggtccagcgttcaagataatcgtgacggcctctttgcgcgtatacggagggaagctaatatgcggaacgcccgcagcttgaagaaacagcggccgcggactggagctgaggataaggacgacacatagggatggaatctgcgcagtaaacaatcaacccattagcaagggctctcaccaagaaaacgaacggggcaaaaacataccacttctcccagcctcgccagcgcagacaacagagtatgcggtgcttcacgctgcttatctatcccatccaaaaccagcacgaacttgcccttgtcattactgctgccgtccgataatgaggcaagacattcgcccagcagcacagccagggagctaacatgctcgcaccttcccttgccgtatttctcccattcgtcgcgtttcccaagcgcttcaagcgttgcccagaggatcttcgttaggagatgacggccggtgatgcattccggactccggacaatagcatgtgggacttcgagggcagcgaggacattgcggacgatagtcgttttgcaagttgcggatattccgtgtacaactaatgtggatgggctggaaattctaggctagtcggtcgcgtttatatgttaattatttattcggggttattgaaaggaattcggaggatctgggggagaaaacatacgccgagaagactggcaagctgtctggtctggagctctcgacaaggccattgcttactgagcgatcggctgatgtctgatggaagcatagatgtgaatggtaagacacttgaagatctatagcttccgtgaatattccgaaaaagtcggagaggcgtagaaaaggataatggtaaacgcaacttttgaggtttcggctttcgcagcgatcaatgaagagaaacgcgggtaacggtcatacgcggtcacgtgcttcatacatactctggcagttcttgcgaacacatctcgaactgcgaatgcgaagaagtatcgatcttgcaatatcttaagacatacggaaagagcaatgactcactaaataacatcttgattgcctaaaatatgggtacatctaatctaccggtactgctgatggaacaggcgggaaagaatgtaaagcatcagacaccgcaaagctaatcatcccaacgtgcaaccaacgaagtgcaagtttgcgcaagcggggcccataattgatagcacaggggtagacataggcatgattcgcagtctgttccaagtttaccatccattgcttcatccagaaaatcaagaacagccgcaccaagcgagccatgcagacaggtagagccttctcatgatgcaagtgtcaagatagcaggatttggtagatagaaacaaaaaagacacaaaaagggagggggctagaagcacaattgggaagcgaggacaaatatgaaacagcagtctttgctccttatcagaccggtagcatgatcgatggagatggacttgtgcgcaagtaaaaaagaagacatgtagaataagaagtaaagacattcaaaaggtatggtcgttaaatgggtgctaaacgaagctccagggcattgaaagaatacaggacatcaaatgaagtgcagtaaatggctttatcatcgtttacatcttctcatcagatatgatccagatatgcaaaaaggttgcatagtaatatgatctcgtcttcgtatcgggaattctggtcttttcaatttgatgacaaattttcatcggggccgtgagtcatgaagatcgtagcgtcgtcgcactatgagtacaattcaatgaagaaggacgggtgaaccaaagcgctgcgtaatgaatcagaagtacgcatacagctgactttgagcaccaagattgccgttggcttgcggcacagctgaagcaaatatagcctcgctaggtccgccagacggagcgttggaacctgtcgcagagccagcggtgggaacaaagttctgatttccaaactgggaaccgactgggaaagggctgtgttgatacatgaaggacttctgtggtccctgaagaggacccggaagctgggcggagttcatttcgttaggcgtcacttgtccgctagttgcggcacttccccttcctgagccttcggatgccatcatcttaccagcaatacgacggccatggggggtttgacggatagaaggcaatataggacggatgcaatcgacaatccgcgctcgagtttcagcatcggcaaagtccatggctgtttgcaccacatagttcgcaaatgagtcgcggagcatcttctcaagttcggctcctgccagcatttcatcgatcatctgacgccggatttggaagtccgcagtacgaaggcacttctcgatgacattcgagctaaacttctgcttggatagagcgggtatgttgcctcggaaattctgacataagggctcagtgaaatgaggctcagcaagatccaaaatatattgcacaacgtagtttccgaaaggatcttgaacaagagcaaatgcattcgcagtgatttgagcaatgaggcgcgctttctgatcaccagacgcatggtcaatgcatcgttgcagaacacaacatccatggcgatgagtgccgacgaccacgcagttggcgccaacagcatcgtaaatgaattgagcgtcctcagcagagagacggttgagacacttttggatcacatggtttccgttgagatcctgaaccaattcaacaacatggtcctctagcgaatggatgaccgtttgggtttgttcggcggtagaaataaactcgatcatcttttggagcgccctggtaccgtgctgattaagagcaatcttaacgagctgatgagcagcgttgttgatcaggtcagtccgctgttcatcgttggaatattcgagcaatttctggcacaggtaattgccgaacggatctatatatggtgttagtgaaagctcttacgacatggggtcgagaatgctcaacaaacctgtcatgagttcaaccacatgaaggcgcgtttcctcgaagatcatttgtacatgctccgggttacgctcttccaattttctctgcaggtacctgcaaccgtgttggtccttacaaaggccatacaactcgcctttataatgctcaagcgggaaatttgtgaagcgagagagctgagcgctatcgttatcaccgcttcgtcgggaggtaacgcttttggccgagccttcaggcatgcgataagtgccatagggagcgtacccagcaaagggagctgcggcattgtagttttgcagctgaccgctgacctgcactggagcgcccatgtaggcttggataccatacccatagaagggtgcctggaatggggtcaaggtagttggtgcgaccgtgctgttgctattggcaggaccggtagtgattggtgggccgaaaggtgtggcactagcttgcagagtagtctgctgggcccgggttccctgcaatttcgcttcatcgcgttcaggcgagtccctttgttggcgggagttcacagggttcacagctggaatccgacccaggttggcattgtgttgaatctgttcggcatgcgtcttaggaggagtgacagcgggattgaaaggctcgcctttgactgtaggaagatcgttggtcgagtatgaggactgcagggatgcaggtctgctggaagcagtagctgtcaggttttcagaatgttcctcggcgctgtagagcaggttcgcctccagcgaatgtctagcagcatgacgagcagattttgaagaatgcgcatgattctcgtcagtttgattaccaagctgacggaacatgttcagggcgttttgtggcatgctctgatgagtagtgcggtgccgactgtgagtgttccaagtctcggggttgggagtacgtgaattggcaaggtccagggcgtccgaattcgcagacagcttggtctcatcgtcagcaaaatgtgattttcgcctgtattgtctgaacttaccaggcctgagtcgtctctgcgagacagagtcgggaacttgtcgtccgtatcagtcaatttaaggatacttttgaagtcgggtgtcgggatcctgtcctcgtccttcaaagtcgcccggtcgtcttcgttatgaaacagatatttggaagcattaaacgactccaacccagacgaactgttgaagcccgataaggtcggacgaatctgtgatcctatgccagtagaaggcattgagtagcgatgaatactgaagatgttgttagtgagggttgactgagcagatgatgaagtggggaatagtagcaagggttgggagggggtaacttttcaattcaagtagtgttcggtttgaagaagtgagggtagtttgagatgtgaagggaacgggagatgaggaatcttggagggagagaggggctgcggccctatttatgcactttcaacaggagcgagtgttgcagcacgccggaccaggacaaagaggtcgatgaataggagatcaaaggagagtgcagggagaacaataagataacctgttacttacgatgggcctggacggaaaggtgaagtaggttcttgagtgaagtcctccttctctgagttccttcgagagccaggaacagagtgaacggagaaacgattggttggtgtttgagcagagttgtgattcacctggctcggcggagtagtgacttgagcaggtgcaaagacattgaagaagccaggagaggaagtaacacttgaagttgagaaccgagtagggcgtgtgaaagcgggatagctattctcacggtactctgggggtgtcgtaggttcgctgacagggccagacatgccaaccttggccaggttctcggcaatccgctccaaatcttgcttttctttctcatgttgcatgtctaaaagcttcatatcttcctcaaacctcctcctttgttcccgcatgtattcaatgtgctggcgcttcttctcaaactgtgatggtgttagaggcggtttcaatacaatagcaggtcatcaataagcaagtggacgcatgcctgagtatccacaaacggaagtgggtcatgatgcagcccttcttccagtggatactccagagacatacaaagcaacaaagataagtgtggagcgccaaagcaaatggtacccaggtagcagaagactactgaagagcccagtgctaacgaagtcaagacatcatgtatagtacaggccgcatttcaagccagttgggtatgtgcatcggggactttcgtgacgtggctaagcttaccgatgaaagcagatccaggtgatctggagccgggagctgagagctgctcccgagatggttcagatgactccaggaagcgagcttgctggaatctgttgtaaagcggcgctgaagattccctcgaacatcgcccgagggtcgcgagaaagccgagacgaaattggagtggcccggggagagcgaattatagccagggaaaggggactccgagggaggcgaccttggggaagggaatcgcagctcgtcgaggcgttcactaagtccgttcttgaatgccatggtgggcagattgttcgggacggagagcacactggactgatatcatcagcgagccataacgagtcagcagtcagcttatatcagaatagggtggacggagcgaggcttaaaaaggaagagatgagacgatcgtcatcctttggggcgattgcaagcaaagcaaagggccgaggatagagcacaggaaccaaggagtcgggaaggatgagttggttggcggtgtgctgctgctccagataacgggcaatgtacggagtaaggggagttaagaggggctgaggggtgatttggcggagaagatctcggaaaagaacagcgacttacacgcaatgaacgcctcgagagtttaaattctcaggaacaagaaagaaagagaaaaaaaaagactttttgctgcccacgatatttgtgtgcaccaaagtaaagaccttttgatggggggagttaagagccgtcctcccgcctagcaatgcgttcctgacggtgcggagatcaatgatggtggttgaatcacagggcgctggttgtcggtattgcttgcccctacgctttctcgggatcgagagcagcgtggaccagcaaggagaataacgagcgaacgaacactaaggagatgggagggggagagaaataacaatggagaaggaaagataatttgttgtacagggagctttggagttccaagagggagagggaggaagaagggggaggggagggagggggagaagaaggcgacaagaagagtgggaagcgagaggggaagaaagacgaggcgtgagcggctgggaaagcaagcggggagcctgttaagttgtttagttgctaaactcgactcgtttgggaagcggagcgtgaaagctgctgggaggatgggcgcgatactagtctatctgcccccttcccgacaactttcctgggactcagtagcttcccggtcgtctctaactaccctgtcattccatttattaagtgcatgggcgagaacgtagtcccctgggactacccgtggtcatggcaaaatcgatctcagtagttacggagtcctgtgtctcttactctttgttccgctgtgtagattgcatcatctcttgttctctctcgtttcccgaccgtaatcttctagtaattctacaacatttggctctatttcccttttctcaagccccgaaaacatgaagatctccgggggagaaaaaaacaaaatgtaaaccactacctttgtacgtaccaagaccgagcgcgtttaattctgccaggcgtgcgtgatgaaatacgaagctggtaaaattaaaaaaaaagaaaagaaagacaaagagcccattcatcacccgttacgattgttattaatcaaatcccacccctcccgaagctggtgagctgtcttcctctgatgacaaccaactctctggtcgatcatttgcttttcggacggatcaagaatgaatcgtgacctccggccccgtgattggagcttagatctctgacttaaaatgctactgcacgacttgttgcgttgggaccagtagtagcccctgggtaggtacagttattccacccgggaattgggtttgcagcatctcaaagaacatggattctttgtccggctctctctacctctcttgctctctcctcttcatgagctggaatatggattattgacgtcccttcgaacatagcaggagttatcccgatcgcagatcagcatcaacataactgatgatttaatgatgtcctccctgctggacagcggcgcaaggagcatcccctgttgggtgtgctggtcgagagcgtggcctctgcaagtgtttctgcatcgggtggggacaccgagttgattaggacgaaagatgtgacggcggatcacgccctagccaccgcacgtacctgggccagagcataccctaaaagacgaagttgggctcacagatcatctacctactttgtctgcttcatcaactccggactactcatgggcgagtaagatttccggggctaatagcggctgcggtgcaagtcatagtttcaacactattattattatgattatttcatttccttacatctgttttcgtctttttcagttgctcatccttttcctttttttggctcctacagaaaccatgcccccaaatggaaggatccttccttcggcgattagataaatgtcttgtgttttaggtcttactggcgcatggatctgcgacattattaatgatcgaaggctaaccgaatgtactttgtatgtatgttactatgattacggggctgctcacctctttgagggtagtaccagaaagtcaatattttcggattgccacgcgcgtcccagaacgtacgtgacggacattgtttggtaggttagggaggccggtaacctcctttaccatccttggcccgatccctgaggaaacgctgcgaattttctactggcgcctttcatggtgggctatttggtgtgaaccagggttcatcgccggataacctaacaatgaatcccaagcattgagagtgcggtcagccagatttccatgggtccgtcaaatcaacgtaatctccgcccaggtgatctcgaccgattcaacgttaggtgtgtgtcagtgtaataaaacctggcggcaaatcgccgtggttttaaatacccatagacaatagtaaatggggggacgtgactgtctcatcgcacggacaatggccaatcgatcccgatgcgtgaatccctccatgtcaagtcgaacggccctgggatgactgacagctgctgattggtgcggcagggtagaagcggtgtacaaccatccagggaacaccaggcgatgctgatccatccgtcttcgataggagaaagctgtctccttgaacggccttttctggtcggttgccgtgattttctacaagactctccatttcggggcctgaaccaactggaattgtcctcacgctgggcagaacccagccttagggccatttgtggggtattctaaatgcttcgcgaaccgtagtacagagtataagacaggtcgatgatggggccgttacggcataggaacatggtaaagccccggcggtggggtcaaaatattaggattggaaaatttgcgaagtgaatactcggcatgactttgctctgccgagattcgttcaaatggaataggatgataacagtccttgctggtgatgacgatcctaaattgtttaggtatcgacctaactagtcgcttgttgggtacatcgcatgagtcatctttcagacaacttcggaagctaagaacaacggacctatctgaggtcggcagatgggagatgagcccattagtacccacaagatccagggacggattccgatttcatgctagccactgttgaaccacttaccaaccactttgaacacactgaatgtacccctccttctgagtaatgacagttccagtgtcgatgaatctgtctgttcgagggcatgagagaaagcaaggcacaccttgatggaactttgaatggtaataacgtttagtacttctctagccttgaactgacgaactaagtctccgcgctactgagtagttggtctgacggtcatgttaagcgtgatgtgtttcagattggttcgccaccgccggcgcagggatgttcgcgtacggtaagtaatctggcaaaggttgacagattaagtgggaagatttagaaaagcagggaactttgtatacaattcctttgatttagcatatcctttccttgccagtaattcaagtctgcagttaacctggtgatcaagagataacaactgctactctgcatgccaccacgatatcctcaaggaagtaatagataatcaatccatccatttccgtttactgactgtgagataacgtaattttacccccccgccagatagaatcgcctcataattattccatccaatacactgcacaaagtactgtacctacaggataatacttaccaccaagcagtgttaatggcccccatgtccgatggctgcaggaataggtccgagggtcatgaaacaacgagcctgcgcttcttgctgggagctactgcactcatggcccatgtattctggaactggcttgcgcgtgactgcccatatctttagtacttgacaccacttacccttgaacgtcattgggcatgtatacgccatgaattgataagaccttcgtactcacgtgatgttgctcaatgaatggttcgacatggtacttttacttctgatggtggatccatcaattgggaggcgtttcgccgctccgcatttctgttttggctatgttgtttcccactaatctctgtgcctggaaatcgtcgaatggaaatctttccgatggggaacttcgactgccaagtggcaatgtcttctaaaattgcggtcaagagcaagtccaccgcctcaaacatactttgtacacagcagtgccttctcaagagtcatctccccacatgctccgcagaggactgaattgatctgtcgccgacttctacccactcctcaatattatgagccataccatttgcctgaaatatgcagtctgcatccaagaaaccagtaacagctgcactccatacacctactccaacagactgggtaccggatacctccagctccggaatgggtgaaggcacttatttcctgaagactggacgtgttgttgcccaaccccgcaaactacggaggttagccgactttgcagccagatgtgcagccctgctttctaaaagagaacagtggcttccaatgagtatagccaaatttttggccctcaagtgctcagcaattctatctctatggtcttcgtgaagtatccaatcaggccttcacattatagcagcacctctaatggcaattgcggatgcagttttctgactgtatggccgctgattggggcgtcatctgctggcacctgactgtcagccaactcgacatgaggtctttagctactgcaggcatctggcatagctggtagtctgttaccatacgacagaagaagctagaatcgaatggggattatgctaatgcaccacatgaatggtatcccttgcgggaatttcggatttcccgcggcttttttggttggtgttgtatcaagaccagtccatggaggtcacgtattcacctgacgtgcttccacagttggggcatggcgattccctgcagacactgacttgagttgtacaggagcacagacgtgttgacctgcgaggcttttccatgtacagacatcctcgactatctgtggagacagtatccttgctaaaggcggttgatacagatactactctaggacatacctgataagctaacgaggccttgtcagcctttttctcgagtgtatcaagaggtatgagacaccaatcgtcaaatatggatttggcattcacgcatacatcacctgattctgcaggtgtatctggcaagctatccacttttcaggcatcaacgacgctcggatatgcggtaacctacttcgtacgtgagtttcctcaattgtatacatcaaggtgattgcacgagctcagcggataatatatatcaactgggttgtaaatcacgggttatgcggctttacattgcccgagctagaacggtgactgctaacaaggcgctttagttaaactgcccgacttgacggcaaacgcgctcttcccacgtattttgcatctacccatcttaactgtaacctgaatagtctgaggtatcttgaaagtcccacctcaatgtctctcttattatatgatgggtgagtgatggtcaatgaagccgtctataccataacttgacaataccatcaaccggcctgaccagcacacacgttttgacattgccgtcaaattcaaaatgatacagccaaaagcagtagttaatttttactgaggaaatgcggggatcattgtacagtctattttcaaacttcctccgcgtccgcataacgaaactgttgtggcaattgctcaagaacacaccagataacatgcggtagctgctgcgacttccggtgaacaatggtttctcagatgcatgcttatctttccattaactatttgggttctaatgtggcagacgggcatgcatcgatctaatcatactttaaactcagacatatccatcgcctacaataaggcatcgggcagaatggaactcgaatgatgagccacatgatgccctcgggcacaccaacatgttatactagtatattgcggttgcggagaagcagaaggagagaccattctcaatggtcttctcgaagaatgcccgcccaaattgatagcttactctgcagagggcctgagaacataccgtgcgcatcagaagaagtcactcaatcaaaagtgtgatcgaataatgtaagtcgaggaagataatcagacttgctacatattttccttccgcgtgccatgagatcctcattcttaagaccgggtaaccatgtgaatgggcaccatgcaggatgatagtagagtatcttggttcccaaggcagccaatccggtatggaattttgactcaattggtagctcgactagacagtatcatactggtgcggatgcgttctatgtgagtgactccggttgcgaacggaaaagcaaggacaataaacaaatccttcggtttgctgactggctacacatcacccaagagccgcgacatgatacatcatgcaggcttgatgataatttgaaagggcagcatattgcaaggcagaattgaaattacctgaggcattcgcctcaaaccccgcaagtgacagccgcttcgactgggagtcagcccaatctacaaaatctgcggtcacggtgctcgagcctctggatttcacgggctgtctgcagaaataaatggctacccttctgagaaatgcctctcgtgatcaaaaaataggtttcacctattcactcgagtcctgaatttcgtgaaagcctgatgtcattgttccgacaccgatagtctccagactgccctggaagaaagtctcccagaacctaccatcaagatcagagaacgatttcacttacagatgcggtagctcaatccttccaacacatcctagatgctgaccgctgcatatacatctgggattgtcagtagtagtatgtctctgcattagcaaagctgtctggctcttctgatggtgggcttgagtttctaccattagtagtatctatgtactattactactatcagacatgaaacaacttgattaacaagctttagcatggcccgaaacatactagtatcaattatagagtccgcgacatcaagtccgagttgccgtgatacatgaatactctgtcctttagctactagtactttagtcatgacatagtaactacagtaatatgtagaaaatgctgggccagggactatagtgcaaaggccatatgatgtatcagttctttaccacttcctccggcagtcgccccggggcggcacttgcactttacgcttgttccagtttgcttccaaattccctccacaatcttctattattgagagcttggttactactctacacctattctcaatattaatcgctcctggccgatgcgagggacttatgcagctagattggcatcttcaatgattgtgagtttctacggaacacaatcccgggtagtcgcttgtgcggggtacaacgaagacgaaaagtgacatttggtcgttggagctccagaacagccttgtaaggtgctacaggtacccgtgtcaaaacatctcgataacctgagcgcttggctatcgtctactagcaaactctcgaattcctgttatcacaacaaacgttgcaagcaacaatgccgagcaggacatgggaaggccaaatccggggcccagactggggtcgatggtggggcggcgtgggtctggcctgtggaaagggtctctctgactctctctgtctgtatcggttaattgtagttctttctagtcgaactccttcctcatgtccacctcgatgctcccttatcactttacttttcctcgttgtctgttggcttggaacctgttactattggccagcatcgtcttttatttgccaattgacctcgagaagcgaaacctaccactataccgcaatggtacgattacacaagcctccaaggtatgttctggccagtatactgtgctcatgcgggggactgctgtttgggtaaggattcattctctctcggcgagctaccttgtacaaccttgacagaagttctataggatggatactggaatcattggacccgtcacggttatggacagctttgtttcacgatttggcagccaatcatcaaccattcacggcttgatcgtctcatccatcctgattccagctgcattttcttccttctttgcggggtatctggcggacaaaatgggtaggcctaagagtatcagcatcggtgctcttatctttgcaattggggcagctttggaagcggctgctgtgcatattgggatgtttgttgtgggacgttgcatcgagggcataggtgagggcttatatctaggcaccctcgtcgtgtatgtggctaccccatgaattatggtacttttgttttctttgtttctgattgacgacagctacatctgcgagatctctccgccaagggttagaagagcgttgacaaccgggcccccgttgctaattactctggggttgacgatcggtttctttacatgctacggtacttctcgcatgaagtcttccttttcatggcgcacgcctttcatcatcttggcttgtctggctgctacattctccatggcttcactcctgtggttaactccatcaccgagatggttgaccctccatggccggagatcggaggctactgcagtttgggactaccttgatgtcagccaggcggaacgtgaaaagattgagtttgaacagactcagagcgttaatactgaggctgtcgcgagtgcttcgagcgacatacatgccccatccgtataccaacgccaggacagatcaatgaagcacaagtttttcgatctgttttcaaaagatgtacggacacgcaccgcaccggctgtgtttctaatgggcatgcagcagctcagtgggattgatggtgtgctctatgtgggttttcagttattcctattgtcgtctcctgctgacattggctttaagtatgccccactgctcttcgagcaagcaggactagcttattcagatgccagcttctttgcctcgggtgtttctgcaatagtcatcttcgccgtaaccattccggcgctcatatgggcggacaggtggggccgacgacacagcactatttatggtggcatcggcctcgccgtcacaatgttcttgatagggggtacgcagggaatgccgtatacaactcaactggtgcaggtcggtgggtggtcatcgtctgcatctatatttttgcagtcatatactctctcagctgggcagttggcatcaagatctacgcagcagagatacaaccacaaaggacccgcgcatcagccactagcctggcacatggcagcaattggaccgctaattttctggtcgcactaacgactcccatattactgtcaaaaagcagcagcttcggtgcatactttctctttggtggatgtactctgatcacggcgtgcatttgcgccctcttcatgcccgaaacaaaaggacgatccttggacgaaatcgaggaggccttcaagtccaaatctctatcaagaacactactaaaggcgttgcgacctattactcggacagcctaggaatacgtgaccagaatggggaagaagctgtatatgttcacatgtcatgcacatgcactagttagctgcacatgccaggaatgaaaccgtgcagcctgccatagccgataagataagaaatgcatacctgctagatccagttagcctgtgaatttgtaagctaaacagtagtctaaccgttttaggatagctgctcattacctaagcaattattctgccgaattggaatttagcccggatatttcccctcgctgataaagaagaaattgtgtccgtcaccccagaatgccgtgatatccccttacaccttgacacttggcacacggcagtattcagttcctcttgggggagatcatcacagcttgaatagcgatgccgccccgcagaagagcgccgatctctgcggcgaacctgcgatctgcgcaaccttcagaggcaagtaccaagtattttacgatctccggtagagaagggacccaggctaacggctcttgatgatatagggtgcagcatctgcaaagccaggcgccgcggatactacgaaacgtagacgtccctctcagaccgcacaacctccccgagccgaacagccgccaccacccagtgcggaggaacagcagcagaagtcgaccgaggagcacgagcattcgcattctacataccgccaccgcgacccatttgacgcgcttctggaacctttctactacaacaagtccctcacggatccgattaacactgcgaaagacaaatggaaccttctgccggctttcctcaaggtcaagggattggtgaagcagcacattgactcatacaactacctcgttgaggttcagttgaagaaaattgtcgagtctagctctacaattcgaagcgatgtcgaccataccttctacatcaagttcaccaacatttatcttgggttcccgcgccgtgccgacgagccgcaggatgcgcgggccgacttcacctactcgaccgtgtccccgcaagaatgtcgcctacgtgatacgacgtacgcggctcccattcaggtcgatttcgagtacgtccgtggtcgtcaaagggtcatgaggaagggcgttgccattggtagaatgccggttatgcttcggagttccaagtgtgtattggcgaataagacaccggcggagatgacggtgctgaacgagtgtcccttggatcctggtggttatttcatcgtgaacggaaccgagaaggttattcttgtccaggaacagttgagcaagaacagaattatcgttgaaaccgaccccaagaaggagattgttcaggcgtcggttacaaggtgagaggtcttcgcgattgactgttgagggttgccattctaatatttgtttgcagttcttccaacgagcgaaagtcgaagagttacattgtcctcaagaaggacaagctctacgtgaagcacaacgtactcagcgaggatattcccatcgtcattcttttgaaggcgatgggcatccacacggataaggagatgcttctgctggtcgcgggtgtcgacaaggtttatcaggaagactttgctatcaacttcgaggaggcgatcaagttgggtatctacacgcaacaacaggctctggattggataggtgcacggattaagatcaaccgcaagcagtcgccttcttatcgccgtacccacgttcaggaagccgtcgaggccattgcctctgtcatcatctcccacattgaagtgaagaacatgaacttccggcccaaggctgtctatgttgcgcacatggcgcgtcgtgtgcttatggccaagaacgatgccagcctggttgatgaccgtgattatctcggaaacaagcgtctggaattggctggtcagctgctggctttgctctttgaagatttgttcaagaagttctgcttcgacatcaagatgaacattgacaaggtcttgaacaagcgcaaccgtgcggaagccttcgatgcttacagtgtcatcactatgcatagcaaccacatcacccagggtatgaaccgtgctatctcgacgggtaactggagcttgaaacgtttccgcatggaacgtgctggtgtgacccacgtgctcagtcgactgagttatattgcggctctgggtatgatgacgcgtattagcagtcagttcgaaaagacgagaaaggtctcgggtcctcgtgcattgcagccttcgcagtttggtatgctctgtccagccgatactccagaaggtgaggcctgtggtctcgtcaagaacttggcactcatgacgcacattacaaccaatgacgaagagggcccggtcagaaacttgattttcatgctcggtgccgaagatattcagactgtgggtggtaaggagctatacggacctggctgctacacgatttccatcaacggaacacccaccgcactcacacgtcgtccgaaatacttccttgacgcgttccgcagactgcgtcgaatgggtcgcatttctgagttcgtcagtatctacatcaaccaccaccagagggccgtccatgtcgcgaccgatgatggacgtatctgtagaccgcttatcgtcgtcgaaaacggcaagtctcgtgttaatgcccagcacctcgagaagctgcgtaatggcacaatgcagttcgacgacttccttgctcaaggtctggtcgagtatcttgatgtcaacgaagagaacgactctttgatttccatctacgagaaagatatcacagaaaccaccacccatctggaaatcgagccctttacggtcctcggtgcagtcgccggtcttattccctatcctcaccacaaccagtccccccgtaacacctaccaatgtgctatgggtaaacaagctattggcgcgatcgcctccaaccaatttctgcgtattgactcgattctgtacctcatggtctacccgcaaaagcccatggtcaagtctcgcaccatcgagctgaccaaatacgatcagcttcctgccggacagaacgccatcgtcgccgtcatgagttactctggttacgatattgaggatgccctggtcctgaacaagggttcagtcgaccgcggcttcggacgctgccaggtgttccggaaatacgtcaccaacctgaagagttactccaacggcaccaaggaccggctgagcggacctacctacgagaacgacgctccaatccgcaagcacgctctcctcgagagtgacggtctcgccgcagtcggcgagcaagtcaacgccggcgaagtctacatcaacaagtccactcccgaccagtccatgtcatcaggcttccccaactccgacgccggccgacccgtctcatacatgccaacccctatgacctacaagctcccagaccccgcctacatcgacaaagtgatggtctcggtcaccgagaacgagaaccagctcgtcaaagtcctcacccgccagacccgccgcccggaagtcggcgataagttctcctcgcgtcacggacagaagggtgtggtaggtatcatcgccgaccaagctgacatgcccttcaccgacaccggcatcaaccctgacatcatcatgaacccccacggtttcccctctcgaatgacagtcggcaagatgctggaactcgtcgccggcaaagccggcgttctagccggccaacacggctacggtacctgcttcggcggcagtcccgtccaggaaatgtcccagatcctaatcgacaacggcttcagctacggtggcaaggactacctcacctcgggtatcacgggcgaagccctacccttctacgtcttcacgggtcccatctactaccagaaactgaagcacatggtccaagacaagatgcactcgcgtgctcgtggtccccgcgctattcttacccgtcagcctacggaaggtcgttcccgtgacggtggtctgcgtctgggtgagatggaacgtgattgtttgattgcgtatggtactagtcagcttctactggaacggttgatgatctcgtctgatcgtcatgagatcgatgtctgcgagcagtgcggattcatgggatacttgaactggtgtcagcggtgcaagtcgtcccgcagcgtggtcaagatggctatcccgtatgcagcgaagctgctcattcaggagctgatgagtatgaatgtcaccgcgaggttgaagcttgatgacgagttcccggagatgaaggggcggtagtctgtcctccttatacggtctcgctgtatccacaatgatgataggatgggatatatggatcaagaagaaatgaacaaatacgcaagaaatacaacagctgatgagtggaaaaagaaaaaagttgggcgtttcattttggttcatcggagtgtacataaaagccggttctggatgtgtctttttctttttcttgttgttgcatgcatagcgctcggcgatcgtcgacttatttctaaatcttattgcaaatatgcagtagtaaacatcctttcccttcatccatagtaataaccacacaatcatcttctattatgatctcccctccacaacctccccaacaaccttccaatacctccccccatccaccctcatatgctcaacatgcccactacccctcccccacttctccttcctcaccgcaccaccaccaccaccaaataccccctccgcctccacagcatgctcctccacatccctccaatccactaacccatccccctcggaataaacataacaccgtcgcacactttcccccacaacactcctatcattcagcattcgtctccccttactcacctcatcttcactaccaaccacccacctcatcccaaacatcaacagcaacatacatcccagcagaaccttccccacccacttcagaagaacattcttaggaagaatgaacgagaaggcgcggaacgcaccgatcaatgagggcttccccggtgcgctgtcaatgagcagggaggtgagggggagggtgtggcctgtggtggacttgtaggtcgagaggagggttgtggttgtgtggacgccgccgttggagaagaggtgaatgtggattctctcattctctttgggggtgccgggtgggtggtggagaaggatgtagtcgagagcgggttgagcactattagtcctcttgttgtcgtttgtagtgctggtgaaggtgaagagtgaagggaggcgcataaagtcacccgtgctgctttggagagtgaggatgcgggcgctggggtagagggtgcggtactgggtggtgtattttgtgagggcgcgctggggggcgttcatccagtaggcgaggattattgtttgcggtgcgttgttgctggtggtggtttcgggggtgagaggatcgtaggcgtggactgttggtgagagtgttatgggtttggggagggaggtcatgtccatggtgggtggagatgacatgattgattgattgaatgattgattgaagacaatgtgtgtgagggtatggagtaaaatgggtgtggattgatggtggtggtgtgaggtgaggtgagaggtatttatgtggaattgtctatctctagattttggcagtaaataagggaatggaatttgcttatcacttcaacaatctacctggttcctggatgatttccggggaatctgccgatcttcggccgggggagagctgagtcgagcatcgcggttaattctacttctagtgcctttttagtcactttagtgttactttgtaggtccgtcccccgttgccaagaaacggccagttgatggcttagcgatagatagatacatcctaccaagtggtgtttggcattgcaagtggatcaaagcctgatgtgatcgaaatagcctcgttaacgcctgtccccgctatgctctaaattcccgtcctacgctttcgcgctgccttctatagcccatccaatgagtcaaatatagcgtgcctgggaagccagcggtcatgtcctggtagaatgatcaggggctgcttcccctataccgtgcaagggagacccataatatcatagccgatcggcgttcattaatccagccttgtctggcgttatcttaagtaggggttgccgagccacttgcgtctttcttctttcctcgtaatgtttgaccagatccctggaagcgaggcttgtcctcgagtacctgtccgctctcgtcgcgcttcttcactggcttgattgcatatccaaagaatagctggttgtggcctaaccgcagaggttgcgggccgttggtcttcctgacaggagggggatgctgcgggttcgttgttcctggggtaggagtagacggttttggtgtggatgttttgcttcccttcttggcattcagacgctgtcctccactaaggaagttcgatgagaccgctcgggcacccgccgcagcatcagtcgactccggggcaatagcagcgtagttgatcgcctgtgccatggttccatggggatgaagcagcccaccagagggcagcttgttgcttactccactacgaggagtactggtgccgctgggccgttgaggctcctcatagcccacaggaggcgcaaagtccacttctagatctgtctcgagcacggaaatggcattcgtgtcggtggatggcttggtttccaagaccgccatctcataaacctggtcgttgtatgcaaatgtgaagacatctcccttggtcagacaggagaagttacggaaagcattctccagcacggccttcgggtcacttatatcgaggaatgaggtagattgagcttgcagcttgatgaattggccgggtgggagatcggtcgacttgacctgtacgagatcaccgggttccagaaggagagtttgcatgagctgcgggagatcaactagtcagtatcctgcagggtacctatcatgagaagcacattacccagaaaggtagatagatcttcccctcttccgcaatgaactctagtacaccagcgtgcgtcaacctttcccgtgcaccgttgtgaagctcgaacagcatcggatacgtaatatgaaggcgagtaagcttgtcaagagcgctgggcggcatgatgaccttgccgccgtggttcacgttctctctctccgggccgggcatcatggcgacaggatagcagcggtagtattcatcgaaacgacgagcagctccatggcggaacatggaaccacccatgactccgttcatgggatcgtcatcccagtatccagaacgaaactgtcatcatccgggtatcagcatgtatacacctcagtacataacggcgcctaagcggggaactcaccatgattcgagctggactagtaccctataggtcttaagacgatgatcaactgaaatcgtaggttttcgctacagtctgagctgtagtcagtagcaaataggatgcaatccgctgcggtggcaagaaagcagggaagaagctagcagggagagctgttcgggtgaaggtcaggaacgaacggagcgatcagatcgcagtgacgcaaacgccgccgcgatgattttccgacccgaccccagacagctcggtttgctccgcgcaacccctctgctgatattcttcgtttgagttctccagaagcaaaattactacgattttcaatgcatatgccccggaaggatccgtagaatccaacaaacaccttggttttacagcgcagctccatgtccgcctctcagccacgccccaagcgagcgggtgaagacttcacccgcacccaccaccacgaagatgacgatgtgaacggtgcctccagcaagaaaccccgctttgacttacgaaatccctccgctcttgcccctgatgcgctggaagacgatgcagttctggatgcagacgaaataggacgccgtgggcaacaagttcgccgcaaagctgtcaaccttgatggttacgactcggacagtgaaaatgaaggattttcggcgcgcatcgaggccaagtcgaaagcaagcaaagaaaagcacgatgcggaagatgacgatatgtttgccgagctgcaggaggattttggtgcagaagaggtcgacgccgatgaggccttgcgcaagaacaagaaaacggtgcgattcctacgagacgatgaaatcgagggtcaagtcgcttcatccaaaagcggaggaactgtacatgcagatttcagcaaaggcgccgacgaggttgacaatgatgaagacgagagcgaaagcgaggttggagatgaggagcgcgcaaaactcgatgaggaaatggatgaagagcttggcgctggcgcaaagaaaaagcatgcgccagtactggacgcgttcaacatgcgcaccgaacaagaggagggcagattcgacgaccaaggcaactacatcaggaaagcagcagacccggatgcggtctatgacagctggctagaaggcgtgtcaaagaaggatatccgtcgcgccaaagaggccgcagagaagcgagaggaggagagaaaagaaaaggataggcaagatgacagtgtattgacatcagacgccctgaagaccattatctcaaacctccatcgaggcgagacgatcttggaggcgctggcaaggattggcaagggagctccaaagaaagcgaaatggcagacgaatcgcaacaaaaaccggaagaagcaagaatctgcgaacgaggataccgaaatggccgaagaggatcccaaggaaacggctagaaagcaagcgattgatgccatcacaggcgcagccgatattcttatgacaagagggcaggcggatatttacgacactgaacgcgagatgctcactaggcaataccgccgcgaaaccggagaggactgggtcgatccgtcgcccgaggtctcagggcccagtgaagaagctcctgcaatgtgggagtttcgttgggcggacgctcgtgacggaggcgtcacacatggtccatatgatagtgcgacgatggagtcgtggaagaatgcgggctacttcggcgaaggtgtcgagttccgaaggacgacagacacgggtccgtggcagagagaagcaacatttgcataagcaccgtacaaattacgtctactggcatctacaaataccatctgctgagaaacattaattgcatcattatcattcgagcctaggctctttcttcaaagttgagacccaatatcgcagtacccacaacagatgtgttttgaaaaagcgccagcattatcatacaccaagcaattcatctggtaaacgaaaaccgaacaatataaaaagacgggaaatggtcctccgtaagccttgcgatccatgcctcagtgccgtctaatcatggcagaggcttccccacgcaccaagaatcattgaaaagttctacggcagataagactatgaaagctccatcgcatctccgtttgtaggagcaatgaagctaacggcaccttgatcgccgatgaaacgctgttcgtatgtgctgacgaatttgacgctccgtgcagggtcgtagaacagccggtaactgcgctggacgtcatcaatgctgacctccttcgccttacgcttttggctgagcaaatgggaggtggtgatgatgttgctggcgtagcgtagattcgactcctggccgatcttggtgagcagcgccaaagcgtccggagaaaggtcgatctcttcctcctgggcgcgaatcgccagaatctgcctaatctcatcggcagagtagggctgtgtgctgacaatcaccacgcggtcgaggaaatccaggggaaggccgtgcggagagctgtatgtcgtaccacgaatccgggcgtggccccggttgctagccatgatgacgatgggtgccagttccgcctccagagcgcggttgatgtaagagaagcattcaatgtcaagcatgtgcacttcatcaatgaaaaggactcccgggataatctcggcttttccttcttccttccactccgccaccttggtgttaatctgatccctcacttcactcctgatctcaccggtatctccagagaagagagccaagaatccttgtgaccgcgagttgatcacatcgatctcatgaaggctgacggtgtgcacgatttccttgcgaacctggagttcaccctcagggcattggacaaactttgtgtccgctcccatcgcatcatagtcgcgcgaccgagcgtaagaacgtcccagcttggttatcttgcccgaggatttgtcaatggagataatgtcaccggccatcactcgttccttggtcattgagtcgatcatctttgttcccatgtcgtagatcgtttccatgtcggtcgtcttgatggtgagcttgccttgtttgtttccctaaaagataactgatgtcagaagcgttcgtcaatgagagctcacccaaggcctcacttacaccagtaacactgcggtcgatttggatttcaaccacttcaccctcgatgatttcactctcctccttgatacgaacgccgatcgatttgcggaaggcttgcgtgagcgcctcggtcttggacatctccatggagaagatctccgacgctgcgagcattgtgaagggaacatcggatccgagggattgcgccatacccatggcgatggctgttttaccagtgctaggagggccagcaatcagcaacgcgcgaccggcaatcttgccttccttgaccatttgcagaatcactgcggcagccttcctcgccttctcctggcccaccagcccttgagaggaagccctaggctgtaggctgtctgcatcgacaccgagtcctcgaatgtgtgaatgagcagcgatgaggttgagaccccggagctccttggtctccgcgacggtagaaattggctgtcggggagagtcagcggtgatgaacaccacgcatttcatcggaattggaacttacagcagccatcgcgacgactttcagatcgtaaatatcttgtcaggtcagatgaaaagccacggaggtcaagggagcagccaaaaatggagaggtttggccagcctgagggagcgcggagtggaagagcaggcgaaagagctgctggccgggaagccgccttgcaggccgcccggcagaatgagcgattgaccgtttttctgccggcgcgttgttttctaagcgcaaacgggtttggtttgactgcgccaggaattctccgtttgtcccctcattgacagttgcgcattcacccgctcgaggtatatatataataaaaaaaaaaggagaatgatatgcgtctggactcggcctgtcgaccttctctattcccccgttgtctggccaatgtcgcggttgctatcgcgccgccttcaatcccagttgtttcgttaatgtaggcaattttctacttggggcttgaattcaatcaatcacatttaccttttctatctatcgtgtatttgtcttaccccaagcccctcatcccaccccttattaattgtcccctcctggcttccttcatctacgttacgcaaggcacatgggatgttgtcaaataattggatttgattgtcaggccaactgaactttgtgacgtcgtgatatggatacagacgccggtactacgcgtgacccccgtctcgccaggcctttagccaggccgcccctgaaccacccttcctctgcggatgcttcttcaagcgcctcccctacgcgcttcaggcctggatcccgttcggtcggaagctcctcgcccgtcgatgcccaaaatgccactgccgatcaatttatacgtggaatctccgacctggtccaagccgccgtgattgctgccaacagcaagtccgaacaggagagactaaaaaagaagagagaggccactgatgccctgcttaagaaagctaaagttcactctagttttccgtctactgcagcttttttccagcagtcccaggaggcggaggacgctgatctggctcagcttgataaaaccctccggaagcatgccgccaactacagagaactggaaaatgctctaaaagccaaatttagctcgatcatgtcactggagcccccgagaaccgaggacagggtaaaccaactacaaaatgaggtccaacatgcgaagaacgggttgggaactgcgcagaaggacatcgcaaggctgcgtgactataatatcaacctggaaggcaagatggcggcagtgcaggataaagtcggctcagttaggaccctgcaagaaaaggttaactcgcttgacaggcttacctcaagccacgcgaaacttgccaaagagaatgctgagcatgtcaccaagataacctcggagctggaaactgcgttggcatcgaaagagcgagaaaataactcggccgcttccaaggcacagatggatgagttaagaaagcagacctcagacttgaccaaacagatcgaagtcttgcagaagtcccagcgtgaatgctccgattatttgaataagatgaacaagagcctggacgatcatcgccagcaacaggacacccggagcatggagaatacacggtcgttgacatcgcttgctgcacgcttaacttcagttgaagagaagaatatccaggtcccctcccctgctgtagaaactgcgcctgagccgtcggtcatgtctgaagaactggcatcccgattacagaaactggaaggtgaactctcgggacagcacgagcgtcgtattaaacaaatggaggatcagctacaaggactgcaaacaatacaacagatgaaagacgacttccaattcaaggaaatcgaggatctcaaaaaggtgtgggaaaggggcgcccaggaattcgaagagatcaggagcgattatgtccgagtcagtgaggagctcaagggcctgagccaagctcaggcagtagcgaatcccgctggggttcaggcgcatatccaagggattgcgtctggacttatgaacatgcaaaatatggttgaaactttgcgggttgcattacattcactcgagactcggtacaacaatctatccacggataccattgtgaaacacatggtggtggctatgcaagagatgtacccatcaaccgcgcagctgacagagcaaatatcccttattagggcatggtttgagcgggatattcctccattgaaagcgataacggagcgcctgcacgtgaatcagatgaatttggtggagcagacacagaaagacatggctttgcgaatggaggaaatgaatcgcctgaggagccagcagacgaatctctcccaatcactcgcccctgtttgggagcggcttaccgcccagaatcagaaccgttggctcaccgctgatgatctacggcaaatgcagaatgatctgacatctctggcggcaaagattgacgagcatactagcaaactcagcggatacgtggagtcgcgggaggcaaaggaccaactactccacgacgacctgacaacaggcagaaataacttgcatatgcagctccacgccattgccgaaaagcaaacggaactcgagaaaatttgttctaaattccagaaggtcaatgacctaccggatcaagtccaagccctagccgtacagcaggaaaccctggccaaaagactttctgaacatcaggaagagggcttgcaagatcaagtcagggctctggcagatgaacagaaaaagctactcgagagattttctgattctcaacaagataatattaggagtcaaatcaagtctctgattgacgaacagaaaaccttggctgggagactcgtcaaaacccaggaggaacacgatcagctcaaagctcttgtagaggctcaagaagacctggcaaagaaactttgcgagttccaatcaagcaatgaagacgacttgaatatgttgaaagcctgtccagatgagctcaaagcagtgcttgaccgtgtttgccaactcgagacctccacacttgaaaagtaccagaatgttgtggaagaacataggcttctcgaaggctccacgtcgaagaaccttacaggactaactgaaagggtcgatggcttagtgaagctagtcgagagcagccagcaaccaccgcgactagaagagcctcagcaagatgataatatcagtgcaatgaaagatgagcctgaggggaatgatcaggatgctgaagtcgctaggttcatgagtatagctgaatccactccagcgcgtgctttacaagagcggaagaggaaacggcctgttacgtttaatgcatccgacgaagagcgttccagtctaagtagacccgaatcaccaacttccaatgctgcgggttccgcagcgggaggtgacaccgcgccatcaacagacaggaaaagccgcaaaaagaaacagaagaagcggaagttacagaggaataaaggtgcgcaggcagcagacaagataataacaattgactgaaagggggttgtaggtgtatgactgaggctgagagttaccccctggatggtgttcttgaagcagtacacattacgagattacgaatgttatgaatcagtcgttagtctgaggaaaaggaagaaaagttggtttcaattctgctggatatccccctgtcaataatttcttttcttatttatttcccctcactctctctgtggtcctgggcgacgtaatcccaggcctctcttactttcttttgttcaatgcttttttctttctttagggtcaaggaggtaggggttgaaagggacctgcacataacaagaatgtacaagtggagtctgagtcagttctgtcctgtcttgtctgtctatacatccatccatcaaaccaagcatgcctgtagctatcaaatcagggagcctcctggaggaactttagaacagctgcaagaagcaaaagcatacgcgtcagcaaaccatcctactcaatccaaatagatcagaactgctcaccttgcctaaatccctcagggttctctgaaatcaaccaatgcccggcctccacatccgctatgcgagcattggggaagaacttcttaatcgttggcacagactcatcgctcacatatctgctcttggtgcccctcacaaacagcgtagggccatcatacgagacagatcccggctcccggtatgggaaatcagccataccgggaatggcttcgccgaggacggcgagcgggacacggaacttcatggtttggtcttcagtcgagcggaccaggttggtgaggaggaactggcggatggggagggactgtcacatattagcttagtcgatcgatatgtacagatcgagctcggtttgcaattcacaactcgtactcacctcctcatatcccttcaagatctcatcagcctcagactgcttcgtcacattcgcagcctcaacatgctgcatgccacggacgtagagaccgaaatcgctcttcaggggagcattcacgggggcgttgtcaaccggtacaagggccgagacaagcttgggtgaatcaagggcaactgtcatggcggttttagcgcccctaattattttccgttagtttagccgccttaatcatgttttgtctttactgttggttctgaaggtattgtgtgtagagggaagaatcagagacatgtacatagtagtaggatatgacgtacatcgagtggccgatcagaaccgccttgtctagcttcagctgctggaggaacttgatcacgtcttcggccatgacggagtagttgtgttcttgggcgtggaaggattggccatggttgcggaggtcctggagaacaaacacgatttgaatcactactttgattccaaattctttttcttcatcactagttacacaccactgtgaagatctcacgtttcagatcacgtgccaatgctctgcatgatggttagtcgctttccaattcactgggtgtttgtcttctgagggcaattgaatggaaaagggatgcatacttgctaataccccggttattctgcttcgagccaaacagcccatgaaggaagatgataggactccgatcaaccagatcgcctttctcggggccaaacacctggtaggacaggtctgttcggaggcctcgtgatgtggagaataagcgggcgctttgggcagcgcttcggaaggttgtacggattggttggagcatgattgtgagtggcgattatgatagtgatgacgatgctatctgagaatgcgattgatctgagggtttaccttgagtttggtgcatttaagcattgaagatcagcagctgccttgggtatatgactaagcagctggcaagtggttttgccgttgtcccgtcggcttaatgggattgtcatgcttggagcaatatccgggtgtcttggcttgacaggggtatatatgtcggaggtgaattgtcgtttgctttggtctgaaaggtagcctttggtttgtgctgcgttgtactgctggccttgcattgatggtgggctattgtggtaatggtttgtaggggcttgagtaattggatcttatctgatctcggttcaaaatatatatcgattaattgcatcatcgtttctagtactactgatagtactaccaatccacccggttcatgttggaccttccacctcggatattgatcggaatctctcgctgtaacagcttactatctacttacgcttaggcctctgaatgatcgtacgactcgaaaacagccgggaaactaaatccgggtgaattaattactatctgcaaactgagatgaacatcgccgccaacatggttattcagtcagaacaatatttattggaagtacatttttctacaccgcaagggccagcttggctgttactcccacgtcgcaccaatctagctcaagtccactgatttttatgagggagctcggttgttctacaaatatacttgccatgtcagaatacacactctactgtaaatctccttttatacattcaacaatcaaaatcgtaaatcgtctattctgggagcttcattgaagtaaatgtatatacaggacatagatattgtcgtcatatccaccgtgatatcccccgcttattcctaaagttggtacactgacacctcatatttaggcgtccaggagaggagggaccttctcgcaaaggtattcaacaatggcgtcggggccgcgctcgacctggagaccctcggggatagcgtgcagcttgatgtcgggcttgatcgaacgggcaatggagtggatctcgttggcctgctcggcggaccacatggaggcgctgaactgcggagggagttagacatatgccatcataacagtagtcgctttaccccgcattgtagagaaagctcaagatgaagagagaacttaccaggacatcgggcatgtgctgcttgaccttggactcgacttcctcgatctctgttcgcaaattcggtcagaaccgctaatcacgaagcctgcaaggagtttcaaagtcacaagtacttactctcgcagttgtcaatgtgaatgatggtgtaacggtccgaaagggcctcagcaacccgtccgatgaggcgcttggctctctcgggagcggtgttgacagtgacgagcttgaaaggtcccttgggggcagacattgtggcagattgtgtgaagagtagttttctgaacgacttggagacagactcgataactgcgacactgttcgcttttaaacgaagagcatgcgatttcgcagttcaaccggcacgacaagccgcgggcgacatccccacgttgtcgtggggaagtgggctgtttagcgtattcgccgccggctttcgcccgaggctcggagatccagagcgttgaagtcaagtcatggagggggagcgagtgtttggttcctgcaaaagaagtcgaatgcggactggctgctgagaaatggattggttcccaccggcaaaggcagtgagtttgattgcccctcccactttgctttcccccccaccccgcgcgcactgagcttcccggccggccaccagaactgcaccccgcgacgatatcggggtagaaatatcccgtggactgtacttcaaaagagagttcgcctcaattgattcctgctcgctgtcttgcatctttgttgttcatcaattccttcttccccctcacaataactcatcatgtctaaggtcgcatctaccttctcgcgtatgtggacacgatcttgctactgcagctgtgttgctaacgcaaatcaggcctcgtgcgcttcgttcccaagtcgaaccctgctaaggttctgatcggtgagcccgtcgatgccgcagtggatgttggattggccgtctaccagggcaaggatgtcgctgtgcgccccttctccggtagctccgtcctcaaccccggccagaagaccgacacgaccgagaccattgagcgcgtgctttcgcctttggcacagagcgaagtcggatccatccgatgcattggactgaacgtaagttctcattcatcgcagcatagtcgcctttcggtatcgagcaagaaactaagcgattgcgcagtatgtctcccacgctgctgagatgaagctgtccatccccgatgttcctactcttttcatgaagccctcgactgctctgtccgacccctggcccgccccgaccgttctgcccaagctcacccagatcgacaacacgggtgactacgagtcggagatggtcattgtgatcggtcgcgatgcgaaggatgtcagcgaggctgaggccctggactacgtgctcggatacaccgcggccaacgatatctctagccgcacctaccagatgaaccagagccaatggtgcttctccaagggcttcgacacctcctgcccaatcggtatagctagcccaccttcaatactaaggtgatattgcattttgtgctgatggacgaactctcgcaggtcccgtcctcgtttccgccgctcaggtccccgatgccagcaagttccacattcgtggatcgaagaacggaaaggtccttcaggactgccccttgacgtatgtctcttcttatactgcccatgatgcgcaccaggataaaagctgaccagcaattccgaacagtgatctgatcttcaacgtgccccagctcgtcagcttcctgtcccagggcaccaccctgcctgcgggtactatcatcctcaccggtactccccccggtgttggcgccgccaagaaccccaaggagttcttcaagcatggcgacgagttcgccgtcgagctgcagccccacgtcggcaccctcatcacgaagattgaaaaccaggcataattatgataatggtacaatgagacgggtggggatttacggattatgatgagccatattacaagaatagcatagagatgtatatactgtacggataccaatgaacaggttcattgttccaatacatacatgcgtgaatatagttaagccaggtgacatgtcctatgatgcaaggagttatcacattgtcgcaatcatcctccgagaatgacaacaaacccaacaagacgtaggtgggaggcaaaccacccacatccacaccccacgctgactaaggtccccacaatcagccacttctcaagcttttgcccagcactgcccatgaattctagtctagctgctgcaggccggaagacaagaagcaaggagaaggaggcagctgacaaggaggaaaagaaataagcctgaatccaacataccaaggttcaagttaaacctcaggcactaaatactgaatccttaaagacccagaaaccgccatggaagcaacaacaaaaatccgtataatcgaagtagtcttcttccccgtgtaactccttacccatcccttcactaccatcactccatagatggataaacgaaactcgtcctcaaaatgcaaagctactcacagaccgaaccacgaattgccgactcacatcacaaaatcagtcaacatctgcaggagaggataaaatcttatcctagcggagtaaatctattccgcttcgatgccgagcgctgcgtgaccagtccgaaccggagtttagtggttcaactttcgggagtaaccttgcatgctggccagccagtagtcaatacctgagaagccaagtaatcgggccatgtgctgagttatccctgacagcttgtagatcaggaaagggattacattcctgtctctatataaacaaatctaaataagaactgaagttaagaaaattgataataataaaaatcccggttaatcctccatacaatcaatcccgtgccagtactccgtaaattcgtaagtagcgaaccggacgccgtgaatccttcccgatagcagcaacatcggcggacatcgggccagccgatcgggcagccgcccaacactaaactgcacactgtaagcgtggtctgacactagcagcaacaaccacaccactcccgggtgctattcattcccccttcgctttgccgatagttagtatggtttgatgatatcggacgggccacttttcggggagaatcgtttggcagctctcgaatcgaaattgccgtgatccatcaaatagttattctactagactaattaaatctcatgctgagttttttttattcaatgtgggttttagttccattcccatccctacttcttttcggagtgagtatataactacggcggacctggtagggataaagtctttagcccttgggtcttttggtttctttttcttttttccctttcgcttgaggcctttcctctatacttctaaactatactgtacttctcatgataatttttcttttcgttgtattcattcctttacacttcgattgaggattcagattcagatattgtcttcgattgcttcgctgctgtgcacgctcatatcttcatgcgtctatatacatgctcgccatctatatctaacgtctaggagttctatactcgccaaattcgtcttcgaaagcaacacgccaaatcgtccaaggaaaaaacaacatatgcaacattggaaataaaggaggaataacgcaaacgagaatgaaaggggattcgtgtcatcagtttattcttcaatgggcggacgccagctccgtccttgccagtgtacgatcatagtcggaatgatactgacggccgcaacgagcgccgcacaaatgccagcactcggtgctataccaacactcgagaacatggatgggaacctgaacgatatcgattagcgtttgccatatgtgaccagcacagagatgcatccaatacttaccagaacggtccgaggaatccccaaatttggcggacaaacgtgatgtatactccgacgctacctgcttccttgtggtaacagtccactgcatacgtgacaagaacagtggttacgatttgattgccaccagcgcagatggcgatgccgaccaccggccttacgttccagtgaccctccgtcgactcttgggtgcagacaaggaatacaatcaagcccacaatgcacagaacaaatccaatgtaactgagccacaggcggtattcgggttccggcttgcggtggattttctttgcacgcaaattcatccagcgatccgacaacacaccaccaagctgctcacccaaaagagatccgatgataggacccaggaactgaagtccgagctgctcggcattcaaatcgaatttagtctgcagcaaactggggatttccacagtggtcattacgtttcccaaacagaacaccatggcgtatgcggcagtggggatggcaacacaaggatgtgtgaccatgcccaggggtctgaagaactccttgaacgacaagggagaggggtcaatgcgtcggagctgggcatactcccgtacccaagcgggctgttcggggttatggtcgcctccaatataccgggtctcaggacccaaaaagagatacaagatgaactgcacaccgttgatctgaatattggagattggtcagcgataatctcttcgttgcaccagtaacccgaccgggacatgggaacacttacgattgccaggatccagtaaatccattggtagcccaaccgatacgtaacgaagccaaagatgaagggtccgctggggattcccagcgtaatcaatagcgtccatatacccatgtaccgtgctcggtccttcttgaatgtcgtctccattaccaccgcacttccgatcgcttccgcagccgttagcacgtcaggtcatgagaataagaaaggcgtcttacctgaggcaggggaaatgaaaaaagcttgcaaagcccgacaaacggccgtggacgcataactagtgctttctgcacatcctacattacagacgagactgcagattaaggaaaggaggaaaatagggcgacgtccccagcggttggataacggtttccagaaaatcggtgctacacccaggactgcaatttggatggaggtcaaataactcgcgtcgttcaccgaaacaccgaaatcactcgcaattctggtctcatggtcagtgattgaaggcaatacaaaggttcctggaagaccatacgtttgataagccgggatgatgcctgcagccgcaaaagtgcccatgcacgcatgaaacgctactaggagaagatttgcaattttctaaaatccgttgacaatagccgttagcatggtccttgtccacgaaacgtcttaacaccctgcaaaaaggtgattcaacaccgcttaccttccacgacggccaattgtaaggatccgcaggatccatgctggggataggatcgagttccagcgttccatgacgttccatcaaatagtcacggtgtgccttggaaaggtgagaagacacgatgtctgcatatgtcgatgggatgcctgcttctgtgctctctacaaagtcgacatcttcctttgcaggcgtctgagccgggtgcatctccatggccccagacatattgtgaaaagcaaaaccctgaactggggagcttgtgggacaaggcaagtggcgattctttccaagactcacaacacactggagatatcaaaaaaatgcaggttgtctcaagagtctgaagaaggggaacgaagaatgacagagaggaggaggaggagatggaggaacccaatgtgatgcctaagagggaagagccctgcctccctatgcaactaatcggttcacacaaaatgttcctaaccggggggaagaaggagggttccacgctcaccgggagattgacctatcaccgggggtgctgttggtacccttcctgggggatgttcaaacctggaagtgacgagtcccgcgagtcccgcgtactgttggggcaactcgtggggaagatgcggaggattccctacggcacagtccagtcacgaaagcagcaatggtcactatgttttgtcattggggatagcgcatgatccgctcattggccggaccgagccaaagagtgtgtatcgccgccagaagcaacataaccgagggcccgactacggaggactcgggggatccagaatccagaatggttctagtagcgacccattcggccatgtcggcggcgggttaagtctttggagtggatgcgctccttctcgggaggagacatggtagaccaatgtttcgcctccaaatctcggttattccgctgaccagatttggggccaactttgccgagttaaacggattacaaagggtttggctaagcagtcggcgtcaagctaacaatctgcggacgataactgctcgggcagatctcagcgtgtgatgatgaaatcactgtgtaaccaggcattgattttgatgtctgcctggggggagtgtgggctattcaacactagtacctcataatacgcccaacaaacttgcatctgctctatgcagatgtcaggggcagggaaacaaggtgtgatcagtcagtttgtgggaaaggaggtttaggacgcgtcccgtactactagtctactagggactacagggtgctactgcgagtcaagatcaggtgggtgctaaagtacccacactatatacgtagacacggggtctggagtagagagcgactttgagtggagtttaacgactcggcctttcaactccagtacgtctcccagagccgctaacaagtgccggggtgtgacacgtaaggaacttacagactttagcgcttttacaaggcaaataaccacggccgccgtgtaccgatacggttctgtgacgtccacgtgccaagagccaaggcaacagcgttgccaccactttttctgccccacaattcaggccggcttctcctctcccccattgttgacacaaaaccacccgcttagtttcctgcttctccacgaattcccccccctctcgcccccagtctgtatcttatttggcttatccctccttatcaccactttatcgtggcgactggctagctggctggcccttgcttggactatcttgctggctgggtaacgtggatgggttgtatgtcattgttagttggaatcaacttgatctagatttatctatttttatggcttctttagtcgccatgccacaaaccaccacatcatcccctaccaccacgaccacatcggcggtcaagacactgatctgccgcgtttgtcaaaagggcttttctaaggcagaacatttgagggtaacttgcccctagtgccaatcccacggtgtggagacatcactaatgctggcttgtagagacatgaacgttgccgtaagcatgccaccattgttgatttcctttctgcttgagcaggcatgatcgccactgcattccgccctaatggattgtgggaggtcattaatgcaagtcatgatggctaacttgccgcgcctaagatacgggatcgaagccattcatctgcaaagaatgtcggcgaccttttgcccgccaggacgctctgacccgtcatgaaaagcttcacacccgcgcggccaatgccaaacaggcccaagtgcagcaatcatccgtacaacacagatgacacaccatcttgcctcgatttgacaaatgtggacaattgaaggactgtggcatcgctttagggcttagagcgtggggtatacttagtggcatacagatgttgatgacccttcttggatgttgtaataggatgcataatcaaagagaaaaagcaaatttttgtccattctattcatcctatgtatgctatatgtgcaataacaataaataacaaagatgcaaatatgctcactcaagtaaggtaacctcaaacaataaaccgacataagacatgacatccgggctccaaatgctaagggtatctctagggcaatcagctgctcatgagaacaaagaagatatgaatagacataaatgatgcaaacgtgcagagcaaacgttccaagtcacacaagtagaaaatgcaaactcaaaaaatgacagaaccacccataaagcattaagtagatgcgtaaaaatcaatgtgcagaaaaactcgctaaatgctgaaatatgtgctcgaatcatttcgggtattgatcttgaactgcaggctcatccattcggactaacgcctttgcaaccgccactccgacatctttgaagagatcgcgcattatcgcttcgcagctcccaggggcgtcctgctgtttggcaccctgggcccggaatcgagcagataaccggtcaatcaatttgccgaaggtactttcaaagtaagactcgacaagcttccttttcaggtgagcgttgtcgacctgttcttcggcataaggagtgccggaagggtggctcccaggctctacacggatacgctgggcaggacgctcagcaaaggaatcgtcgatttcgcgaggccttttgttccctggtaagggatcgtgtagcgcaagagagggctgatgaggtggttggggaagataagccagagccgggtccggatttccgtccgcaccaaactcaggctgctcttcgccagttttggttttctggaaaacaaatcgacgctcccgccggactttcgagcgagacatccagtccgccagagcatcgacataccccgtccatgttctcatggactccatatcctccacgtgcgggagactgtccagccagacccaaacccgctcgattttcgtcgagacctgtaccaacccctgctcgggcacgacccggacgggctccggaacctgcgggggttctactcgagtaggtagcgcagcaggggcttcagggggcactttgactgtcacatcccgaggtgtgttgtatttggccaaccaagaagtcagtaggtcccaaacttcagcatcgatatctacgcccggatacggatcaccgttcgcatacgcctcccagtgagcctttcgtttggagatgtaggtttggatccggcggcggcatgactgccaggaatagcggcggccagtttgcaattcaagtttgttggagatcttaatccagaaagatttcggatggttatgcgcatcatcatcgttcatggcagccgcacacagattgaccaggcatacttgctcggggacgctgagctgtctcccgcggccggcgaaaggaagggactctatcggggtagattgatccaacgaggccgaaggctggtgaatggcaataagggctgctttggaggcagacggggaggggttgttcggagattgtggtgtgctaccccattgatcatgatcgggccgcatggggttgggagtgaaaagggtggtggtagcaggatggttcatggctcaacgggcggcggggttggggggttgccggatcctcgtggaaacgagcgaacgaagaagtccagcagcgcccaaagagacctcttgtagaaaggggaaggagaaggagatggaggagggggggatggagaggagaagatatagaagggagagagtgaagataaaaagtgagcgggcgaaaaaagaggcaaaaaccgaaaaagggaaccggaaggaggaagagcgaaggcaaaatgattaaggcgacgcccgcaccgcgtccgcgtcagcccacgtgatcggcagttgggtacaaacgattccctgatccatcgcatgatgccggttgggttttatcccctggaacccaccttttcttcttgaatcagtcgagaggaagcagtccgggttttaatgcttctatacaggcaattgcacaagatgcaattcttgctcccgacaaaaaagatggggataatcacgcataaaaaaggagaagcaccaaaatggttaaagccgacggagtactttggtcggctccgcgtatcatattaccgcatcgggagatcgcctcgtgatctgctcttgatgtccatcttgggaatggaaaaagtaaaaaaaggaaaaatcaaaatggaaattaaaaaaaggcaagtttcaaatggcatctcatcccctctcctccttcacctttcacactttcccatctgctgtacactttaacctcggcttgtctcactctctaaccaactacatagtgtctctccacactgatgtccctcggaagagttacccgcccgttcccgctcgacggatccgttcagccgacgcgctcccccatgcattctttccactcatcgtgttgggagctatgagctatgagctatgctaggctgccctggattgcttcggcttcggcgggcagatccttttttcgctaccctcttgctatggacaaactagtgcttagtgcccgggagattaattattgaggttcagacttcagccgatgatcttcgttagtgcgttgcgcgaacccatggctgcctctccgccatgggccgtgatttgtcaaatccgcgtgcgtttaaggtggtacatctgggacatgtgaacctaccgtgagtgcttcgtccatgtcattcggccctgtggggtaatccagactcttctgatcccttacgtggaacaacgttcaggtcaaaaagggtctcccacccctcgtgcctgtcctcgcaagccaagcattgaaattctccccaaatcccctatcccctttatcactctccgaccaaacaatccctctctctctctccacatatatactacttgacggctatacgtgcacccgagcaaggatgtcatcacgagcccgacccaacctgctggatgtggtctcctctttgtcctccgtcccggggacacggaaccaatatgccgtgaagattacacgggactggtgtacccaacagtatgtctgtttgaccgccgcatccttgcttcatcactcgacgggttgagttgaccagagcagctctgtccttgggggtttttccactgcgcttatgctggccgccggtcaaaggttccttgaccaggaacttggcgtaggccggtatcctgaccccgttcatgcgttcgtccagtttctacacatggttcaccctggcccgtcaattattacatgcacgcttctacgagtgtccaagaaacaatccgtcctacaagttgaactagcgcgtgcctctaagccgggagaggactcagactcctatccaactactactctcggtatcttcacatacggcgatattagcaaagaaaatggcctgtcacaggaaacgcggccggtcatcactcggccaccccccgaccggctcactgaatgcgttactatcgacgaccccgtcgtcagctcaactcctgtgaccgcgaagatgaactgggtcgccccacgatctccacagggactctggggccaccgcctcggcggccacaaccgcgaggtctggctgtccttccgcgacggctccaaactatctgacgtgttacatctggcgtatctttcagacctggtaagtcgcggttcttcccaacttacttctgcttgtgctaatacgccgcgtgcggtaagcccctgcagccaccagcgacccatattccggatttctacgctaaatatgcgatctccaccctgtgtctgtcgatcgagttcaaaagacggcccgacccgtccaccgactgggtcatggtccgctccaactccaacaaggtttccaatggccggtatgatgctgctttgcaactattagatgagaggggcaatcttctcgccttgagcaatcacgttgtgtttacctcagacttgaagccccggccggctcggctgtaagtgtggggccgtgggtcttttgatttcgagcttagcgtcaagtcatttctcactgcagtatgtgataataaattcaaaagcgaggtgttttgttcacggagtgagtggatagacattgattctgtagttagttaatccgtatttggaggtgattagcataaagcgttggttcctggccctgttctccgtggccagggcattctcaatagattcgtttatgctatctacaaactagcctgagggagcacacacttttatgtcattttcatttctttccttctctttcattcaaacaattctagagcatcagatcgatacgaatttgaccggcggcttgtttcgtccaggcacatccatccccagttctgcttagtaacgtaatccgtacatactaggaggctatcactacattatacaaatattagtatcatatgtatatatttacctgtagatgcgataaatgaccagacaaactactatagtccatggactatagtggggtagggagtagtttgtctaactttaggcgcaccaacaatatatatgaagttgggtagtaagaatgtgtgaggagcgactgaacagaatggacattggatattacccacgtgcattgaaggactataggtcaggcacggtagtcaactgagggagtatattgtaatagtatcagtagaaaagaagtagaaaagagtatagaaaatgccttgccatgaaaaaaaaaaaaaaaattcttgaaccgaaaccaaagaaaactaaatggattatgcaaacgcaaatgtgagtagacttcttccagaaacaatatgaggatatactattctaaccccagttatcatgcaactgctccccatggatcgtccatgtcataactcgagctactgccatgagtgaagccacctataccggatagaccgagactggtgccgttgttgcttctactgctgctgaaggcgttagaggctggagtaggatttgtatctttaacaggcgaatcgtcgaagtccaggaaacgactctgttcgcgctctcttttgacattcatgccattcccattgttgaagctgtagctgctatacgaaggaaagacagatatggagtcataaatgtcctcgaccttactcgccgtatgtgccggaggcgaaggaggtacttcaataatctcgacatcgcttccgtcagaagcaggacctgctgttgtcgagacttgtgcagacctagactccgctttgacagtaggcttaatatcggtctcctcatcagcgagcatgtcatcttcaagagagatcgcatccatgatagactgccctgctttgcttgaaccggctccgctacgggttggcgttatcaagttggcgggtgttctgggagcgggtctccttcgggacgaggaagaagtgacaggcttctggattccgttgcggcccacacggggtgttcgtggtgcaggagaggcaatgctgccggtagtagattttcgtccttttgcactagggacgtccgttattcctcgctcaaaggcctcttgtctgagttgctcagcaagagcgtgacatcgccgcagacgattctgaattgcatcgtacgttgcttcttgaccgaagtaggtggctatggcgtggtaatctagctgggtggtgtgttagtgggatacagtagttaggatggaggtatcgtacctttaggcttggatgggctactatgagagctgcaaagagacggtcggccgactcgggctgtttccaattaaccattgtgttttctttgatgctttgcgtgaagacttcgattgcaaatattctatccagagatgaacatgtacaagatgatttagaattagacttttagtgcgaagcaaaagaggacttagcaaaacgatgctggagattgtgttgaagtaacacacacattgagtctccagacgttcagtgaatgtcaaggcatgatggcccgcctcttttgggaccacagcaatggcagtcagtcaaacaggcgactgagcgacaggtcagaaatctggcttgcggactacacagactctgagaattagtgacttgacttttattgagctgacaggctatattccacagattcaagagaagggagaagtacctctccgtcattttctgtggaagactgtggagcattccacaagaatctgtggacagaagagggaaatgactttggtccggctgagaaggaatctgttcgctgcccacggagttgatgtgtagattccacaagaggggaagggaagccaactggctacactaaatccccactacagcaccagatcggatcagtcatttggaacagtcgatagaacagattttgctctgaaacaaatctgcatctgatccacagccgggttttcggggaagtatccatgccgtatccgctgcagccagagaaaaagccaagtgggtaagcacatgcaggaacatccaccccgatgacagggatcgtctgtccagactgacaggagatctgcatcaccggttctagcatacatacaggattcttcgcgaattcaagtgcgtagcatacaccagatagaacccgacacctaccgatgctgaagataccatagacatctctgcagtaaacagcaagtaacatattcatgatcaggttcttgggcgacgtcgcttcgggatcgttagtgactgtaggaacagcagctattcactatagagcagtgaacacaggaagaaatgtattttcacatactctgagctgctttctaccccttccatttcttgtagactgttcttgtctcttgtcaagtttccttccttctcttgaccttcctctttcttctatactcattctgtttctgcgaataagtctctctactacaacaccttctctattctacttttgcaagaaacatcgcagcttctctgtacatgcttcgaaccttatctgcacgaggaagaagcaaccatgaagtggactcctgagaaagatcaactggtatgtctcttcctacacaacaccaccgcgtatctacactgcgtgcacttttacacgctgcgcacgcagcctatatgatctacataacctacaccatctatactattttcaactacctactcaacacaccaaaccctccccaaacccaacctaacactacaccccccaccatcctccccaccctacctacctacctaccaacaacaacaacaactactacacaactaacccacaaacccagctcctcctcaaaatcctcgaaacccactccctctccgtcgacgccaaacgcgtagccgaagcatggcgtaagtccccccctccacccctcagctacccacaatatcttcctaccaagcaagcaagcacaaattaacatcaataaaccagctaaatccctcggcccggatatgcccaccccccgcgctatctccgagcgcctcgttcgcatgcgaaacactgcccgggagtccggcggcgaaaacggccacttctccatcggaaaggggctcaagaacggcagtccaatggccaaatcaaccaccaatgtcgcctccagccctgcttctgtctctatacctcagacgctgcgcatcagtaatgccaggaaggggttttctatgaagagaaagcgcgatgacgatgatgagcttgatgaggatagagaagagggggagtatacgcctacccctatcaaggtgaagagtgatggtggtagtgatactgagattgagattgggttggagacgcctagcaagaccgtgaaggggaagggtgtgagcatgaggtccactgctcagctgaagaaggaggtgattgatttggaaagcgaggcggatgtggcccccgtgaagcgtgtccggaaggccagttcgcttgcgcctggaatggtggagtggaaggatgaagaggatgacggggagggggagagctcggcgagtgagtatgtgccgaagggggagggagagggggcgggagttgatagtggtgaagagtttgatgatggtgatttgtacgatgcttagtcttttcctaggttgttgatgatgatatgatctgatgtgtggatgggcggcgggaataggttgattatggtgttgcagtgattttgctttccatatcatgtactttaagcaccctaatacccaatacgaggtgaaatttgtgaatgaaaagctcatctccattgcaatagaccggatacgacttatcctaaggtagaaacaccacccgaactcaacgccctttccatcccaagcaaccagcatttagcaaaagtaaaagaaaacaaataaccacgatccataaaacgagcaagttacctaaccatcaactcccaaaccaaccaacccatgcaactgactacaacccgttaataaaaagaagagagccacaagtaagggaaaagaacaccaccatcaagattcatcctcacccttcacaacaggactctcctcgaccccctcaccaccagcctcaggaatctcaggaacaccaggttcggaaagctcatcatcactagaatcctccttcttaacaatcgcagcagcagtagcagccttcttagcccgcttagccttcggcttcttagcagtcgaagcagcaggagcagccgcgggagtagtactagcttcaccacccccagtagcggggttcttacggggccgaccacgctttctcttctcaggtgtagcaggggtggaattggtgggagtctcattgccgggagacgtcatggtagtggtagtgcccggtgaagaagcggtgccgccgggagtagtggaagtgctgctggtgggggcaacagcgactttgtccttgaggcgctggatacggtgctggacggcggagacggtgcagcctggatgggtgtgttagtgttggtgtttattatggattgatgggtggatggtttgggggaagacataccgggacccataaatttggctaaggcgtgcatatcgagtttcacgtttgtagtggtcaaaatgccgaccaggagctgggaggggatatgttaggttgtgttgggctgcatttgggggagaggagggtggaagggacgtactctggcatcagtggtttcgttccatgtcatgggcattttggtggcttggatgcggtaaacttgagatttcttgtgacgtgtgaaggtggtagaggaagagtaaagaattagagtatagtaagggaaggaacagatagaaagcgataaagtaaggtagggaaagaatttgtggttgagggagcgagaaggaagaaagtggaaaagaagaaggaggggatgtagagagccaaggaagtgttctacttcagcaggcttgtgggctgaagtgggggtgactcaatttgagatttttattcacttggactatcaccggtttcaggactcattttctactcctcgaggctgaattgaatgtttttcggtgtttgtgggagattgagaatgctatgcgtggctttagattgttgggatgtcattactatggatactggttgagccatgacgctgtggtatcatcaaaacataaggagaaatgaaaagagaacggcacagaaaaaatcaaggttctcagcttgccttctcgaaaatgaatttgttgtactccgctggatgataggatgagaaatagtcgttatatcgtagctcctcccggctcttctgagccgttttcaaattgtcaaactggcggaaaagtcggccaagggtcacatacagctcgcagtacgcaagcctacagaagtcagtacagctcaatttcacatgtgaggtgacatacggcatcccgatacattgtctagaccccttgccgaaagagaacaagtacttctcgagagacttgctcattactggatcagtccatcggtttgggtcaaatgtttccgacttgggaaaaagctcttcgttatgatgcattgtccacgagctcatgctaacaacagtctagaaatatgttagcgaagttgacaatgatggtgccatgcttgttgcataccccaggaggaacatgatagccattgaactcagcgccgacgtcagggacgactcgaggaagtctaccaggaactccacacgataacctgtatacaagtgagcgaatgttacttctggttcctttggaataacatggaatcaccttagagcctccttaataacagcggtctttcaacgttagctcatgggtatctcaatgggagtaattcagaagcataccaagtatggcaacctctccaaagccacaaagtcaatttgcgcttctgaatcagggaacgcctgcttcagctcctccgttaagcgcttatagattttggcatttcgcacgacgttgtaggcagcaatggtcaacgcatttccggttgtgtctgcggctgcagccagcatgatataggcctcatcttccagctcctccaccgtaggcaccacatgaccttcggcagcctctgggtgaagaagctggtgaaagatagttgtccggctccctttctcaccccgatcgacagcgtccttcactttcaatatttggcgacgagaaccctagaagacgtcagccagtggagacaaaccagagacgaatgacatacttcacgatgcagcaccatcctcgtcaagggctcacttgtcaacttagccagccagaatggcgtgccaagcgaaagcccctgtatagccggaaattgttgaaaaaaccaaaatgccggaccgaaacctcggatcatctcaaagaactcagccccgaagttctttttaccgagaaagccgtaacaattcccaaaggcgtagtcactgatgacatccacggagatagctcgaaaggcatgatgcaggtcaatacagcccgtcgagctgaaagactccctcatgcgcctgaccagcttatctgccttgtcctgcacgatatcctccagttcaagcacctttttgcgcgaaaagaaggggttcaaggccgatcgcttgactcgatgtacgtcggggcttggtgccgtaaaggtggccttgtgggtgccgaacgcgccatagaactgaggatccttgccataccgtgaccctatgtagtagatcttctcgcaattttcagggtcgctgaggtggatctcgtcaggtgtgatgcggacaacggagcctaggctgcttaaataactgttgcgcgaacaggagagaatcaaccgtatcacatgacacagtgaacataccatattgctcatgcagcttctgaacctggagatagaaggatccaccttgcatattataccaaaaggcatacagatgcgtggcccgagccagaagtgggcccggtagatgggccagggggtggaagaacagtcgatacgcgatcgtccagacgcatcgcagaaggagcacgatggacaggacagacaccgtgagtaataatacatggactgaaatcatggtgggcagacggactgaatcaagcctcgcataggaccctggagggagaaaggtgaacacccctgtcagagagatcttcccagtgctttaaatggaagataccgggggatgagtaactctattacccttcgatgccacgcgagtcttaccaagcctgaataatgatgacaatcatcagagggtcctacctcatacgggaatgaacgagcagaccccgcaaggggggctagcctggatgggaatgggtgagcagtcagttgggatagaaagacgagcaagacggactactacggagtagaaagatggcatcaagtcatgcgctgctcaggcctcggcaatagacttctctgtggcaggtcccagcatcctcactcgcctcggaatcccttccggtgcgagaaatgggctcactccagcacagcatacgttcagcatacatgaggtagggacaacaggtcatacatcatcctccggttgccttctgcagtgcagccagcaaaaagcaatggacccagtggtctggtccgaattcccggctgcaggattgcagaatgtcccggagaaaagggtcattctaggctcctggcgagggattgacattcttcagacctgtcatgggctgagcaatcccaaggtcccatctcgaattgtctgtgggctattacactcggccgttactgctaacggtcgtttttagttggattagcggcgtacgcgaccagtgcgcgtggtccaagtggccgggcctgacccacggcgagcgatgacaatgacaccagagacaagggggcgaaaagacgagaatggtaagagaggcattcagcataatgagaacgcaatagtacgatggaaaccgaccgggcgggtcggaggtcaatccgcgtcccgttctttctgcagaagttcccaatagacgtgccatgactggtcaatgggtcctatttccgggtggagctcgaatttgatcctgctattttgcggccttccaggaagatcgtcgtctgaccatcgccaggatgtcaatgcccctacggtgtatggtatggttgcaggtttgcagaaaagagagcactggtggatgggatgcacgaggcgaccagccaggcagactgtgggagaaacaaggaaggccacctaactaagactgctctactcggggaaataatatcgtcatcatcagacgatggttagcattttcgtgcacccaagggactgtccggtaaccgtgcagaaccataaaatcataattggggtacaactgcaatcattggatgttctccagctacaccggctgccgtcatccccggtcgcctccactatccaagctcccgacggccaatcgaacacgcgtgtagcgcatctttagcaggacactagcctctcaagtccacattaaacccaagcattcccggccgccccgacctttcatgacgggggacgtcgagccccgattggcacacctctgccaggctagtcctgtctgcttgcagtagtcggctgcgcaatgcattttgtcggttcttattccgtcagccgtgccgcagtgcacttcgtccccaaactctaataggcacttgtaggcttttgtccatataccccgaccctgttataacccagatgggaacaatcctaagttagcttcgtgctcgtccagtctagaacgttaaacacgacagtgtcttacacgttgaagtatgcgtgagtgttcggatcacggaggccttttcgcatctgggcgaggaagacctgcacttcggcatagctccactaaattcagtaaggattgtcctgtcagcccgtgtccgactggctgctgccaagagtgggtggtgcgcaacgcagatacgaggtataacgctctcagacacacacacacacccaaagaagaaagcatgcttatgtcctataccatcgaattgcaaatggagaaaaggtggacttacccccatgactcgggtcagcagcgccatggcccatccctcaataccctgctcgcaatgaaccaggttccacatgcctagtttcttcagcttcttgtctcgactccactggccgacaggcaacttcattcggtgttccgtcacgttgtggaatccagcctgctgcatatagcccttagcaagatcagctatgcggaaggttttgccaaacttctcgcccgcctcaatgaaggtcttcgaccagattgccagaacatgatcgtctgtcaccgttccatcatccgatcggaattgtatagacatctcgagttgatcaaaccagcccccaggccgcaagcgactagaaaagggattagggccggaacgtgcaacaaagaatctcattgagggactcacctgagaacgttctgatagaatgcgggccagtccgcgatcgcgccatacagtgcacgaacgtggatcagatcgaaatggttctccggatagacccagtcttccgtcgcgtcgtcgatctcaaactgtaggttaggtgggacaaaaccaggctgtatgggtgacagatcggtcccaatgacttgtgctgaaggatactcgtctgcgaagtcgctgttcataagaagtcagattgctgaaatgtgcccatcttacacttgcttcttactcacatggcccagatcccagtgccagtgccgacatccagcgctctctgtcaagttgggacctcagcgttggccacgattgtaaatgttgtagttgtgttacagtatacatacctgtatattgtcgctgatcggcgcgagtagtagtttaccatcgagaagcaaagtaaacatatgatgactgacaccagcattagcctgcgcatcaagagcgattccagggagcatacgcaatatctagttgctcattttgcgtttcgtcattaggtcccctgcaacttgattagggtaatgcgcacaccgaagccactagatgatatagtcataccaataagccccttctttgtaggcgtggtaacgtcgtccattctcaaatcggtatgaagtgatttcagagttcaaggatgttgtatcgctcgcgctaagcgctgtaagcatgagggattgattgcgagggcgattgataaacttacaaatcctctgcgtagtccgagaattcttcttcaggctctgcctcgtcctggtgagacaaagtcagccgacgcttggagaaggcgaaggtcggcaaccagtggtaagcagcgtactgagtccgaagattcaccatcatgaggccccgcgacgggcgcagcgccctgggatacattttgtggagccgaagccaaagatgaggtgggctgtgggggttcattagcggcagccccttgagaatcgggggtggaaaaggattccgccatggggtcgaattttcgggaagctcgtagcgaagttgaagatcaaacagctggggaaaaggatatcctctaaggttaaaatggggcaaacccaagcgaaaaggtcgtgtgtatcgagagagatggatgacgttcgatcggggccgactttctgattccttcgctgtcagatttgttccttttaaaagagaggggggtttcccgcttcccgattcgtggcgagctgcaactagctgaggtggtactattagattagactaccactttaaggtattgggctgccttctcccagttttcccccttggaaggagtcgtcactatagtagctcaagactattttctccctagcaaagctgatcgttcttcgccactcgtattttgttagcgggcatcgaatgcagattaagctgcggatagaacgaaagacagagtttcgagccttcgcacgttttgacgtctatcgaatccacgcgtgggtggggactgaaatgtgggctgatcaaaggacttttcgcagtttactggtgtaagcccagatgcacgcgattcagggaaattctctgtacttccggaagtcctcggcgatgcatgaacaacgatgcaaaggatctctctttcgcttagctcatgggtcaacccccacttaatgtccgtcaatcgacaacgtgtaagcgtgtacagactacagagtgctcctggaatctcttgttcataaagttactcgtgcgcagtttcccctgtataaagatcgcattataaaagtaccagaacatcccgcgacgttgtctcttactggtcattacagttacctagaaacctgccggctttttagccgcataatcaggtgtgtcacaagtacctgggacgcctattgttctcctcaatcatcgaatagtacgatataaatacaatctcgagtttaaagtgcggtgcgaaagcttttctagcacccggtatggcccgtgcatgcagccggcacttcctttcttgcttggttggaagtacccagataacccgtcaaggaccagagtactagattcccagtaaatggtcataaagtctcttcagtagaaagcggcttgttaatcatactagatgccgtacatgagatcaagaggcgaagattgtgcgccagctcgtacatcttgatacattcataatatgatttccttcccatttgttcctatcgtctgcccttgctataactatatgagatgctttatggcctctatctgtatcttggcaatgccgaggttgtatccttgccacaagtatccgacatccgataatgttataatcgaacttgtatctgataggcctgaggacggagatgagcgtcgatgaggcaattgactaaatcaccgtggaaggtctggtccggtatgcaatgcaacaaggctcagtggatgtccacacaaaagtaccttactattttttgcagcagagacagtatatcttcctcgagaagagggaaggggggacgacatgagacaaacaacggcggttatcagaggtactgaggctttcgtgggatgatagctaggaagctgcgcccgatattcatgatgacggggatggttatttctagcaatgatgagctgttccagatcctgtcttaccaacgtctgactggtatttctgtcaaagcaacggcgaagtaaaccaattagtgtcaaaaaattattggcgtatgcttcttccagtgtctgcgtactattgagagttgctgttcagacatgatggtgctgttcattaagggatcccgcaacggcactgtgcatatgatcgatcctgtttgcagtgggaagcctcacccgcatctttgtttactttcttctcctccgctccaccccctgaaatacttcatggacgccaatgctgcaagaaacttgagcatacttgtaattatccatttcgaactcttcctcacgatcacaattgcctaatgatccaaatatgcggtcccgaatgtttctcgacgatgtggcctgggaacaagccgaggaagtatcagacaattggctgctccaattcctcaatcatgacatcttaagaccgatcggatatttcatgcttgatcagaattgaggtaagggtactaatttaagcatactcgagaaaagctcttataacatatcgctgcgaatagaggatgaacatgtagctaccatcattcgcctatcgcagcccggcgctgcctctttttctggaagagtgtgtcacgaatgaggttgctaccgtgcgatttctcgaggacaagacaacaattcctataccatttgtgtgtcactcgggaacaaagaaatagtgtcccctcgaactgagtccttccataatgatggaccttattgaacatgaaatggaaatgtattacgcgcttaatactcctggatgtccaattgaagaactacgtagagtctatgcgaagcgaaacggccaatcatgtcagggggatgaacagtaagttaccactccatttccatgagatacttgggagtactcggattagcccttgtgtccacgcacaacgcccataatattagctgtgcaatatatgctccactactccgtacattctgtcacatttcccacctcaaccctggcaagatggcttggagaaggttacccggaggggatgcagccgctgacgttgacaaatgccaacaggcctgattgtccccgcttcatggacagacatgaagttgccatggcaggataagaacagggatgtagcaaacaaactagctgcatgatgctgtgcttgacaatggggagacaagaaaccaaacggagcctgacatgcaacacttcggcttcctgcatatggatatccgcgtctcggctggtagtagtaagtccgacgctgctataccgttattggtctttcacaatagatgcagtcgcaagcattcaaagtagcttgccattgaggatatcaggtaacttgctaatatggtaggaatatacttaggtggctgacaggaatggaagaaccgtggttgagggtgcggaagggcgggcccgctcgttggcccgaaccttgttcttgttcttactatgccgcaggttacatcagcttactggcggcactgataaagcaagagaggttgcttgcttcttaggatggagagttatatccattagcagagttggacgatatgacagcttatagaacatctccttcagccctccctactgtatgttagatcttcaaactcgggtgcttcaagatctcaagttgttaacgggttctatcgtgattgtgatggctctgtcactcgtattcaccagaagctcggaaatataggtggtaaataattaactcccgtgtaggttatgcttgaagacaagataatactcatcacaaatggaaggtaagaaccttggtagcagcccttgtaatgaaagccatgtcaagtacggagtagcatccagcccatccattcattgtctgttccgagtcatcccattgatggctgtgcgatgtttggaagaagcgaccggggaggacagaacccgaatgcgattggggagtctctggtctgaaaacaaaagccgcacagaagaggacacatcgacaacggccattattcatctctcactcggtccagatgcgttagctcgcagtcagatatgccgctgagctataagctagttaagctgccagcgggacaaatgtaagccaacagacaccgaaacctctggttttggcctggtcgcttgcgagattcatggcctatgatacagatcaagatcgaatccagtgctaccttgcgcaaagcaaagtgggcattccgatgcaagggaaggccaagcaaacaataaggccacgcaagaggggtaatgtgttcttccgccggggctacggtgaaagacatttcgccccataaacaccgcgccaagaggattcgccaggtcaaacagtctccatagcggggttttcctgggataagccacaccacaggtttcgatctgctgatggtagagcgttgccagccaacggtctcccgtacactcttttcccggaattattctgcctaaggcactcagccctgtcaggggcatttctaacttcttggccagcaagacaagagattcgaaacacagccactccgcccggaatcgctcagcctagaaaacgggaatgttgtcaatcagccttatgtcattatctcggctctgtctcactcgccaagggattatcccgtggggcgtcgttgcgcccagtgactgtcagcccaacagaagcccatggatgcatctgcgaccagccggatccaacagcagccgcaaatgctcatcgatgacaagcatgtcgccattccagattcaacgcacagcgggccatgacatgcaccaagcgccaataccaagactgctgcctaggacgatagggaaacggacgactgaccatggagatggagccctgcctgtggctgagatgaagggggagggaccctttcagggtccaccgctgacctgtctgccaagaagcctcattgagcacgcggagtggggggatcactggccccagagaccaccatgaaacaataattgtcaattcctatggagcaatcagccacaatagtgggaattcaggcgcctgtctggggctagaaacggtgaaccgtcaaatcaccgttcatggtgcttcactccataccggggttgttgcattgcattcccctatcccaagaagcccccacgaaaatagcctacctactcttaccaggttgtcgacaatcaatcaatgaatgctcaagccactggcaaatgacctgaggccaagtgtatgatatccatgctcaggatctcttggtgactgcgaagagccgactccactgaggcataacgaggtatataaacccccccttcatcccctcttgccctccatcaacaaacccaaccacaaccacaaagcaatcaatctcattatacaaccacttttcctccattccctcataacctctttcacaactccatcacaatgagcttcttccgtaccgcctcagacatccgcgttgacgacggccacatcctggtcgccaacgtcgccaacgaggagggagagatggtcgaatctaccctcgatcttaactcgtgcatcggaaacgaagagggtatgtgatccgttagcaagctaccagagcgtagccatcttctacttagattatggccaagctaaccatctacacctaacaggtcgcttcctgtggggcggcaacgacttcgccggcagcgccgaggacatcagcttcgccattgagggagaggacaacgtccccgttcttagagccagactccaaaactccgagggcgaactctttgatgctgatgttaacctgggcgagcacgtcaccaacaacaatggtaccctggagtaccaggaggagtcgctgttgtaagggcggggtgtattatcgagtgtatcatgacagacaagtaaccatgtcttgataagtttatgtggaactatatgaaataccatttcgtttgaacaagtagcatgctcctatcccagattaatctccttaattctaccgcttcggttgaacttcgtctaatgttgtcaagattgccagcataagatacaaaatagagatggtatttttaaaattgcgaaacagccaactcacagtccctatgtccacgctatagaataaactccccattcccgaaaatcaaccttttatcgatcccgaacaccttgaccagattacccagtgtgtatcatgtaagatcaaaagggacaaactagatgaagcacaaacacacgccagcgggtcaaaaaagttaaggctaccacgcatgtctcccatcattgacttccaggtcattcccattccagtcctcatcgccactgagctcatcgtcgagaaaatccccctcattgtattgtgtctcggatggacgctgattgtcaatgcggaccatcaccacatcgcacatgccttggatcatagtcgatggtatgtcgctgatctcccgggattcttgcctctctgccttttcggtttcatcatcaccggtctcggagaatttcctcagagcaagacgcgcgctcttgcgtttggatggtgttgaaagtccgctatgctgggtatcagaatgtgtatgggtctcctctgcatgtgtatcacgactctgatgggttacgtctgactgtggtacggcgcgaggaatggaacgcagacttgggtccgggggtgggcttcggcgcaggaaagtcttctcgagctttccgatccatttctcgcgaaaggacgcacgatcccgccagccgatctttaggattgcactgattacaagtcgtcgcaaatttcgcagttcagatgccgcatcgatgagcgtcccaaagaagacttcggctgtcgtatcgtcccatttgcgcaactgaatcagctcaatgtcttgcagcgtggacggccaggttggaacaccggttgacaggtctagaagagtatgaaagtggggttcgacgtcatgataactcgaggcatcatacatggatatatccatgcggaacttctcgagatttttgcaggactctgcgagattcacagcgaaggctaagcttagatggcggttatgtctcaaatctaaaatctgaagatcatgaccatgtgagaagagaaatgggccaagattcatcgcagtgaccgcgtcgcagttgttaatggtgagcgaagtaagtcccatcggtaagttgggtaagaggtactcgtttacaatggaacattgcacaaagtctaagcgacgcagctctgggagttctcgtagggttgtcgcaagaaccacttcgttttcatcggagcccagctcatcaccatccgcatcctccgacgttatgtgcaacaatcgaagctcctggagtctatggaatgcgggctgcaagtgtttctctagcatgatgggcagcaactgtctggtctccatgaagcgactgttccactcccaacaccgcagttgtattgaactggagactaatgatgtaaagagagagtccgggtatgtccatcttgaccgtgggttcagccagggggagccgcccaggaagtaatcttctttatgatagagacgcagcgttttgacctgaggggttcgttcaattagccttgacaactcaaaatagcccagggtcggtccgcttttgtagaatagaagactctcgacgtcaacgtgcagttctttgaccttgctaacgtagttagtggaaagagagtcctggggcttagccaacagctgtagcaagccatgggccttggctgctggcaaaagaggagggctatgatagagcgccgccagcgcaggttcatgaaacgcatgacacatcaaagcaatattcacgagccattggacagagctatgcctgttcgcggtcttttcatccattagtgggctcgatgcgcaggaaaatatgtcaaagaggatgtggtatgggagagtttgccatggtggaataacccccgaagtaacaatcggcgtactatcctcctcaacctttctacgttttttgagcggtcggcccagctcgattcgtctccgacccgtccgcttttccactttctttgtctgggagcgtgttttcacggttcgattacgcggggctcgagatggcgcagaacgactgttcgtctcagtatacggataagtaagatgctcaggggcatcaatcgtagggactacagcttccggctcatcattcgttgcatcaaagtcatcgtcagtggattcctcacggtaggatgtgggcacacgagctgagttgcgggggcgcaatgaaagcgacaagcgcctcgctcgttcctcgtccgactgggtatcctcgtcatcacgaccttcggagctgctttcttcatggtaggattggacttgagtgcgactggaacggatgggacgagacgatctcgatcgcggagccatggcggcacgagtgaattgatgtaataatactaggcggtgtgggagagcactgggagtggcagacggcacaggagctgttgctgctagtgcggctgctactaagctccaggtggtgtgaggtagacgagatgcaagggagaggatcgcatttcatctggaaagagctcgacctaaaataagaggagaggaagtgaggaagccagaagaaaaagggaaacgagagagagaagaggaagaagaaattgtaaagagggataggttgttgtagaaggaggaggaagaggaggcgagttacggaggagtagtaagtagggaaaggaaagaatgatgtcggcgttccaggtccatcgcagcttcccagttggggaaggcggaaaggcggacaggcgggaggcgggaggcattatcgataaggggggagtcgggggattcactacgcctgaagtagactagcgggggagacatgtgacgagtgtgacgggcgtgacagggccaggcatcaagttcccccgccctgaggccacaacactagactataacaggcatcgcagcgtaggcctgaagtcccgaaatagaaacaagtcaagtcagctcctcccaatcgagttatcaccggctttctttaaagcgccgccgtcggccagccaccttctcctctttttctcctcccccttccatttggcgcctggcgacaatgctctgtcggtcgaaccttcgtcgccgtcgtcgtggattgatgcttccaatcccgagcgggtatcatctttgcttgttctgactcttgcgagccaaaccctcccccgaactcccctaaaccattgattgatttccatgcgcactactcgtcattgggctggtccctaattttacccgtgcggtttgcgatctgatagggtcttacgacgtcggcgcgtgctggaaagaagatctgccctatctcatctctctcattgagtcaaaagctaaaatcccatatgatactactcctccaccttccctcctatccttattattctgattatcattatcattatcattactacttcctgtgtttatcattgcaccaacgtttctttattgaatatatagaatcgctttcgatccggcgacttttctctccctttttcccttttcttgttcacataatcaaagtgtttgctgttggcttgtttcttgttccaaaacaatcatcaagatggaaccgtcatttcccaacgtgatgaaccaacctgtgccgccggaacggactgaattagggcctccgcccatggtcatccaacagtacgcaaggtatcctccggctctggagcctggtttacatagcgcttcttccataggcagtgctcgcactcacatagctccctccaaatcccctcctctggcgcgcaaagctaccccgcgcagtcttcaggcatcgccaaccggcccacggcccatagcgccgcctccacctccacctccaccaccacctgcaatggtggcgcactctggaccttcgatctcacctccgatgtatgattctattcgtccccggcctccacgggactcgatggatcagactgaaacccgatccctgccttctcgcgatttgactgacagctccatcgatgatgcctacatcatgtttgtcttctactgcaatccaaacgtccctctgtccgtggatacctcagagctccgcaagaactttcgctgcccacctcggagtgatggcaagagtttcagtatattcgcactgtgggagcttattcggaagctagacagcaaagagctaaagacatggatacaactggcgatcgagctgggggtagaaccgccttcattagagaagaaacagagtacccaaaaggtccagcaatatgctgttcggctcaaggtttgtcgctaatcccattccagactgcatgtttaactagaagactaacgaatacctagcgctggatgcgcgcaatgcatgtggatgccttcttcgagtattgtctcggtcatccgcatccctactacacccatcttccgcctgctaatgtgatcagcgacagccgcgatggagtgcctcttgaagaagatcttgcgctacgggctctggttccgcaatggaggccgaaaaggggacggaaacgagctgaggaagaaaacgaaagactagccatggcgaaaaggccccatctcgatccaacaatgggcgtcctgcagccagggccattcccaggccctccaggaccatacccaccaggtgccctgccatttagcacctttcctgacgagatggggtcgcatgatccgtggatgggcagcgcacctccattcccaccggaagggacgactgaaccttcgtcgcagtctaacccggacctgcggtggcgacctatcgaacgagatgcttccccagggggttatccgcattctgctatagcacctagaagccagcatgagtctgatgtcttcatccagcctgcagaaccgcgctcagcggtcacaatgtcttcttccggggagaagacgcggcctaaacgacgccatggcccagcagtgtcatctgcctggccgagcaacactggcagtaatggaaagacccgaggccggccaccaaatcgagggactgtttctggacctttctcttcgttcccagtcaatcccaatcgcactgatgcatctcatttaccgggcccagggcttcggtcttcccctgctatgctcctggatcaggaccctgccagtcgttacaatcattctcctttccagcagtcccctacgccgttccatttcggtcccaagccagataaattacagctccaggtaccaccccaccccggcacacctgtccgtctggcaacccctcctaccctgatggtcaatggtatcaacaatgctcctggctcaacaaagatggaagggcagggaacgcagcgtaatggcacccttgctcctctaaacgacttcatgagtaatgtgggcgtcaccaacccatctgcttacgcaaaccgcaatagcgtaccacatgcggatatatcttccgatgacgttgtacgtgtactgtcaagcgaacttcttcgtggaaagaccaccggtcggtctgctcccctcagcactgaagaggcccgggctcttgcaatgtctgtagtgtccagcttgaccactacatatgcaaagctaccagccggcttggcggcgcttatgtccgccttacatctgggacttggacagcaatttggctatccaggagtgacagacagcctgatgaccgtaaatgtcgagtcagggcctgccataacctcagacacgccaagcaccgatggaagccccaactatgtgtacaccatttctcatgagtacaagcacggacttcggttttcgaccaaagtcacatacggcgacctcagcattagcactcccactccggacagccacaagctcgaccttacgccccgggtaaccgaggaacttgaagccagcatagcagaagccgacagcatgacagatgctgaattcgaagtggatgcggaggattccacccccgacgcaacgtggaaacaaagatatctcaaactccgagcgcaggtgcagcgaaaggagcgaatgttgtcgcaatataagcgcaaaatcctagagtctgtgatggcagacatatagagatgattcgcggctctgtgagcactggtcgttcacagcgagtcagactcttaatcatctcctaacaaatcccctcctcctccccgacttgttgtgataccctatacagtatattctcatatcaatggtcgagtctcacctggacacatttataaaacttcatttcttctgctcttggttgtctgtctgtttgtctgtgggctggagccaaatggcgctctcctgctgtttgttggtttcggttcggtcttctttacagataccccttgagcgaacttgttcgatctgcttcagagcctgttaattagtatagagtctattgataccatcaaatgcttgattcatatctgcagtacctgaagccctatgcaaatcccagagtccatcaaagtcgcctgtcggagtatcgtatgatacaatatccatcccttatcgcccaacctagtagaacgcaagcaagcaagcaaaaatcagaacgcatcaaacttccgtctgccccatctatggtcaaccagaaactcatcctcctccaacggcaaattgcataacccagcccaccaactatggaatccagaggaatccaaagcaaagacctcaaacctcattcacctccaccccctcctcatcatccccagcctcctccttcacagccaaccccccaccaacaccagaaagcccctcttcctccaatgccgccctcatctcctcatcctcctcagtctcctcctcatcatcatcaacaccttcctccttcttaattccaacaccggcatgctgcttcttctgcatcaaactctccgcccgagcgacagccatcttcttcaaccccttcgctttcttcgatgcatcgctgatgccatcggccttgcgctttcgcgaggtcggagttgtgctccctgcggcggcagtactactagcagtggtagtagctgttcccggtcgtttcttggcaggcgtgttgttagaggaggaggggagtgagccactgcctgaggtgttgatgccgtgggacttcaggaggcgttcgtagcgctttgctctggttatgggtagcatgattagtaccatattatgttagggttggcgcagtagtgtaagttactgttcgtggcttcttgggtactagtaggtgatatataagatcgaaggtggggggtgaacgtacgcagcggctttggtgacgatactgcattctttggcgacggtggtgaagtcgatctatttggttgttagggtgagtttctttgtttggagagaataggatagaaggggacttaccttgccgctgttggagtggcgaatgcagctgaggaggaaatgaagctgctcgtcaggggtgatgcgtgtgggcttggtcggggtagttgtggtggacatgttgggctgggttttatttcagcttttgagtctgattgtaaaagggatgtgggtgtgagtagatgtaggtgaaaatcctctctcgtttcttgtgattgtggactcggtagagtattaggcaggccgatcgggtgaacaggtgtgaaagatggaaagaggggtgagattagggagggatagagtaaggatttggaagaaaggaggaagacggaagagagcgagaagaagaagaagaagaagaagaagatgggagggcagtaacactgagatgggctgagggctgaggggatgttagtggagtcactgctggcttcgcttagggttcttgtgaatgagtctgggtatctcaaattgggggatgaagaagtgaaggatcgatctctagagaacagtgatgtgatactacgctctggcacttctgtacagctacaatggagtggacaagtcagtaggctaattctcccattcagcagatatctagtgctctgatactgcacaactcatcccaatgctgttcaagatctgttaagaagaaaccagaaatcattggagtaaacttccccgcccaactaacaacacaagccctgcaaagtggatagaaaatacaaaatgcgtgaacctccagtccttccagataaattctcctcttattccttgcggtgaaacgaccttccacgacagggtggaccaaatcaagacaagttaccgagcattaggtatagactcggatttctaagatccttccaagcgttgagcagaatcacgaattgtagttcaagccgtagcactttccatgccagcatctggggtattgtcttcgatgagagtgtccgcatcgtcctcctcttcctccttcacagcaacagcagatttagctccgcgcttgcggcccttgacctctgatttgagcgtaccagtggcaggaatgggcttcgaagtagcctttgctcccttacgcgtggcgacctttctacccttgggcttgacgggagaaggctcgtcgatatcagattcctcattgacgccatcgccggcctcagtagtgccagtagcttctttatccttgtctccattggtacctgcgctcttgagtataccagagccggacttggcctcaagattgttcatgccgtagcgcttgcggagggaacggaaacggttgccgacagaagcaacattgctgtaacccagcatatctccaaccttggtaagatcgatctggagagaagaagggcatattagtagagtcgatatgtgcgaccagaggtcatattacctgcttgtcgtcccccatgcattgcaaacaggcaaggaagaaatgcgcgtctgcattagggatttccagaccggtattatttgacttcgcggcctttgacttagtagtcttatccatagcgaaggttagaaaatttagttgtctagatggcagggtgtagagaagttgtagaacagatgacttggttatgagaagtgagtaagagtgaacggtctaatcggtgagatggagaggagatgaaaagggaacgttcaggtggtgaaggacagagacaagtgagacgttgagccacaggtccccactatataaacacgtcaaaatgtgagagtcctcaccgaacagttcgctgctatttcaggttaatcggcgagaccaacttctggtccactctctcagtatagctggtaggatttgtttgtgatagcgtaagggaaaagtgaagccagtaataaagtgttatgcaccattgatcagaagactaccgcgcagctaaagaagaacttcataagcaaaagcaatgtcatatttctgctaccagaatagttctagctaaggaacagtggtcctcgtgaccggttgtcgaagccagcaacaaccctccagaaaacccgcttccggttcccacaaggaccgagttctacctgccagtgtctatcgtagttgcagaagccaggatcttgacttgtatccgtcagtcctcaatgacagtaatctccgacttcttctccgatagttcctccttgatttccctatccacacccttgcctttgtcgaccggttcatctttcacctcgtctaatctcttctcctcgtcttctggctcgaacttaaaggcctcccaatcaacagaagccatagccgatggcaagtactgctgctcgtgctgctgctgctgctgctgctgatagctacctgcatagcccatcggcatgtacatgttatattcatccatactgtatctgtgcggatagtagtatccccacggataccccatgggggtgacgaacgaacccgcctgcatagcatgaggaggagcgagaggaatatctgccatacgaaccatcgtatcatcgtaactttcctccttgacctcctctttaatggggacgaggggttcaaagtcagggtaagaggtcaccggcactatcgtggtccttgccctactggaacttgctctggctgcccttctggtctcagctctcttaggacgcgccactttctggctagacccttgattctccagctgccctttgagccgcgagtaccgcattcttgcagcatgcccattggagatattcagctgcgaggcaaccaaggcccagtcgatctgcttagtagtcagctactatcactgtattccagctgttcatgcacaaaccgttctcaaatccaactgtttcataatggtgtacaagaactttacagccggctcatcaactgacatgatggacttggtgcgtctatagttggacgcggtggacgtagccgatgatggattcgttggagaggcgaaatcattctcggcttgatgatccatgggtaggtcgggcttcatagtacctgtataccagaagcattcatgtcagaaagaacaatacaaaaggggatataacaggaggggacataccagaagcactgggcttgacggtggttttggtaggagttgggctccggctttccatcacctcaactactccaatgtatgtgtgtcctgtgcaagcacaatggaatatgaagtgctcacagtacgagaaagatgttggaggtgaatgatgggagatggaagaacatggatttggacctgatacttataggcctaatttccagttccggaataacgttcagtatctcctttgtgagtgaatccaggtactgtatgcatgctttccgtgagggctccactttgtttccgacaataacagtgtatgcgcagctaggtattgcctccatgtagatgcctagcgtcctgttcctgttaatatccttgaatacagggcctgattggtgctactcacccgtgcacgcgggatagtgaatcagactgctggtgcaggattggtatactgagggcagctcaccagaaaacaaagcagaggctggttctagatgcaatctagacaattagtgcagtaaaacagagtatgctcggcagtctagccatggtctgtaaatacagcgtaggtgttgagtccaggtttaccctccggattaggcttgcagtgccagctactattggtacagtaagaaaaaaatcatgttcaaggaataaaatgttcaactcgacatactaggccattgggagtgtacatcgtgtgaaattttattacatactactagtatcttagttgtatttgatcgagacggttggcagaatatatactagcaatatagtaatatacacaccagccaagaagtataacgcgtagaaaataattcatagtaccctgtatgtggtcctatcttgctgttgtgggaatatcatctctaagcactgagcctcctgtcactttcatgcataacatgtttagatgcgtatagtaggaccgacattaggtttgattaatcgatgtaggcacagatagctgcaggagaatttccatagtgaataaagcatactaatgtcctgaaaacgtccttctgcctgtaagcaaaagtggatattttacctttccatgaaacaccaatcacaccaaaatgattagcaggtagtatcgatgtctcatgttatttttatctgtcaattacttacggaagatgccgtggttaattgcatatcagcgtggctctctccgcgacaactagtcactaccagtatctctcgatggtagaagccgtccagagtacggttgtttccatttattttcattatacatggtgaatgctcacagggaagattcaaacctactgcctgtgtccttgttgtctgttcaaccgtgttctccgactgtttactcgatcgtggatctccaacttcagcgatgatgtcgacagtgggtcctgactaatcccaccaccacattacccctctcggcatacaagttgcagcagatattcagcttcagtatatcattcctctttgtaggaatcatcaagtaaacaagatgtcattggtcgcaataggtgcatgctatctggatacaatcctaacgttggttggcgcctctactcctagttcccaccatttcagtaactcattctttgtattagaaccccccactacccaggagaagatgagaagctacgggcttcgagtatctcccatcgacggggaggtaattgcccaaactctctggaagttctaaagcagttgacaacgaacagtccgtcaactgccaatgtctccctgaaccttattgctgtcctacctgcgaagacatctactgcttcccaggagatccagtcggcattcaaaccgcacgttaacctatctcattgtatctttcgagaggccttcaatgagcccgcctcaagctacatcattaaaagcgaatcgtctggcagtcggaccattgtcaactacaatgaactgcctgagatcacggtagacgagtttacccagattgcaggcaatctcaccaacccatcctggttccactttgaggtttgtcacgatgctttttacactcatgatgcattcttcaggagctaacaacttcgtccccagggtcggatacctgatataactctatcatgtatccaatatctccgtcaacagtacccatccgcgactatcagcgtcgaggttgagaagcctgggcgtgagggtctgcaaaacctcgcagcggaagccgacatcgtgttctactcgaagagctgggctcaagtaagggttacttgggcaatctacatcgtgtatctctctgaccactgacttgcagggcaacggataccaaactgctgaagagtgtgttcagaaagaatccacactaacacgaaaagcgtatggtccttgctgtatcctacacgttgaatctatgagtgctgattttaccaggtcgttgctgtgctgcacttggggtcaaggaggtgcagtggcctttgagaccaagacacagagtctggttcatagtcctgcatactctgcagcaaactttcgagtcatcgagtaagtccaccaacaatttcccctcctcgtgatttctggttgtgccacatccggtaattactgtattcgaacggcccctctaacattgaacaagcccgatcggcgcaggtgatacttttatagccggcatgctatacgcactaatctgtcgaagaaatgaatggagcctatctcagaaattgggctttgcgaatcgacttgctggtatgaaagtctcccaggaaggattttcgggccttgcaagagctttggagtcttttccttagggtcattgtatattattgcagagagccactttcaatgcaaagtactaagtagtagcgaatataaatcatgtagtgaaaatgtattatggtgggatcaagagtaggagagcaagatttattaataatgcagccgctatgcttatcgatgaactgagatcgaccatttaatctgcaagattaactgttcatagagcatagcgcgcatgatatagttcagatgttgaatgctcgttacgtactaataaaatattgtcatgaatacacgtgataaggatctagattcaactgtaggaatatacatatatcacgtgacaatatcttacgcatggggaaggcggtctcagccaaaaattattctgcccgcagctttttctaaatttgcgggcgatcaacagaatcggagtctccaaatcgctacaacccattcaccatggcatccgtttacaagactatctcaaagaaggcagctcgtcagctcgccaaggaggaggagttcgatgaggaggatatcgagatggaggaacttctcgacaacgccgacgacaccaccgacagcgaaagcgatgaagaaactacgaccgaatcggccaagaagcagctcgctcaaggattcatgcccaagactcgtgtactgatgctaacctctcgaggtgtgacataccggtatgcttgatgcccccatccaacatgatatattaacaatgtgcgaatgtgacgctaatcttttctgtttgctgcagccatcgacacctgctcgccgaccttgcgtctctgcttcctcacactcacaaggaaagcaaacttgacaccaagaagaagaccgctggatacaatctgctccttaactctcttgccgaccttcactcctgcaatgtgattttcttcctcgaggctcgtaagcagggtcaggacttgtacctctggcttgctcgtcctcccaatggcccgacgatcaagttccacgtcgccaacttgcacacaatggctgaattgaatgctggattcagcggcaactgcctcaagggtggccgtggtcttgttgttttcgatcgctctttcgacgaacagggtccgctcatgagccaacccggcaacgaataccggggtctgatcagagagatgctgcgcggtgtcttctgtgtccctaagcgtggtgtcaagggcatgaagccattcattgaccgcatcatcggtgtcttcggtgtcgatggcaagatctggattcgagtctacgagatccgcgagtccgaacccggaaagaagtctgaggatggtgcagatgccaagcccactcccaagagcaaggacggtcagccggaggtttctctggtcgagatcggcccccgttttgttcttacgcctattgtcatcctggagggcagctttggcggccctgtcatctatgagaacaaggagtacgtgagcccgaaccaggtccgtcgcgaggtccgcatgagcaaggcggctcgctacgccaagcgcagagatgggcagaccgaccggttcgcgaagcggtcgaacctgggattgggagaaggcgagaggaagccggatgcgctcgacacaaggcaactgttcaagtgatggatttccgttttgttggttctttctgttgttttacgccctattagacttgatatcctcaagggatgtatatgtattgatgcgaggggtacatgcatggtcctgctggcgtctggtgtgaaataataataaaagttttgatgctacggttcactattatcctgattttatggatctaatcatagaataaacgaaccttggacttactactgagtggattagtatcgttgctatgagcctcagcgattggtaataggggaacggtcagtcttccagctctccaaagagtggtgcaacttgcagcaagggaggccacgaactactgggctgtacgttcttgagctataagtatgtcgcaattttgactgaaagaacgaagtagctggtgagccatggcgcatctgcggaggagcgtcggcctggctgaaaagcggaatgatgaagggggatcctgtcaagtgacttggcggcgggtctccctttgcctgccccggatttcctcagcgcagctgcaccctttcgctcgtcatcatggcatccctttcgcaatacagccctgggtggtcgctgggtgctcatgcaccttcttccacaatggcctccactctgtcttgctttcactatgttttgatcacccccaagggcggggtcgcgacctagagttagatcgtgatcgcgacggcgttgactcactacagcgccgcagctacctctgtgccgaagactcgcaattgaaccacataatcttctctccataccttttgacctgattaactgtactaggtacatgtgactatcaaatgaatgtctactggtgtattcgctgacgaccctagatcctttcaaaccactgagccatgcccttccatcaattggccacggagctattgctccatatatttcgctcatgcgaatctgtcgccgatgttatgaatcttgcaatgacttgccggcgacttcataccgtcttccaccggtccaataaactacaaattctcgttgatgttgcggagtctgagttgggccctttggatgatatcatccagatcgtcacgcagaataccagccaacgtgcccacctctttcgtaccgcccctataaccgactccctccttaaacaaatagtccagatcgggcacgtggcccagaagtgggaaatcatatatccggtcaagaaatggaagaccgattatgagaatcgtcgctcgctggatgacgatgagcggttccgtctccgccgtgcaatatatcgtctttggctgtaccaccgggcctttcacacggagacttatagtcggtttagccgcacccttccacatatcgtttccgagcgtgcccaactcttgcacaactggtccacagccgagctggccgagattgaggatgtgcgtttgatcatcggtgatattgtgcagaaccacatttgtccaagcaacgggactatccaacgcaaattccgcaaacgctacccggaaagtaaccatcaactgaccttcaatatccatttaaattacccttcgagcagtagtcccgctggtgcacctagtctgtttgagaaggatctcaatccagccgagcagtatttccacaccgcgcaccctagcaacttcactgaatcacccgccaaatataagtcacggtttcggaacgattactttcatgaccctggttctgaaggatggggtgacgagatcccacattattatgtcgtgcaggacatgctgaaactcgatccgggccaggtgatctggctacgggagcatgcacctcttaaagaacaggtggagacttatgtacgctcctttggggactggttccgcgacaatggcgagacctttggcgatacattggagtgggtgatgaaggagcggggtgatgatatcgatgagtttcgagctgctattgcagaacgggaggttggcgtggtgtgggattgattcgatggaattgtgtatgtttgctgtcatattgcgtagcatatcgattactgtaggaaagcatgttagtgttacatagttaatgtgagagaactatcaactgtgcaatgggaacattaccttttcccttgtgtgaccaccaagcaccttggactctgtagatactccgcgctcctattagtcaatattcatcaataccatagacctcatacctgacctacagacatcaaactacgatagacatgaacagtatagtatatgcacgccaagcaaacaactggctctacacaatagctagataagtatccatccattctgacccatcaacccgttcctgaccacccgagcttagtacgtacaataaaccacaataataaccaattttaataagatatcatacctgcaaccccccaaagcagcccctaatcaccacacctacctacatggtgtgatcatctctcacccacgtgtcccaatccagagcttaagagcaaccatagcttagtagactatctagcagatagtctagctacctgtcaaacggaactctattccgttaattaatagctcgtaactactattaatttctatctctgtgatatagtactctccaatcaaccataatattcatgtttctcaagattccaacgccccaattcaatcctgtacattaagcaggaaaagagaaagataactcttactctactagtagttatgactagcccccaacttgccaaaaagcaaagcagtcaaaaacaaaaccccctagtcaagcgacaacaacgtctccttccccttctcacccctgatcaacccagtctaaaccagacggggaataaattcagccgcggcggctaacagtgggtaggagtgagtggagacggagacacactgtgaagggagcaccttgaaaccgaggcggttggcttaggtggtcttacctaagtgtctacttgtcttgctggagtggttggcttgggggtaatggggctggaaaaggtggtggctggtgttcttgtgtatcctcgagtattccatttacactgggagtaatactctacataagaaaaagtgattaagtgagtaccgcgtgtgtagcgatgagagagagagagagaaaagagaaagtagctgtggagctcccgggtcaaaagtgggtcgggcgagatgcccgcatggggttggcgaattattaatggctagtaacgggcaaaccaacgggcgtcgggccccatccgaggcggccagaagggacgattgctttggcttgcttgcttgcttgtttctcttacggatcactttttgtgcatttcttcttttattgcatttataagcgagtaatcttagcaaaaccactgtgcataccgaacagacaatcctgtagagccacggataagacgccggggggaaagtgggaaataggaacaaaattcgttaaaccaaacagggatctgggtttccgtcattaggcagacatcatgggggaacagcagtaagacgttaatcagatcaatttctcatcaggttagaatatagggaagaaaaaaaaggaaaacgaagggggaggaatccacaagaaaggggagcaaaaggaatagaggggaaagtggtaaaagggaaacagaagatataaaggcagagcgaacaaggtgtcgggagaatgtgatgtccaacaaacaccgccgtacaatgtccatgaccccaggtgccattcctaacaacgtccctcttgtgtatcatctccaggaggctaagtaacagacaaaaagagagttcaagaccgttcaattatcacatcacaaaaataaaaagtcgttgcggttgacgtgtcacacattccccgatctcgtggccccttaacagcatccctgcttggtcttcgggtcctccgactcgtcgatccgcaccatgtcgcggcggtcgcccagaacggtctggccggcatcaccgccatccagagccttgctggagacgatacggtagatttctaaaggtgacaagaacgtcagcatgacggaattcgtctggtaaactgaggaccgggggcaagtctaacctgtcaggatgttctggaaagcaagctcgacgttgctggcgtcaagggcagatgtctcgatgaaagagaggttgttctcgcctggtagcacgttagcacgccagcacatttcatcctaagccagcgaaggttccaacatacttgcgaattgcttggcctcttccgtgggcacagcccgcaggtgcctcaaatcactcttgttaccgaccaacatgataacgatgttggagtcggcatgatcgcggagttccttcaaccaccggttgacattgtcgtaagtctggtgcttactgatatcgtagacgagaagagcaccgacagcaccccgatagtaagcggaggtgatggcacggtaacgttcctgaccagcagtatcccaaatctgagccttgatcgtcttggaatcgacctggatcgagcgggtagcgaactcgacaccgatggtggacttggagtccaggttgaactcgttacgggtgaaacgactcaaaaggttggactttccaacaccagagtctccaatcaggacaactgttaagtacaatcgtcgttggttagccgtgtatcgcgaaaatgcggccgacaatagaggcgatgggatcgagcggcgactgtgcggagacgggaagtggcaactttacctttgaagagaaactaccaagtagcccgttagttataccgttgcttggcaaggggtgcgaatgagagaaagaggatactcacatcgtactcgtcgttagccatgaggggtggtttgcgagagctcgcttagctttgttacacgtaagatctagaggactgggaagggagacgacgtggtcgagctggggggaggtttggaggctcttgaaaggaaatccggtaatagagtgtgtctgactttctggaaggaggggcgcaacgttgtcagctttcaggaccacatccaagggacagaggcactcggggggagcgaggagaagggacgtttaaaagtaaccgacgggaggcgggatcggaggaacttaccgatgagtgtaggggaggcaggcaccggggcagggagattaggaggttatccagactgactttctccctacggattcccgtccgtcgttcgcagtgccgagtgcactgtcgccccttcgggactagcgcacgatcacgtgagtgtatgcaggtgggcggcgcgaggacttcagttcttgatctattgatcaattattgtaagtatcctgttgggggagatcgcttttcacacggacagctcctttaggtgcaccgtatgtgtccgtaaaagtgtgtttgtgtgacctgattgcttttcatcgcatgattggtcctgcagttcttccgctgtatgtttgccgtgtgcacttgccagtgcgaatctaatctacacttcgaatcgcgcttacatgagcagctggctggctttcagcaattatccattcatttgtttcaagcccagctcactggcggcccactatgctatgctaggtggctatcctgtagctaaatttgcgtctccggctctctgttgcgccctgcattccttgggctccacatatcagaaaatccttacgcactcaaatcccattcagtcttgctgtataatacggcaatgactagaaagcaggatgagagcgatgatgaaatttccatcacctcgactgcggtcagctcacaagcatctgagtatgatgtggaggctatcctagccgagcacaaattcccacatggaaggaggtttctggtcaaatgggccaattaccctgagtggagaagtacttgggagcctgcagaatccttcagaacagcagagacccttatcgactggcaacgcagaaaacaacagattgcagaagggaagcttgaagcgtatgacgtagctgactgggagcgaaagaacttgaaattccaggaggcaaaagaggagaagagacgcagaagagatgccagaagaaaacaacttggcttacccacgaagggtcccgtgatcgaaccttcaatttcttgggatagctcctgtgtgagtgcaagacagaagagtacacaaacgtcgcccacttacacacccagcattcgttcactgccttctaagaggcagcatgccgtggcggagcaacccccggtcctgtttggaagtggacaaaaaccaaaaccagcgtcagctacgccgcgttccgagaatgctcaggaggccgcgaagtggttttcgcatttgtcaacgaggcgaaaacacgagaaagctaaattcagagagccagatcccgacataaatcaactagagctcgttcgaccgtcagactggtcatttaaagcacctctgcaccttcccaagtctggttctgttgatcaaacacgagaattagtccaaatcgcggatgagcagtctgtttctcatacggaaactcgtctcccagatggacttactcatttacccgacccgctcactgatccgtcaaatgaagaccggatcaagcacgaccgtccagataaaccggtccaagatgttcccaagctacctcggagggtgcctggtccctatgccaaatttgtgtccggccgcttttgcaatcccggtgaggtgttagtgtatatgtattatggaccagacaaaagatccattggcccagctagactatgtggccttagccccatgtctgctaaaaggcttattgcaagtaaggcgggtttatatattgaggtttggttccaacatctttgcacgctggaggattatgaggtactctgttataattcagtaagtgattcggcgatatagaactagtcttttttgctgatcctaacaaccatagcggtcgcgacatcgcacatattgtaggggctggattcaggggtttaatgatacggagtccaaaatatatagcatggcacaggagcttgagcaaggcgaccttctcgcgatttttccaggcatccagggtacgccacacaacgtgttactggcctacccgtctaattcactgaagctcgagtcactcagcgatggctactccaggaaccagccggatacctttcttaaccttgttgtgagagatcccttggaatctcttgagtttattgagcgactgccctctagagcaagagccgacgaccggtggacagatcctcgccaccaagacgctgtcgtgagggacttcccgtattatcaactacctggaagtggatgtgacggtataaaacacgtcgacgacgccccaatgtcaatatcgtctgagcagggaaagagatcaacagaaaggcaactcaaagaggtagctagtgagacgaagttggaatcatcaccaaagcaactgggggttgcttcagcagaaaagcaactgaagaagattgggatacccgtgaagccagacaattcacacgagccaatcgagctacagtctgagaaaatgtctagtcctgcgaagccagactcttcacagaaacctctggagccagcttcggccgaaacaaatgagtctgccgaccaagtgcaagacgaacccatggaaatcgatgatgaacaagacgaactcatggagatccataaacagcatagttctgcttcagcgccatgcgagcagggctcaataaccgccccgcctacagctgacctcgaaagtgttttcaaaaaggagtttggagtatcttatgaaactctagtgacagtgaacgccgcaggcaaggtgcagagagcagaagcgttttttctcctattcgagtccgaggcacttcacaatgagcttctagtcctccaggccttcttaaatgcacataaccctgttatatatacctggcagcagaaagacgactgggagaaatttgcgcgagctgtccaagtcggggtggttttggtatgttttgctttcaaccgagctcaagatgcactaaaagaccaacaatcaagcaggttcacgagagcttcgtcaacttcaacgagttgcctttcttccaaaacgtcatcagcaagccaatcaacttctggagcgtctctctggccaaacctctcgaatatgccggtcaccggtcccacttccagcgcattttcccacatggcggggctatcttgatgacagaagatataatgcttcaggatccgaaaggaaccgtagtaatcctagcgtggttcgctgacttcatcaagaagaagtatccgggatattggaaaatcatgtttcggcctgctgttctggactggctcatgcagcaaccagaacccacagacgagtcaatacagggagtgtacgttatttcattccaagccaacctacactctaatttctctaacaaaaaactctgtctctagatggcctaccatgtaccgtttagtcctagaatgttgcggcgttcccgcatacgacaccccccttggcgagctatcatccggagcccatgacgactacctcgaaagcaacgccatatcccctcccagcctaccgaattatggcacccgcaccgaagcagacaatccagacatccccaaaggcctaacccaagaccagcgcaacgcagaccaccttgttgaattttttgccggctggggcctggttcatcgccaccgataccgacgattggtcgtcctcacgcaaacgaaaaccctggaccgatggagtaaatggcaacacatcgatgtcaaatggggcgcgaaggatttcttgaaaacattcaaaattaatcatagatactactggtcaaaagtctttgctgctccttcctcgtcttcagcagcgtcttctgccagtcttatttcttctagaccaggtacaccgtctgaaacacgagcctcatcggattcctatacgccgcggacaccgaaatctcgaacttcatgcatgtcggttaccagggatatggatggagctagttactatggccggatacctggcggagtatcttcgtatccggatccatacaaatgagtcttacgtgataagttttgcaaaaagaaagattgtgtgttacgagccggggcggactgattgctgttctaagattccctatcacgtagttcagtttcctatttcccttttcttcttttctgtgtcttatgtttcctatacccagtgggcgtgaatttgttgtgtctgagggagatggtgtgcccctcgtcgattgataatttgtgtagtaaccgtttcatatgtaaatgacaaacggaaagactgtcctgataatgaaacccggtgtttgagccacgtatttatacaggaatatcaacaacatagaataaaccatgtaaatacttgcaaggcggatatatactagtggcagcagtagcaataagttcaatagtaagcaatgaaaggtatcaacaccgatataacaacgcccaaaacagccagcttatatgaataactcatccaactagtaatcgctcagcgaggttaatgacaacaggattaactgctgtctgcctgcctgcctaagtcccatgctctccattccgtccatatgtacatcgtcatcatcatcaacaacatcgaatccaagcgaacgacaactaaaacccagccgtctgcgtgcgatattccctgaaactcgaaatcgggggtagttcatccgccggccgtgtcttcgctttcttatctttactcttctccgctttctctcgacggaccttctcctcccacttactttcctcagcggcaatcatggaatggaagcgtccgccctgaccgcgcgcaagatatattggtttctcgttccgctccgcgacggattctgtgaccaggacgaatttgacgctcgagccgggggtttcgaacattgcgtcgctgaggatggtttctagttcggtgcggagggcgcgcgcgcctgtacccattgtgaaggcattggcggcgattttgtgcagggcgggagtggtgaagcgaatttcaatgccggagaggctgaagagggtggtgtattgggctaggagggagttgcggggttcagtgaggatacggacgagcagaggggtggttaaagtggagagggcggcggtgacgggtacacggccgactagttcagggatgaagccgtagttttgcaggtcggtggggttgaggagatcgagggcgttgaagtaggttggttcgctgtcgggggagttgggagaggtggccgacgtgaagaaggggaggtgctttttgtatagggcttcttcttcggatcccgggaggatggggatcggttcgttgttccccggtgtgtggtcgcgagatcgattgtttgtgagggctgaaccgcggacgggctggccgaagccgattgatccgcgagatatccggtccatgattactttgtgtagcccgacgaaagcgccggagaaaatgaagaggatgttgtctgtgcggacgttgtagacctcgcctttttggggcatgttgccgccattggggttgaatggggagttccctagcgggttgttggagggaaatgtgttgggggagttgccgacacgaggtgcacttcgttcttgtttcgcttgcacttgtaccgttgtgccctcgatgagcttgagcagcgcttgttgtactccttcaccactgacgtccttcccgtggctgacctttgctgcggcaattttgtccacttcgtccaacacgattatgccgcgctccgcctgctcgacatcataattcgcagcggccagaagcctgtggacgcaaacttctgcatcctctccaatgtaaccagcctgcgtgaacggtgtgcagtccgaaatgctgaacgggacggatagtatccttgccagtgtctttgccatgagcgtctttccaacgccagatggccccaatagaaggatgttggatttctccagttgtaattccgacgaatcgtcaagtccaggttgcgctgatgtaggcaatgtacctatttcgggggttgtattgacggtttgttgttggcctgggaactcgtctgactggcttagcaaggctcaggtgatttgacaggcaacggaatacagataacctaccttcgaccgggtgatgctcaattgcctctctgcgcgcccatttcgctagcaactctgcgttttcctcctcacgtctctgcagctcttgcacccgttggtagtggttgaagaccgcgacgctaagtatcttctttgcacgatcctggccaacgacgaactggtctaggtactgcttcaacgttctgggggtcacccgaggggctccgaaagccggagctgacgcaagaggtccggttgttgggagatccggttcataactgccagtccacggctggtttgtgaaatctgagcgatcgaattgggaccaggcagggaaagtggttgatgagctggtgaatccacggcgaacagggcgggtaagcggcttcggcgcatgccgatagcgcaagggagagttgcggtgcgccctgaggaggccacgggcctgtataggcaaccgtagcatggccaagcgcagtgatatctgcaggagaagggtgcgatgatgaatatatgggaaggacgcaagaagcagctggtctgtgaaaaagagagggagaaggaaggctgtgggcagtcgaggactgtcacctccgatggcagcagataagatgcaatacaatcaaatcaaaccaaatcgggcgatagctttccccgcagcacgtgatgcttatcgccgacggtacccgtggatgacgtggttgagatgggcttgtctaacacaacaagtaaggtttggacgcaagaaggatccgtcagtagaagaactctggaagacgtgttgagcttcgtgctttgttagttcggaggttgtgaaactcgaggcggataaagaactcgtgtttcgtcatccgggagctccaagtgcgacgagcggtggcggtcccgatcgtcgctcccgtccgtcccagacaccgacttcgctaaggccgacctgtgccattctaaacaagtatggcctccaaggtggtctttattaatgacctgaataagtgctacatgtgagattttcaatagaatagtatgaattcatttagcatgaactgggattaaattccctatacttccccgttcttccattaattcatatgaaacaatgcgagtctgccaagaggcattgaactactaattgtaccaaaccttcttctttccccaatggcctcaattatgcttacacgtattcctgtaagcttccgtccattcgacaaatgtgtcaaggtcgtatcgtacatttagctttggccaaccgagcggttccgtactttccatgacactgaaagtttgtagtcacggctgtcattcttccatttgaggtgtccatactggtccaatcgctggggcgtcctgtaaatatgggaaagcaatagtccccaggtgcctcgtgcgcgatagctcggcgtcaactggggagggaccagtggcatcgacactgccacagattatactgtaaagcagtgtgttacagcaactggctgcggcttgtgccaaccgccacccagaatgaaaaggagaattgagcgagttgcgctcgagacaatccatactccgagatatcgaaaagctagctgcttgatttgaaggcaggctgctgctccatagtttgagatatgaagttccgcagggccgcccatcgattggaaaccgagcccccatccgtgttgctgttggagtctgtagtggttggcgctggtgcttgcatgctggacatctgcgccatattcttcgcaaaccgatcgcgctccagccgttctagcttctctcgacgcttcatagcacctggcctatgctgcagagttttctgcttgatgatattaacctgtttgctagggtcggtagcagcatcgtcggcgtccggaagcgcatcggccaatgagtccagagcagcaagtttcttggaggcacgccggcgctttgtagatttctgggagttcttttctatcctggacacaaagctgctgtgcttaatcaagcgcttgtccttcttcgtcgtgcgaaactcatcgtggagaaagctgggcttagacgagggcagagcgcctttcccacttgcaggcttcttgatcgagcgagtaggagcctatagcagtaaggaggtattggtaagaatacgtgcatgcatgatatcaactaggggaaagcttaccatgatggggagggatgtgctgtttctccgttcggggaacaagacgaaaaaaggcttgcatgtgcttcacgaagaaccgaattcttcgttgattccgatggggtagcgcggactattccggaagagcactagtccccaaccgaagacccgatagtatgtgtggctcaccgcccaggtgatttcggggcctcaccgactggccgagcctaaccagagagtgacaaagtattgaacctcaggccaattccccccttcccggtctagttcggggtccctgatggccgtcttcagtcaaagatcactcgcgctttgtctcgcgccagccattcgggttccatcctgtgctacattaaggctgataagaattcccaacagtgggaccaacaatttaatagcaaggcactagacctgactaggccgaccgtagttcaaggccacagaaactggatcgtcatatttccatcagaatctctccccctgctcctggtccagttttcttgcgggaggcaaagatccacattcacgggttccgaacccgcctttttatcttgcccttgccaggctcagtggctcaacttacatcagggcaccaccacaccgacaccggttcgataagattgccttctcatttgtggccttgcatgtggatgctgtctccagcgcgccttttatctcgccggacgtgcccttttccatcgaggactactactgtgcctgtgactctacctcggcccccgaccttccatcacctcctgtctactccattgagtcgggaattttcgccgtgtctatcagcttccacagcatataagcctcaagggcccgtcgcagtccgctacttctcgcatagccctttccactcgtcgatcatccccgccagtaccgaagcaacaatgggctctctcggaccgtatcagcgcaaacacaagatcactgtggtgggctcaggaaactggtatgtgcaagctggctttccgtcatggtgctagtgccagggaagaaggaaaaggctgactcgggtcatgtataggggatgcgcaatcgccaaaattgtcgccgaaaatgccgccagcaaccccgcaattttcgaggagaaggttgagatgtgggtttttgaggagaaggtggaaatctccaaagactcccggcactatgatccctcttcaccgctgtgccagggcccacaaaacctgacggatgtgatcaaccaaaagcacgagaacataaaatacctgccaggaattactctcccctccaacctacatgctaacccgtcgttggttgacgcagtcaaggatagtaccatccttgtcttcaacctcccccaccagtttatcatcaagacctgtgagcagatcaagggcaagatcctgccctatgcgcggggtatctcctgcatcaagggtgtcgatgtgaacgaagaaggtattcatctcttctccgagaccattggcaagattctgggtatctactgcggtgctctttctggcgcgaacattgcgagcgaggtagccctggaaaaatggtccgagtcaagcattgcctatgatcctccgcacatggattccaaggcgccatctcccaatcgttccccgtctacgtcgaccgagaatctcgttcagttcgagcacaaggatgtttccggccaactatcacgagtaaagctgcaagcgctgccgtccgactacccccctgtggaccacgccgtcctgaagtcgctcttccatcgtccgtatttccatatccgtgtggtgagtgatgtcgcgggtgtgtcgcttggaggcgcccttaagaacgtagttgctcttgctgccggctgggtcgacggcatgggctggggtgacaatgccaaggctgccatcatgcgggttggccttctcgagatggtcaagtttggtgaaaagttcttcggggccaccatcaatactcgaaccttcactgaggaaagtgcgggtgttgccgatctgattactagctgcagcggtggccggaactttcgctgcgcgaaactcagcattgagaggaaacagtcgattgagaaagtcgaggagacggaactcaacggccagaagcttcagggtactttgactgcggttgaggtaaacaacttcctgaagaagcaaggccttgaggaggaatttcccttgcttacggctgtgtaccgtgagtaacccagttccttttccctttatcttggttttttgccatcgatgtactgaccataaaacaggtgttctcgagggcagtatgtccgttggagatattccttcttacattgagcggtaaattggacctgttgatcctctcctttggtttatgttcgggttgttaatttagggaaatctgttccttttgtgtcttgacagaaagccggagtctatctcttacgttgaaaccgggcgggtgaccagcagtggaaccagccaggcagtcttgagcgccaggttgtgatcgggggcaggattcatgcattaccccctcctcttgtgttttccccatccttgtcactttctttcctttcttttcaccaccttgtttgtctttatcaccatctatcttttgggggaagcgtctgttggtaggtatactttgtcgagattttctcatgcacatagaccgatgactatagaccgcaatgacaccggaatgtctgaatattcttcaatcccatcacatccacgccagtaatgagctgtacaattgccagatcatcaatggcctgaccgggggccatgaggggaggccagcagggaaagaggaggcgtgcggaggcccgtgttctcgcccgggccgttccagcccgcgctctctttcatgatgtcagtgatcccgcggggttgccctgaacctcccaggaacaggaaaccttggtcggccttgcttctcctccagttgttcttttgctcataaatagccagcgacctctgcgccgtggctacacgggttgtctgtgcttctactttccaggaggacaccctgcctttatacccattcatctccgttccttggttagtctggccggcaattcaccaagaatagcgccgctaggctcaccattgtcacgaagtctagtcgaagctctatccccacgctcccctaatcgtgacggctagtatcattcgagctcacaatgtcctctccacagcaggtttatctgctgcctctgaaggatgatggatcgcccgatgttcctggaggatatatctacctccctgctcccactaacccgccatacttactccggtttgtcattgaaggcagcagctcaatctgcagagagggtgctttatgggtgaacatccctgagaagggcgagtctttcaatcggtctgcttttcgaagcttcaggtaagcgaaataaatggccacaatttaatcagcatttgacctttccgataaaattagcctatccccggacttcaacaagaacattcagatcgatgtccccatcacctctgctggttctttcgccttctatgtgaccttctccccgcttcctgagttctccgttctatcaacacccaccccagagccaacaaggactccaacccattatatcgatgtctcacccaagttgactcttcgcggtcaagatctcccgctcaatgccctctctatatactctgtgatctctaagttcatgggccagtatcccaaggagtgggagaaacacctcaacggtataagccagcgtaattacaatatggttcatttcacgcccttgatgaaacgcggagcttccaattcaccttatagcatctttgatcaactacaatttgatgacgccgtgttccccaatggtgaagacgatgttgcgcgtctgatatctaagatggagaatgaatatggacttctgtcgcttacggatgttgtatggaaccacaccgcccataacagcaaatggttggaggagcacccagaagccggctacagtgtcgaaactgccccatggcttgaggcagcactggagctggacactgcgctgctgaaattcggacaggatctccaaaaccttgggctgccgaccgagtttcaaactgtggacgaattgatgaaagtcatgaatgttatgcgggacaaggtcatcgctggaatacgactatgggaattctacgccattgatgtgaagagtgacacacataaaatactcgacaaatggaaaacatccaaagacatagatctaacagacacgaactgggcgcaactcaatcttcaagactacaaaaactggactttgaagcaacaagcaaccttcatccgagaccatgctatacctacttcgaaacaggtcttgggccggttcagcagagctgttgatttgcagtttggggcagccatactaacagcacttttcggtccacataatccttcgacgtccgatactagtatagtcgaggaaagtctctctaaaatactcgacgaggtcaatcttccattctacgaggagtatgatggcgatgtctcggaaattatgaatcaagtcttcaaccggataaaatatttacggattgatgaccatggacccaagctcggcgccgtcacggcacaaagcccattgatcgaaacgtacttcacaaggctgcctctgaacgatgttaccaagaagcacaagaaagaggcgctggcgctggtcaacaatggctggatatggaacgctgatgctctgcgggacaatgcggggcccgactccagggcttatctgcgacgtgaagtaatcgtctggggtgattgcgtgaagctgagatatggcagctgtcgtgacgataatcctttcctctgggatttcatgacagactatactcggctcatggccaaatatttctcagggttccgcatcgacaattgccattcgacaccattggtggttgccgagtatctgctagacgaggcacgcaaagttcgacccaatctgactgttttcgcggaactatttactggctcggaggaagctgattatatatttgtcaaacgtctcggcataaatgcgctcattcgtgaggccatgcaagcttggagtacaggggaactaagtcgtcttgttcatcgtcatggcggacgcccgattggtagtttcgatcttgacttgccctcttcaggcagtagtcatgcaatagcttcttctggtcttgactccggcaaagaaaaagttgttcatattcggcctacaccagttcaggccttattcatggattgcactcatgacaacgagatgcccgcgcagaagagaaccgccaaagatactctgccaaatggggctctggtagctatgtgtgcctcagccattggcagcgtcatcggctatgatgaagtatatcctcggcttgtcgatctcgtccatgagcatcggctatacttctctgaattctcagaggcccccgagactggtctgaactctctcgaaggggggattggaggcatcaaaaagctactcaatgagcttcataccaagatgggtattgaaggttatgacgagacgcacattcatcatgacggtgagtatatcactgtgcacagggtgcatcccagaacacggaaaggtgttttcttgattgcacatacggcgtttcctggtcaagatagcagatctgtacttgcgcctacacatcttgtcggtactcaggtcaagcatatcgggacgtggctcttggaagtggatacaagccaaactaccaaggagcggatacaagcagacaagtcctacctacggggcctgccaagccaagtcaaaacgtttgaaggtaccaagatcgaggagtctggcaaagataccatcatatccgttttgaattcttttgttgccgggtctattgcgttgtttgaaacatccatgccgagtgttgaacatgcaagtggactggacaattacatcaccgaaggcgtggatcatgcattctcggatcttagcttagtcgatctaaacttcgcgctttaccgctgcgaagctgaagagagagattcgagtaagggccaggacggggcttacgacatccccggccatggccccttggtctatgccggtctacaggggtggtggagcgtgcttgagaacatcatcaaatacaatgaactaggccacccactgtgtgatcacctgcgaaacggacagtgggctctggactatattgtggctcgcctggagaagttgagccacaaggaagagcaccctgcccttggcaggccggctgcatggctgcaggagaagttccaggccgttcgtcagctgccaagctttcttttaccccggtactttgcgataatcgttcaggttgcctacaatgccgcctggaagcgagggattcaactgctgggaccgcatatacaaaaagggcaagaattcattcatcagttaggtatggtgagcgtccaacaaactggatatgtgaattcggcgtctttgtggcccacaaagaaggtacccagtcttgcagctggccttccgcattttgcggtagactgggcgagatgctggggccgcgacgtgttcatctcactcagaggcctccttctgtgcacaggtcgctttgaggatgccaaagagcacataacggcatttgcaagtgtactgaaacatggcatgatcccgaatcttctgagcagtgggaagctcccgcgctacaattctcgggattctgtatggttcttcctgcaatccatccaggattacactgaaatggcaccagatggactggaaattctcgatcataaggttcccagacgttttctaccatacgacgatgtatggttcccgtttgatgatccgagggcctactcgcaacagtcaacgatatccgaaataattcaggaggtcttccagcgacacgcacaaggactctccttcagagaatacaacgccgggcctgaccttgatatgcagatgacacaggatggtttccagattgatgtcaaagtcgactgggaaacagggctgatattcggtggtagccaatacaattgcgggacatggcaggacaagatgggtgagagcgcgaaagcgggtaacaaaggcgtacctgggacaccacgagacggggcagcaatcgagataaccgggctagtgtacagcgccttgacttgggttgctaaattgcacgagcgtggcatttacaaacatgatggagttgacattggaggtgggaaatccatctctttcgaagattgggcgtcaagaattcgggccaacttcgaacgctgttactatgttcctctacagccaaaggacgatggccaatacgacatcgacgcaaacatcatcaatagaagggggatttacaaggacctgtacaggtctggtaaaccatacgaggactaccagcttcgttccaacttcccgatagccatgaccgtcgctccagacctgtttactgcctccaaagcacttgcagctctggctcttgccgacgaggtcctggtcgggccagtgggaatggccactctggatccctccgacctcaattaccgccctaactacaataattccgaggactcgaccgattttgcaaccgccaaagggagaaattaccaccaaggtcctgagtgggtttggcagcgtgggtacttcctccgcgcctttttgcacttcgaccttgctcgcaggacgacaccggcggaacggacggagacataccaacagattactcgacgcttggagggttgcaagcgggctttgagggaaagtccatggaagggccttaccgaactaacgaataagaatggtgcctactgtgcagattccgtaagtcccgatgccctcccctctctctgtctctttatcgtgccgatcaatcttcgctaaccttatacaactctatagtcacccacccaagcatggtcagctggatgtctgcttgatttgtattatgatgcatcaagacattcacagagctgactagcgtgttgttgatacaattttctatcttgatctagcgaagatcatcatgagttcgaattagatatatgtttgtccaaacttagttaatggaaatagcttttatgtgctggcatgatccttactcgtatgacgccgggccgtctgccgttgtggaagaccgcataaaaaacggtcgctgagtaagccacgtgcacaactcatcgccaactagaacgagacgagactagtacttttgagtttgggttcgtcaacatgtgttttagcaagcgatgcccgactcgggtccaatttgccgttcctagcgcggagattgcggtgtagagtgtttgtatcggtgtcgcctgacttctccagttcagcttttcgtgtccaagcaacatcccccaggtcgcgagcccgtttactatctattgcgtggccctgacccctgacgtcagttgtttttgacctacgcatcctcccgagcacaaacgtttccgaatgcattgacaaagccgaacatcaatcactacatctccggtgcagaacatctgcttttcgagcgtcatgtctctcacggaatccgccgcggcagctatgctgaccgccgcggtcgtggtagacagtcccattgacgtgcatgagcctagatgggatgaccagaccaggggtcgggatttgtacacacaactagtgatcagtttgctggtcgggctcagcgcctttttttcattctgtgtaagtctatgctgaatgcaagaatgaaacgaatctctctaacaactcgcgtctctatagattttacgaccgaaatggaccgaactatacgccgctcggcgtcgtcaacgcaacgcggcttcatacttgcccgaactacccgacagtttctttggctggatacccgtactatatcggatcactgatgagcaggtgttggagtctgcaggcttggacgctttcgttgtaagttctacatgttgtcttggtcgcggactagatgtcagaatcggccattttctgacgtggggtcgttatcctagttcctcaccttcctgaaattcgccattcggttcctctccgctatattcttcttcgccttggtaatcattctaccaacacactacaagaataccggcaaatcgggggttccgggttgggatgacgacgatgacgagacattcgatggagacaaagacaagaagaaactcatatcggatccgaattacttgtggatgtatgtcatttttacatacattttcactgggcttgctgtctacatgctcatccaagagaccaataaggttatccgcacgaggcagaaataccttggaagccagaccagtacgaccgatcggactattcgcttatctgggatccctccggatttgggaacagaggagaagatcaaggatttcatggaaggtctcaaagtgggcaaggttgagagtgtcacactatgtcgtgactggcgcgaattagaccatttaatcgacgaacgactgaaactgctgcgaaatcttgagcgggcctggactagacatctaggctacaaacgggttaaggcaagtccgaacgcattgaccatgatgcaccagcagccgcgtggctccagtattgtttcagatggagatagtgagcgaatccagcttctttctgaaggagggcgcgaccacgttacggactatgcacacaagcggccgacagtgcgcatttggtatgggcctttcaagttacgctacaagaacatcgatgcgatcgattactatgaggagaagctgcgtcgtctcgacgagaaaattcaggttgctcgtcaaaaggaatatcctcctaccgaggttgccttcgtaacgatggagtcgatcgccgcgtctcagatggttgtacaggccatccttgatcctcaccccatgcaactactcgctagactggctccagctccagctgatgtcgtgtggaaaaacacatatctcccgcgctcgaggcggatgatgcaatcctggttcatcactgtggtcattggcttcctgactgtattctggtcggtgcttttgattcccgttgcctatctgcttgagtacgagactctccacaaggtgttccctcaattggccgacgcccttgctcggaacccacttgccaagtcccttgtgcagactggtctgccgaccttggttctctcgctgttgactgtcgctgtgccttatctctataactgtaagatggttcccaacgttaactttttgtctactcacgcgctaaattgtcaacagggctctcgaaccaacaaggcatgatgtctcggggtgacattgagctgtcggtaatttcgaagaccttcttcttctctttcttcaacctcttcctcgtctttacggtattcggaaccgcgacgacattctacgggttctgggagaatctccgagatgccttcaaagatgcaacgaccatagcctttgcattggccaaaactctggaaaactttgctcctttttatatcaacttcctatgtcttcaaggaataggattgttcccgttccgactccttgagtttggaagtgttgccatgtatcccatcaacttcctggccgctaagacgcctcgagactatgctgagctatccacaccccctacattcagctacgggtattccattccgcagacggtcctaagtcttatcatctgtgtggtatacagcgtgttccctagctcatggttgatatgcctgtttggattgatttacttcacaatcggcaagttcatctacaagtatcagcttctgtacgcgatggatcatcagcagcattcgacgggacgagcgtggccgatgatctgcagccgaatcttgatgggcttgatggttttccagctggcgatgatcggcgtgctagccttacgccgggctatcacccgctctctgctcatcgtccctctccttatggcaaccgtatggttcagctacttctttgcccggacctatgagcctcttatgaaattcatcgctttgaagagcattgaccgcgagcggcctggcgggggggatatctctccgtccccgtcgtcgaccttctctcctccgtccggcctcgaccgcgattcttttccgatccggattggtggacaagaactcggactacggctgaggaagtatgtcaacccaagcctgatcctgcctcttcatgatgcatggcttccgggacgcacgatggttccagagcttcagggagaactggagcatcgcaatcctggaaacaatgcggccgatgagtccgtctgagactgcatcaaaggcgccaaagtggattgctttcaaaacatcacaagtcaatcgatctctatcattgtctatatatgtattactttctaattaccccttgttgtatgagttgctttttcccgccatgatctacgatgccatgcctttgatgtcatagatggccatatacgcctgatagtcttacaccctcgaggtgagacggtcgattttatgcgctgcaattttcacgcgatcagatttagatgtcactcatctttgttgataatggtttccttatctctcgtttattgataccagaggccttcctgtaggaggtttcattcgacgcattgatgccaatatagcttgcatgtactatcactttaggtactttagggaggattcctgatgctcttgttaatatttgccattaatgaaccgcgtaacgtggggtgttctgattccttgccaactaccgtatcaggatgaggaagtaccccacggagctgattatgtgacactaccaggtcccaccactccttcctaatattttcccccggctatttccctcaaaaagtggcattgatatgccgaatataaaaccaagcatattcacatacacctatgtacacataactactagaatgtcttgacagcgccgtccatcagcgaggtcatcagatgcggaaattacatgcgaggcaatcttgttcgaaattacaactgacatcggttgacgctcagttcttcttttcacgcagccatcaatacaatgagctctcagccagggacaaattgcactgttgtgatgtgtgaatgggtacaacggcatgctttcaggtttaggtctcggataagaagtccaatcgaactgagcagtaagcagtccagtcatgaggtagagcagttcgtccatcgctcctgcccggaaggtccgaaaacattgtcatcgcttgtctttcttccgctagaagacctgctgttactacggatatcccaggaagttggacgggttgacggagtggtagaactggttgttcaatcgtccacccattctgtccgggtttgggcctcagtgaaccgggccaaacaagattcatcgatgttgatactcgcctggttgtcgatattccctataaagttgtctgcgttggatacgacggcgatattacgtcaacagactctgttgatgtaaaaacatcacgagcacaaaggacgataattattcgcaaacggaagcatcactctttggcagattttggtgggcagccttcgagggctcgttggcttcaggatatcattctagaagaggtcgagccgtcacggctggcccagcttgaagcaggctcgtatgagatgcatcggtacttatacatagatccttcctatcttgaccttgagactcccgagcgaatttctcccggggaaaaattgtgtaggatggtggatataatgtagcctggggtgtcggttgtctttatagtatatagcccattgttcttctttcctgtcttggagttccttcattggtaatagcgcagattgtacttgacatgggttttgctggtcttcacttgcttttcagactgaatactggattcaattgatgggaattcaagtatattctaagtcaattaatctggatactcaacaatgctagttctattaccgtcatcacagtgtttaagatactgacggctgtgtttttaagacacgtaagccagggaccatgagtatcttcaaagcttgagaccttctgtcaaggtatcgttgaagtaccccaatgatataaggctgacatctgtcccattatatatgaaatcccacaatactatccatacataatttaggagccacgaaataattagcctcaccgaaatcctagaataaaaacgtgtactacaatccgaaagaaatagaatagaatatcggaaagacatcactttttcatctcatccaaaaaaacaaacaaaaaaaatgaatcaacaaccgctagaaaaatccgatcccttaatcaacccatgcgtcgagtgaacaataatggtatgactgagcataacgtgttgaacccatataggagcaaatgataacagcaatgcagagagaaaagaaaaagagggtcaaatcccaactggcgaccgatttattgggagttgccgttgccattgatagcaagcttttcccggcgggtgcgcacagcctgtgccaggttctccagaacaagttccgtgtcttcccagtggatgcaggcgtcggtgatactgacaccgtacttgaggccggccttgccctcgggaggaaccttttggttgcctgttgtggtgatgttagtgggatggtgtgatggaaggtgttgggttggggggagggaaaaaaggtagaacataccctcgttgatgttgctctcgatcatgacacccatgatggcggtctctccagcggcgatttgctcggccagaacagcagccaccttgggctggttcttgtggttcttctgcgagttaccgtggctgcagtcgaccatgaggcggggaggcatgccctgggcggtcagcttggccttagcctcggcgatgctctgggcatcgtagttggggcccttcttgccaccacggaggatgacgaagcagtcggggttgcccacggtgccgacgatagcagcgacaccgggcttggtgacggacaggaagtggtgagggtgcttgacggagccaatggcatcgacagcgacatccagggagccgtcggtaccgttcttgaaaccaacggggaaggacagacccgaggccaactcacggtggacctgggactcggtggtgcgagcaccaacggcgccgacggagagacagtcggccagaaactggggggagatggtatcgagcatctcactggcgatgggcatacccttgttggtcaggtcgacgaaaagttgacgggaggtgcgaagacccttgttgatcttgaagctgttgtcaatgtcggggtcgttgatgagacccttccagccgacggtggtacggggcttctcgaggtaggagcgcatgacaatcagcagctcatccttgtacttctccttcatcttcatgaggcgatcgcagtattcgagggccatttcagggtcgtggatggagcagggaccgatgacaaccagcaaacggcgacggtcggtgtctgtgccctggacgatagcaatagcctcctcacgaccttccatgaccgttcgccgggacttctccgtcatggcgatctcatgctgaaggaggttggggggtgtgagagggttgtatccacgaactgtagaggaaaagagaaaccgagggttaacgggtgacggaattttgcaagtgagtcacgggcgcacttacttctggaatcctcgagggagcatctgtccccgacattagggttttcaatgaagaactggaggcatcatgagtattaacattgccattgagagggttgagatgctggaagaagcaaaaacataccgacatggtggtgcggcggggtaacaagtggactgacggaggggcagaaagagaaggagaggcgataaagtcgcagcttagataggtagatagtatgcccgacgggaggtatggatgagtaagtcaaagggaagatcggttcagtggattggatcgatgagagcttaatggtagattgatatcttgagatttcgagattgcaaccgggtggaatcacaacgaatatataggaaagatgtatgagagaagaatcactggaattgtctccttgcagagtctctcaaaaagcaaaagccaggaaaaaaaaagtactatttctttggcagtgtcgagtcattcctgcctcattgggtaatcgacacgtgatatgccggtgagcggacgaatggggcgaggtccaaaaaagcgcctcgcccgcggtatcgcctgccattggcctaccctccccattcgtcgtctctcattccttctcttcctgctcggatcagcatgaaggatactccgtagtccgtcatccgctatcccgtaccacatgcccgaggtatcgcccggcgttggatggtcagccttagcaatagatgacgcccctgaggctgccagtacgacctggattgggggcggaaaccttgtatatagtttcggatcatcctggctcggaggctacgttggcactaatctctctctggatctgggtttcgccccttgagtgttgcagaatacgaattgcagatacgactagccgttgctgtaagaaataagtacagagtcatcgcccgagcaaagatgagacttcactgttgaagtgtatactatccggatccgagtcagcccggaccggaaacctcatcaagtcggagcatcagaagctgagatgatgaggcctagcttcaggtcatttcctcatctgcattcgatcccgaagctgctgctcgtcccgctctagacgctgcatcaactcctggcatacttcggtatggtgttcgcgaatggaattcatctgttgctggcacaatcttatccgctcttcttgggcttcaaagagctgatccaggacccggtgacaatctcgccgatacatctctaagacttcgttgatagtctttttctcgctttcaatttcttggattatatgcttgcagccaattcagtatgaacgcttggaatccccacgggatgtcgcctacctcgcttgtcgcaagaagcatgctttgcgctcttttgtgaagcacctgcagggatgtctgccagctggtgtgctccaggacaccatctgcggtggtacttggcttctgcgaacatgactgcgccgataattggtctgggactactgtcgacccaggtagggagttgcatgtcgcatgaggctcgttatcgcgttccaatgtcaaatgtgcatttggactcgatcgtgcgggatttctaagcggggtcttgtttgatgtaggtttacctgtacatgccattagacgatcctggaaggtcagtacttccttcacttgtttcgtgcaggttccggaatgtttcgatcctgaaattacgtttcgctcgcaaaaagcaggtagttcgtcattttgtgcaccatttttaccatccttcatgatcccccgaacgtgctcgctggtggaggacctgtctcccgcgcctgacatttctcgaggatttccgtccacgtcggccctaccacccatgtatccgcttttgatgtggtatagaaggcgagggctcccatcagcatccactatagttgatcggggggtgtttctcaatcgctttgtgggattccagtgatgtttgcgaaccaaccgcctagagtcttccctgaaagcattttctgaagcatggtcccctgtaattgggtcatctcgcatatagtctggactgagcgcagctatctttctcttcactggcctagcccgcggacttttcatgccctcggatgtggtctgaggcatgtcggaagtgcaagtattatgcgcggccccgaggctctccttgcacatttcaaagggaaattcttcatgagaacgactttcccctacacacaatggacttgagtcagcggagccacctgattgggtcaacatctttggctcctcgttgtcaatcttgaaggagctgctcctgctcgtatgcctttggacagaacattctgcatgaagatcatcctcaattttgctcgtgaattgctcgtttggtgtttctaagggcaataccccatcatagatggtatatcgctctatgacagactccgtgatgtcgtgctgtccctgtattccaccgtcacacacggacacatataatgtgtctgacaaatcgagctcattttcgtttgctagcttattatgggtctgtatatgctctaagctgttttccttatgcccgccatggcctgctgaggggtagccttgctggaaagctgcagacagcttgtaccccactacacggcccctaccttgaagtccttgtgcggtcggatgacacttaggagtattcatctgattgttattatcacccgtcacacttgtagatagctccgaataactttcatttttcccggaagcttgaattcgaagcgatctggtgcgatcatcattgtgttgtggtgcagcagagtcacatccgacgatggcattatcagagacgagctcgacatgagcacttttggccatggcacgtccatttctttctctcgaacaaggtatcagtttccctattatgtcatcatctgatagtgtgtgccctggcttatggttggggttgtcagcatcttctgtaaatgctgatgctggtgtcgctttcttggtattgttttcattctttcttgttgggcgagaagatactatcttcttgcgctttgtggctagcttcctccctctggctgctctcttcttgcctggagctgccgaacgactgccgacaaaggacgtctcaccgggcaagggggaagaaattgaagttacctccgcatccttaaaaggccgttccacttcatcgtcactaggtcggagatcctcgtcccagtcgacagcagctttggaattggctatatataccttctgcttggaatgtcgcgtatagatgaccatagactcttgagtattcgatagagggtctctccgtctattcccactttgcaagcgacttgatcttcttcttccggtatctggatttggtgcaagtctaccatatggttttctcggtactcctttggacagtgatgggtttgataatggcactggaggttcacctgcgtaatttgttcgctgacactcttgctgagagccattacgttccaaatgaacatcatccagattcgcattcgtggtattgcacttctcgagctcttctgagtgtttctccaactctttgacagacttttgtatcaaaatgggacctgtgcggggtccctcctgcccctgtgtgttgttaggtgagatcccagaagattttcttgcaacttcatcgctcgtatccagttccatcaccattgaagatgtccgaaatataccatccgtatttatagacccctgatcattctgacagaatgcctcgatggcattccgcaaatcaccaggatctttatcggataagatgcttaaaacatggccttcgaagcatagccgtctgccatttttcacgaccagcttattctgggaaaggactaatttcagacaatatatcatagatttgtccacaaccgtgcgcacgggtagaccgatgctctgagtgtagaaatcaacgtattctaggcacattctcgttgtgttctgtctataggtgatgaatgtcaaacacccctcatcgattatggcaaggacagttccttcgaacaatggtgtctcgtcgatgtgaagtgactgaagaagaaagcagcgtcggaggtaggaagtcttatctaccacttccgatacaacggccatgttggataaggtgtaaaagtgctgtagcggatcatttctataggaaggtaaagtatcgaagaacctgactctgtccgtgctactgtcggatttccagagtgcttcgtcgcttactcccgagttatgtagcgcatggatcatgatagtcgcgagcagtttcagagtacagtttccattgaggatgacgtacgaaagcctggtgagcgcttcgcattagcacagataacatcgctcacatagaagcgtataataccgtgacaattccacttcttctgattcaaggaagaaggcgtcattatgctctggctccgaaagtatctccagaaacattttgccagcctgttcacatgagaatcaatagaaccagttattgtcttggtctcaccaatttccgtagccatgtagcttggccttcagtggaaaacaagaggtatagcttgctcaatatccttctctgaagcaagcggggcctgtcctcaattcttgggcttgctacttgatataccatgtgccctgagtctctcatgtattgcggttcatcctatagaaagcattagagagcggagaggtgcatacataggtagctagcagaccagcagcaggtaaattccattcttcagcccgttatctacgtctgagttgagcaataggtatgccagacaacgcagtgaagagcgatcaagcgcctgagttatacgctttgattcccgtttcaggatggacagtaattggtgtatgttgcgattatcgacctttgactcatgatgtagcaaggcctgaatcaactggtttgagaatgtataaaggcgcggatcacgcaggagacaagtataataaggcttcgaaatcggggatttatcctcagtgtcacctccaacgttcgttacacaggccagctgcgaggctaactctgagatgcaagcccattgtgattcttcctgagatgcattaataagaaaagacgtcattttgcttgctgagggtcaatatattgtggagcgttatagactcgcagtggcagttgatgggagctacgtattcagcgactgcgtgtaaatggatcacatgatggtgtatttgcacttgaccgaaatggcatctttcaatgtttgtcaacgaaatcgcctatttccagtttccctgtttggtctacagcattcagatacttgacagtgttagcaacgcccatcaagcaagtcattgaccttaaatatctcttccaatataagcgaacaatgttagaaggctagatacctgaagaccgcttatttctcgttcatttcatatgttatttttgtactcccacagacggtaagctgcatgaatttttccaacacttaagtgctattagaagactgctgacattcatcaaggctggaggcggactttcatgatttgcaggctccgaaatatggtacgcactttgccctctggctcacaatgacgaagtcaaatactacaataggccaattaccttcctatgatactgcgcaggaaggtttgcgtacagctagcggaagatgaagagcccttattcaagatgaagttgggtggaaataagcatttacgataagaagttcacaaatgacaaccagcataagctccgcttcgcttccgcaggcccctaatcagccccgactttgattagctagatatcgcgcgatagtgcgctagcaagcacaatacttccactgggaagtatatcaatatcatatgctcccaggtccccagaagctctcagattcaccgtcgaacatgctggatggtaacggatggagaatcccctgggattagtggatattggtaagccggctgctgaagtatccgtcccgaggctactccggctccgctccagttagagaggacaaaccggaatgcatgttatgcgtttccgctgggagccgtgttgtcagcataacagccgtggtacaaagcacggagttactatcaaaatggtcatatacatttgctcatacccttgtcaccctggttgactaacggacaggatttgttctgacaagaattattgaccaactgggccagcttgacctgttcgaaagatggcagctgtgaatcgagacgaagagggaggccaccccatccctcgcacacgccgcccgagcatgatcgaaacctacgagcgactcggagagattagccctcttaccggtcctacgcacccctctcaacaggaaactggccatttcctgcccgaaacaactcccgaaaggcggcaagtatcgacaacagatcggtccctcgataaggatgccgaccttgcggagaaggttacgactcatcatttcgaggagatcggagacgggaacccaccgcctgacgaaaccgttctataccttgcctacggctcgaacttatgctccgagacctttctgggaaggcgaggcatcaaaccgctttctcagatcaacgtcgtcgttccagacctgtggctcaccttcgatctcccaggcataccataccttgagccctgttttgcagcaactcgacttcgcaaacccccaaacccagagaaagacaatgcatcagacggaaaacccataacagaggagacctcgcgcctcctccacaagggccccgactataaccccagcatgcccctcgtcggcgtcgtctacgaggttactctcacagactacgcccggataattgcaacggagggtggaggacgcggatacgaagacaaagtcgtcgactgctaccccttcccgaaggcctacaagccaacggaccctctccccgagcgtccaagcacgaagcccttcaaagcccacacgcttctatcccccgccgtggctgaggacctagtagaagctactactacccaggaccatgctcttacaagccggaaacaatgcggtttcgtctcgcgctttagccctcttgtccgcccgaacccattttacgcccagccttcggctcgctatataaacctgatcaaaatgggcgccgctgagcatgactttcccatcgcataccggacatatcttgctgggattcagccgtaccgtataactaccctgcagcagaaggtaggcaaggtgctgtttgcggggatatggatgacgccggtacttctggtcttgctcttgcagaggatgtctgcaggctcggatggacgcagtcccccctggctggttagattggcggatgctattttctttacgatgtggcggtcgtatgataatttatttctgggtatctttggggatggggaaaggactattggcgataatgctgcgtgatgatatgaattctcgatctagacaaagtccttaggcgatgacgttatcatcactggtaataatagaaaatcggactgtttcgtgaacaaagcagatataaccaaataaatacattgaggcattctattaagccttcccatagtgaaagacagaacggctattgtataccaaagcccatacaacatgtgtaatagctaacaaaggaaattgtgacattggatcttgaagcaacattttcaacggagaataaatatctagggtacagatacaagtgtcctgagtaacatctaacgaaacatgcagagaccatcgaatagagtgacaggttgaaggaaatggcgacgtgggaccaacatgacttgttggacgatggattatatcaaggctcactagccgcctgtacttttcctccacggtgtgcaattcatacagtccgctgcaacattcagcgccgggaaacgggggggctgtacacaatctttctcgtcttgatcggggaccacttgtaacgcttgacccagacgctgatggcgaagagaccggtcaggagggtgatagccttgacacccatcttcttgcggtcgtccatctcaggctcggcagcccagttgaggaactcgacgacgtccttggccatctgggaggtggtggcgggggtgccatcctcgtactcaacaacaccatcgaagagaacacgacccatggcaatggctagatattgttagaattgagcatagacgaatcaattgtcaggtgtaatatgtaagtggtgacataccggtaccggggaagtaggggttgaagttcatgccagcaccgacggtggcaccagccgggggctcatcggggtaaccagtcagcagactgaagatgtagttgcagccaccgtgacggcccttgacgatcaagctgagatccggggggagagcaccaccgttggcagcacgagcagcctcctcgttcttgtagggagcagggatgtagtcggacagctttccgggacgcttctcgatctcgccctggtcgttgggctcggtgtcgtactcgttctcctcagccatggccttcatctcatcgacggtgtgcatgacaccgacgaacgagcgccaaggcacacgggtcagggagtggcagctggcacagacttcacggtagacctggaaaccacgacggaggctggagtgcaaaacatgagtaagatggccggtatcggggaaagatggcgagggtagtattcgcccgaaattggaagactcacgcctggtgatcgaaggtcttgttccacttggcgtgctcccaagggtacgcggtagggtgcaatcttgaaatcgatgtgtgtcagtctgggtgtcaaacagtcgggactgggaaggtgatgcctcggtcggagcaacggagcagccagctacacgttgaccattcccttgagcatcacccgataatccactcacccctcctcagcaggtgtcatcgcaaaagcctcctggccatagagatacgcggcggatccgagagcgacggcggttgcggcggacgcagtgagtgtgaggtggaagggggagctggcggattcggcaccggcggcggaggaagacgcacgctgggtggttcgttagtcaaaaaccgatacagaagctttcctgagccatagggaagcgattgtcctcgtccattggatccaatggacggtcgatgtcggggaagttcgtaccgtggaggtcttgttcaaggactggcgtgcgacgccccggaagggcacgctgcgcaaaacagtacgtgccagcatactgacgatgtgaaagaccctccggacaatggggtatttaagaaggcacgatagccaaagaaggggagaggggagggggaggggacaaggctgagcgcacaggagaatgtgcttttggaggtgaagtcgaggttggtcgaacgggtcaagtttctcttgggtttggaattgcctaaaccctcgttatgattggctgccgccccggtcctaactgccttcggtgaaaaccgcgacttttcggaacaacaattttcggcggccacctgatgattgctgaccaccaacaccatttcccagttctcgcgatagcacggtgggaagagttctacgagaatgcgttccgggtttcaatttcatacacatatcaacaattccatcgctttttcaccattctgccagctcctcacccaccgttccgttcctccacgctgaccccggcacacacactcacccatcaattccaccgctctcattggccattggcttgtgttgttcccgagaggtgctcttccgccatagtcatcatcgcctccatcttagcctgccattccgacgctattcccatgcgcagcgcctcaattgctgtccgaatatcgcatcgggtaccgttactatatagaactaacgatagagcgggcagtcttcgaaccgtgcgaccgctaagcccctaatcgccgtcgtcaatacttcaacatctgtaccgaatgctcatcctacatccagaattactaacctcgctttcataaacagcattagcaagtagcgtgggtatagcgtcggggaacgatccatagtgcagcagcacttcgtcaaaagtcgggaggatgaggtgttccgcagcctgctccacatactgcaaagccgtctggggatcgtccggagtaacttggaccacgttgaatgagacaccctcaatgattccgttttggctcaactcctctaggcagtccttgtagatattatatataggtctgctggatagttgcggtatgtattgtttgatgtctactcgatcaaggaaggcttggtcctatacgcgagtgcacaccgtcagcgtcattgcatagcacttggccatgagtaggagcttaccagcgccgtaatcaaattactggtgcagacaatgataacattcgaatgctccttcagcttatccagccctgtgagtaccgcatcgactgctcgaatggcgtcgaagggctcattgctactcagtgcccggtctctccgagcaactaaggactctatttcgtccatgaacacgcaaatgaatgtatcctcttcctcctgaaggagcgtctcgatgttctcaaacatcccattcaccagtttgctgctctcgccgaaatacttgcttcctagagaatatgcgttgatctcaaatagcttgctctggggataatcctttcccaggcgtattgcaagcttctgggcaagaccgcgactaaataagttagctaccaatcacactctatgtaacacatccacaaaccaaaggctcgtcttcccacttcctggtgatccccatatgagtatcaacctgttccaattgatggtccacttatcgagttttcgagcagaaaacgacactactcgagttggtataagtcaagagacgcgaggtgggagggggaacctcacccatcctgcttatagccgaaagaagcgttgactggactggttgatcgtaatccaagctatgcaaatgatcagtcacttgcacccttgggagatttagcagattagcatacgtctcccatagtccctccagatctatgctcggtaaggccagtactcttgccgtagcgacgctatctccagctactgttgaatcctcgagtatatgggacttctgcgagctttgttgctctgatcgtgtacggagttggtacacttgaacgtccaattggacttgctgaagctgatatgctccggactccagattcccgccgctacattcggtgacaagtataaactctagggcttgagcatgtggttcgcttagaccttctatttattgtcagaaggacgttcgggaagctgtcgtcttggggaatttctgaccgaaagaagagatcatctgtccaatggataatacgatgaaattgttcagaagccattctgtaacctcatccctaatctgctgtccagttaatatatgaagcgcgagtgtttcaaccagcctaccaaatcagtgcgaacgatgatgccatcaccagcacatttcacacgtgcctcaacgtgcaatatgggtcgttgggagtcttccactgggctcgaaatgcaactattgacgctcacatccattttgcttgttggtttgggaggtgggtaattgagagaagggaggttgaggaacgcaaagtgaacatctgtggccggtctgggaggtaatctcgtactagaaattgtggcgtttcaaaacaggcaagtcgtctacatctgcaacctccaattcacctgatcgcctgggttgagagcctgttctcggccttctgggttgatcaaacgcgtagaacaatgaacatatgcaagataagcccaatacgtaataccactgcattgaaccataccagtatgtaactatacctcttctcacaatacgtgctgccacatgtgtatatcccccctctgaagttgaaggttgattgcaagacgcccgtcagagctacctgggcgaagccgatatgacagcaattacattgaagggaggtgagaacaactggctcattgagccgtactagtagtgattatgataatattaagtcactccgttgaagactataggtactatcactctacgactactactagtactactatttccggcgcggttattgaaacttaagttggtagtacattcgaggaaatgcaacttcaatgacgacggagagctcaatgtctctgctcttaatttaatatatatcgccccactgggagattctggggaaaattcgcgaacggatcgacttgaccacccaccggatgtttcagaaattcttgtattcgtcaagaaataaactatttcgcaacaactcagaccgccgtcagaagtctgtgaaacaggtggtgatactgcttactgaggtgagatcggattccggagcagagcagcggaaaggtaagcagccggccgatccaaccgtggaatttctggggtgttccgcccacagtgacgaactgcccaaccaaccgacgcaattgctcggcgccgtggattgttcctttcctcagatttaggggctatgattccaccatgcgaaccgatgtttcatgatcccctatttttgccagcaattccggtgccgctcgattactcgggtttacgttcgactaattggggcagccccgcggagcgagctagtcggtgggaacgctgggaccctgaccggcttgtccgcgctgagcttctggagcctttaacggacgaactcgacgtccctcccgatgccgactgtgaaattacaagatgcagaaagcgaggactgggccaggtgccggcgcaaagccgcgcaaggatgttctggcttcactcaagatggcctcgatggaggaaatctccagggccattcttccagcaggtacgtctcaacggtgacagccgaacaagaaagagcggaaggggaggcggatcgcattcactgcatgacattctaacaaagaccagaaatcatgtcctcgatccttgattacctctcccctgtcgagctcatacgggtagctcgatcgtccaaactcctgcgcgagatggcatacgatgacacacgatgggtgcagaaactgaaacggatgggctgttgggacgaggtggaggcaagaaagcgtacggaagaaacgttcggcactatcgcagatgtgcgaacggttgagcaacaggaagttgaggatgcgcaagcaccgcacgacgaacctgcaccgaatgtctcacgcagttcccgggccgatttacaatcgatatctgacggattcgaccaaatcaatctaaccacttcggccaatgttgatatgtcggatggatcagagaatgatcctgtcatcggcgcgctcaaacaagtgaagtcggttcgtggagacgcacgccaggagtacggaaaggtacatgcagcactggcaccatactataatgacatcgttatgaacggtccttctccggatagcttgcttttcaagaactacaccgatcctcagcaccaagctcagatactgtcgcagctacagtccttttccaaatgcgattcagacgaaggctggcgtgaacggattgaacaattgcagtctgctgtgtcgatgttcgaaatatcggctataaaggaatttagacatggatatgagacagaggatattgatgacaggatgcggaaatatgcccacgtgttgtacacgctgaacggcggagaggcagctgtcgaactcttcatacagcacaaccatctcgttaccagaagatcagatctcggcaaagtttcggactgcattgaccctttctcgcagcgggtcaaacttgaacatacacaggccttcttcactcggctaagtgtggcttataatgaggaagtatcgatcatcaatcgtgcctttcccccgtctatgaaaatctcgaccccgtttattgataaggttgggcaggatgtgctctatccatttctgactgccatttttgatgaactacatggttcaaatacagagtcctacttgactgccgtctcaggaacatttgctcaatgccttaatctgtcggatacattgttgccaatacagaatctggacgacagctttgatgaattcatggaccatgtcatagcaaaagcctatgtaccccacatggatttataccttgctgaggaattggaccatttccggaaattgtctgaggcggctgtgggagactgggatagacagctatcggagcaggcagcctcgacagagtcatttttgatgtcaaacatcaatagacaggctgataagcgtgacttcttgacctcattcaagaaggttattatggctcccgttaatattcttccaagcttctccggaaacaaggcgaatgaacaaaaggcaccatcggagcccaccgccagcgacacctcgtctttgaaaagccccaatcggttctcaaccatcgcgtcgcccacgacacccccgatcatggaggcaccgaccacagagctcgcagcaaaagccgcgatcatgaagtctaaactagagggcattcgatctctcttcagcattgaagttgctcttagtctggtccatgcggcaaaatcaagcttggagcgagccgcgcagtttgtgaagatcaaaggcgaatatggagctgctgcaaaacagcagtgcgaggcggtttttgtcgccctcgtgcgcattctgggaaatcgtcacttgatcggtggatttaacaaggccgttgaccacttgtcgaattaccggccgcgcgagcaaggggaaagagaccaatctggcgttgagccgctggtcacctttctggagctggtgaacgttggtgatttgatcctccagatgatcgatgtcttctatgagcaggaactcatcggcaccaaactgacggaccgcaatgattttcttgatccagccgtcaaggaaaagaaaaagttcgagcagagcctggatgaacgggtggctgctgggcttaacaaaggaattgacgttctcatggaagaagttgactacattctagcaacgaggcaattggcgaccgacttcaatcctagtgtctctactgacccctatcgcaaaacgatggacgttagtataaccgaggctgcagcggccgtggtagatgtggtgtcgtcacatacgcagatgctggttgggagcacagacaagagtatgctggacgtcttcaaccaagaagtcgggctccgcctttttgctgctctgtgcaagcatctgaagcgacagagaatcagcgtcgaggggtcattgaagctcatcaggtaggactcttgtgtttatgaattcgaatgcgaagctgactttatcaagtgatatgaatcactacttcaaattcatccagacgttcaggaacaacgaccttctcctctatttcaaggcgttccgagaactgtcgcagatctatttgatcgacccctccgatgccaaagagcttgccacaatcatcgccgatgcggaccgattcaacgggatctggcgagtcgaggaggtgtacgagttcgccgagcgacgggcggattggtatcaagtgaaacgagacgtcgaacgagccatgtacggaattgggtgcaacgttatgtgaagatcatgtccagcattacgattatacggtgtatatagagctacgaataccccagggctttgccattttcatggttagagaatagacagacgattatatgatccagtagaagataaaaggactacgagttgatattactacaaatacccgaaatctaacgagttatcgagcaacaagctgacatgaccagcatgcaacaattctaagccagccaaccatgaaaacctcagtagtatcttctttcgcattaagttattactaataaaccaaccagttgcatcattcattacaacgactttacccatccgacggatcgcatctcctagaaactctaaatctatccggctaattccttgacatcaatccagccataaccttgaaaacaatgacgataataagccaaagagacataaagatctgactactccccggcccaaaggaaagaagcaatgtgtttcaacctggaaccaagccattggcgctacagccaccactcaccactgcattgtccagtctgacaattgctgactgactgagatccatttatacaatctgcaatcccgtcatgagaaatacttatatcctcccacataccataaactttctatactcacataacatatgaaatcatcatcatgctccatcgtactagtgtctcgaggatagtaccaccaacccagatcttctccatcaccaccacactcataatcctcctaagcgccctcaccctcaccacagcccaacaaccaaaatcaaccgtaataatccccataatagcacccaccaaccaccacccaacaacccccatcttacacctccccggcgctctttcaatcctccatcctagacgtcagcaacacctaccgcaaagctcacaacgcaagcaacctaatcgggaacacgacgttgactcaataccctctctattgggcaaaaggtttgaaaatggcagcattcggtatacccttcccctccctttcccccaagatatgaatacactggaacgaaaaatagctaataagtaatgtacagaacggcccctacggcgagaacctcgccttcgggtaccccaacgtctcgtctgccgtagccgcctggggtgacgaagtccaaaagtacaatttccaggaaccgacggggttcacggaggagacgggacattttacgcagttggtgtggagggagacgagggaggtggggtgtgcggctattgattgtggatataacaatactaacactactaatgataatgataatgggaatgggaagagaagtgatggtggaggcggaggaggtggtgggataaatggaacggagagaccgcagggatggtatgtcgtttgtgaatactcgcctaggggcaatatcattgggggcaataagaaattgggggataaggagttctttaagattaacgtgcagccgtcgagtacttattccgggccgtataatacgggatcggctggaaatggggccgcgagggtggaatgtataatgggattatggtgggttgtgttggggtggtggttggtgttnctgacttttggatagtttnggtaattgggatatggatagtggtataaactgaacttgaatgattgcagtagtcatcattgtctgtcatctctcattgctaccaacatcacgcacatcaaagtatcccctcacgctcgggaaagaaatatgcaaacacagattctattcactttttttgaaatgttccagacacaggtgcccccacgcgcgggctggaaccaatccaaatggatcacagatgaagtctcacagggaagagaggaagaagtgtgaagggcttcagagaggataaggaaaaaaaaggcgaggatatcgacagacaagatgcgagataaggataaaaggaaatgaaaaggaaaaggaaatagatggaatagaacacattagatacgaagctggcttcccaatcaaccaatgacttcctcgttctcctcgatgatctcttccacaatctcctccaccactgtctcgccttggtcctccgacacagcaggggcatccttggcctgcttggaggagtcgacgtcttccggcacaccgtaggcgtccttctcctccgcaagcatctccttctccctccggatccaggcagcccactcgttgagcacgcgcttgcgcgtctccacaactgctgtgttggcaatgtcgacagcgtacttgtcctcctcgtcgaactccttcgagtactcgcggaggttcttgcgcacttgcttctgctcctccttgctgagaagagtgggggggcgggggcgccagatgaactgcttgaacttgtcggtggggtgttcggcgagggtctgaccggcgaaggtgtgaatgttgtagccgttttccatctacagaatatatgtcaataatccagttgtaacagaatatcaaaagaaagaaagaacataccgagtgggtccacacgctagcactgctgacaacgtagcgacccgtaggatcccagtcaatatccgtgacaccgtagtgctcaacggtcttcattaattgcaggttggcggccagatccttctcgccctcgggcttctcaccctcaaagtccatatcccagaagtcaatgtcgaagttggtctgggagtgaacagtagcgacgacgacaaaacgtcccttgggagaccagtagatggcgttgctggtcttcttctcgatggtgcgcacaaccttgaagttgccggccgagacacccttcttttcgggggcaaagaaagacacggaggtcttggggagaacggcggcgccgctgggggcctcgcccgtggtgatggcgacgaaacgtcctccgttgggttcccaagcaaagttgatgactgtatccttgagactgtcgacgacttccacggggacacccttctcgcgcacgcggaaaatctccaggttggtggccatggacttcttggacttggagtgacggtcgaccttgacacagacgtaggtaccttgcgactgccagtgcagcttgacatccgagacgttgaacaggttacgcgtacggacaatctccttcgagggaacgctcatcaaggcgacacgggccgggttgctgccgatttcgggagtccagaagcagagcagctgttcgtactgcttgacaccctcgcggacgacggtggcgggggaccactcgaagtccataacaccatcgatcttgacggaagtcttgcccagcaagttcatccgggggagctcgtagatcgagatcgactggtgctgctgcattctcgcaacgtacttctcgtcagcagaccacttgaaagcgggccactggaccttcttcttgggctctccatcaccaccagggccggcagtcagatcgtgggagacgaaggaacgaagaggcttgccagtgacgatatcccagatgatgatgttctttccgtcttcctcgtaggtcaggaccgggtggccctcctcaacctggatggggcgggcggaccaggtggtcaggtagctctcaccgggcgagaattcgaccagctgaacgaaaggatgggggaactgcttctgcttcgagaaggcgggaccaccccaaagctggacaccctgggggtggacggaggcgaggtaggtacccttgggggaccactggacgaaaagctgcgtccagtgcgcgcgatcgacgacgttctccgggggattgctcttgttgttccagaacacaccgaccttgtcgccacggtagagggcgaactggtcacgggcgttggcgtcgcccagccatgagcggaggtgctccttctccttgaagggttcgatggtggggggcttgtattcctcgtcgatgcgtccttcacggccatagcgatcgatatccatcaacttgttgacggcgagagtgtgcttcttatcgaggggtacaccgtgcagttgcttgacggcagcgatggcctgttcgggggtctcgtactcaacgaaggcgaaactgaaacgacgtgttaatgtttccacaaccttttcccgaccacaatcagaattcctaagttgaaacatacccttcggacatgttcttgtcgttgaggggcatgaagacggcatcttccgaggtgtggccgaccgtgttgagcttcctcaacaagaacttgatgagcttttgccggctctcctcggggacgaccggaagtccatcgatcacaacaaatgtgtccaaaccctcctcaagcttcacttcatactgctccttgagatctggatggagaaaaacgggcggagtcagcgacgaggggcacgggggaaattgggcgagaagaggatgatggaacaacaacgcgaggcgcactcaccggagaagtcaatctcctcctcctcctcttcgtggaggtcctgctcagtcagggtgtcaaaactgggcgccatggttgcagtcgcagcgaacggcgatatggggggtgagggtggagagggtatgatcttgaagatgaaagatgctgttctggattttctgctggtcgaccccgatttggctgattttagggcaaaagaacaaatcccaaaccacaagcgccttctgtgtgcgaaggcagctgagtcagggctgagtcatctccccattgtccctgcttgctttcactttcgcgcggtaaagtgacggtaaatgaccattccccatgataccactagtaaactgcctattctttctccagctccaccacgtgataacgcttatctaagccacccgcccccagcttctcgcccggctgattatgtcttctgtaaccgacttgtacaatcggcttggaccagccataacatttcgcgatcctcacgcatcgtcccgctttccgttgctgctgcgggtgatagctgctggtcgttgtgggccggccatcacgaactcctcgtctattcgtttttgtcttgtctaatccatctctctccctgtcctacttcctcctggggctttacgtacctcctctctcttatgccccgccggtcctaagcgccagcgctacgcccagatctagacgatcctcctcagtgcacgaccaccgtgagctgaatcccgctgctgatagccttgcgaactcttaaattgagtccagtcagcaattgacaacatcaaattccattcagttgtgttgtttcctgcagaggtgctgcaaagcaaagctacccggtccaccatgtcgcgtaagttcggaagtctgatgttcccggtcgatgctccacgccgagatcgctctcagctgacatcatggctttttctttttctatgcaacagtatctccagaagcccgcgatcaatacattccgatcattgattcaattctcgccagaagtgatttgaccaccatctcttcaaaaaccattcgcaacggccttcaggatgagatcggctatgatcttaccccgcataaggtctgcgcccccggcctttcattattgtcgcatattgctctttgctctttcgattcgtagcggtagatctcaaacataatgctaatgttacttttattcatacagcttgccatcaagcagcttatcatggagcggttcgacgtctgtgcggcacaaaagggcatccaaaccgcatccgagacaccggcgacctctgcttccaccaccaatggccatgggaaagaccacgactcggtgacccctgttgagccgtcctctccggcccaatcttccatgtcgcagaaacgccaagcggagagtgaggaacattcggacacttcaagcaagactcctcctgttaagaagcagaagcccgacaatgacatcgatgcggatgccctgttcgcggccaaacttcaggccgaggaaaacatgcgtgcgcgccaaacccgcggggctagtacacgcagaagccagcctgtgaagaagaagcagcctgccaaggcaaagacatccaagaaagtgaaggctgaggacgattcggaccttgaatcgggctcggactcaggaaagaaggtcaacagatctggcgggtttcacgtatgctgcaaatatttcctactggaggtgactggtgctgacggctgtctagaaaccgctgactctttccccggcactttcggctttgttggatggcgaggtgacggtatgactatttcttcccatttccggtcgggcaagaactactactaacattcggacagctctcgcgaccgcagacagtgaagcggctttggcaatacatccacgagcatgatcttcaggatcccaatgaccggcgccaaatccgctgtgacgatgcgatgcgtgccgtgttcaagcaagatcgcatacacatgtttacgatgaccaaaatcctcagccagaatctgtatagtcccgatgaataaccttaggtatctagacgcgaacttatgccttccggacaaggcaatcgcagcgaccaagtcgttgccttaacgattccccgacttttgcttattacacagcatttggaacccaggcgctaactctcttttcattctgctccaacattttattacttgcttctcatattgatattttgctgcacttgttgctactctcattggcgaactgattgccctatctttctttgtgttgacctgcttttctctccagcgggagttggtgctgccttgtggacaggcgcgatggatgttgctacctagagatcgtattcgcttattgatttggctacatacatcgcatcgcgtcattgcatgatacattttcagttatcgcacgagcagccggtacagttgtagccgaaggggctagtaatatgcatcccatggctaagccgcacagatgatctgccttgtagttgcatgagctataatgagtcaaaatgagtcatatcaataactggaacgaatcccccaatagattaattgcctagttctcctatgccgagttaatcgcagtaatataaaattgatagaacgggagcgatgctcactaagcatgccgccgaaccaacttttttgcccgccgctcgtaacgtgaaagctggtccctccactgcaacgccggcttatcacccctccgccgaaattcgctgtctggtcgcacaggctcaccaaagcgcgacgcgcttcccctcccaagagagcaaattctgggcactgccccccaaaacatcacctttcctgatcacctcgagtaaccgcccctcaatctttccacgtttccaatgtccgaatcccagcccgcccaagctcccggagcgcaaggccaaggtcggggcggccgtcgacgaggccgcggaggaggctttggagctgctcgccaacctggacaaaccgatggtcaccatcaccattcccatgatggcgctggaaggggtgcgagatctaggggccagggaccccgtcgcggaggcggcagcggaggacgggacaagcagggtcgctcggggaacaagccggaggcttctgctgcaggtggacagggtgatacgaatgctcagacggcgtcagaaggcaaggggaagcagcctgtcacaacagaagagtccgatgatgcggatgatggcgaggtctgctttatttgtgcttcgaaggtcgaccatacctcggtctcgccgtgtaatcaccggacttgtcatatttgtgcgctgagattgagagctttgtacaagaataaagcttgtgcacactgtcgggtatgtgtcttgtctgattgtcttctctggtcttcgttgtggctatgcgctgacattcgcttttggattagacggaatccaactatgttatcttcacggatgaccatgccaagcgctacgaggatttcaaggactccgatttttcgcagatggacgaaaatctaggaatcaagtacgagaacaacgacatctttgaagatacagtgttgttgttgcggtacaattgcccggatagaggctgtgatgtggcttgcttgggatggcctgacctgcatcgtcacgtcaaaagcaagcatggcagagtgatgtggtaagttccttctaccgttggatgcgatgagctgtgtaggcgcatactgacttcaatgtcccagtgatctttgcacacgaaacaagaaagtgttcacgcacgagcatgagctcttcaccaatgcagagttgcgcaagcacgagaggcatggagatgatgtgcctggtgccatagaccagagtgggttcagaggccatcctgagtgtggtttctgtcggcaacggttctatggtgacgacgaattatacgcacattgtcgtgaccgtcacgaaagatgccacatttgtgaccgtcgctccagcggccgccagcaacagtactacatcgactacaacgctctcgaagaccactttcagaaagatcacttcctgtgcctcgaccaggagtgtctggagaagaagttcgtcgtcttcgagtcccagatggacctcaaggcacatcaacttgaatgccatcccaacggcctttctaaggacgccagacgcgacgctcgcactgttgacctgtcatcctttgatatcagaactccttaccagcctcagcgccagcgtcgaggtgctggtcgtggacgcgatcctaacgcggagcctctaccggtgtccagcgctcagccactgcgaagagacgagattgcgtatcaacgccagatggccatccaaagtgcacagtccgtgtctacccgcagcttcggcggccaactaacacgcaacgatactcagcctgtgcgtgctccggctcgtccaacgcccacacagacccctcccgcagccacgccagttgccgagatggaagacctcaacctcagtgccgattcgggtactcctcaagaaaaagcccgccgtctccgccatgcggctgtcgtcgaaagagcctcgaacctcctaggcaacgaccagaacaagctcaaggaattccgtgcccgggtttccagctaccgcaccacctcaatctccgccacagaactcatcgacgccttcttttcgctctttgatacctccagcaccgaactgggcaaactcatcaaagaactcgccgagatctacgaagacgaaggcaagcgcaacgccctcctcaaggcctggaatgactggcgtgccatcaatgaagactacccagctctgcccggccccggcggcatgcttcccggcatgtccccaggaaccgtgaacggcagcggagtgggaggaaagcgtgtcctgcgcctcaaatcctcaacagcccagtcctcccgttcctacgttggtagaagcggtgctatgccttcatcatcctcctcttcctcagccgctaaccccttcccccctctctcctcgaccaccgcccgctctaccccccgatcttccacccccgctgccactactccctggggcgccgccgcggccgcagctccctcagccccgacctctgccttcagcagcgccacctcttcccgctccgcctcgcgcgccccggcgcgcccagtcaacgccaacagcgccgaagccttccctgctctccctgctgcgcctaagcccaacgtcctcatggcaggtctgactcgcggcaccgtccgctgggacgaccgtcacaagccatccgggaatgcctgggcctctcggaacgaccccggcgctagctcgtctaatgcagaggatgatttccccgagttccctgcaggaggcaagaagggcaagaacaagaaggggaagcagactctgttccatttcggataatgatgatacataccacaccactatactgttcttttcttctcttcttttctttcacctcacacatacgaaagtgggtttgtgtctatgcatcgtcggtccgggtcctacgtttgttgatgatgtcgttgcttgttcagcttgtatttgagcgaaaaatgctttttacttctagagttgcttgcgtgaggtaaataaaagctagtgggctggtttttctttgcgttggtgcagggggatgaatggaaataagtacatttcagtctggggttggattatgggggtgtaaaacaaatgcaacacaatactgttaaagtcatacatgatgtggtagagatgaacggatcaggattcagtattcattgaggaaatgggattctgttcgtcagaggaatcatcattattttcagaacgcgacgtggcgagtccatctacaggcccctcggagacgtccgagggaggagctaatagtcgtgatatacaatcattaggactttcgagaagggcttctgactcaggaattccaagctgaccttcagcagtttgcaccagggtttcacccagttcagagctatgatggacctcagggccctcatcatcgaaaagaaggttcccggtagaactagtgtcctcgtacacttccctgggcgcaggagcgtcttcgtcgctggcacatgccgcgtcctcgtcgatagcagccatactcagagcaaagtcatcctgaagccgcttcaaccatttccgaagggcttcgccttccatagttctattacggactagaaggagttgttctttcagcgaaaggatcagattccgtctacgagtcaccgccaaggctctggacttgctatgtcggcgtttagcgagctgattgagtttctctgatacctgctgtgtggtttcgaggacacctgggggaaggtcaacaagcttggctagagcgaggccgtagaattgattcgtatcgatgccttcggctatcttgtagagcatggtcattttcgaagcatcgggggatacttctgccgtgagatggaggctcacgacgccattgcgctcgcccattattaaggcgagatctcggaaatgggtcacaaaccagactagcgcgtggctttctacgagtgcttccgcgatggcgatggctatggccaggccgtctgttgtgctggtgccgcgccctagttcgtcgacgataaccatgctgcgcggttcgatgttgcggaggatgaaggccatttcgcgcatttcggcggcaaaggtcgaaatatttgcttcgaggtcgtcggacgtggagactcgtgcgaatagttggtggacgatggggaatgatgcatattctgctgggatgaaacagccgatttgcgccattacggtcatcagcgctagggtgcggatgtaagtggatttgccgctcatgttgcagcctgtgatgatctggaagcgagactgttgcgttgcgtaggcatcattggggatgaacttcttcgtgtgtatcttctcgcggatcggatgacgtccggatttgattgcgagagtatctgtcagttcaggccggatgtagtcgtttgatgttgctaattgggcgaacgctgttaggatgtcaagaatagcaatggcttcgcttactttgaagagtcctgagatctctgagcagatgttgtgaattagtccctgcaccgtttcgtcgctcatattgatgacttcattgtgtgcatctgtgatcttctgattgagcttaacgagatcgagcgtttgacactctatacggttctttttgcgaaagacgttgatgaagacgtctggcaaggattctactgttgtagccgagagactaatgtagtattggcgagctctgtcgaacttcaagtcaagggctatactgtacgtttctactactatcagctatgagcagtttctatgctccaatgtactgacctgctagctctgctacgagatccgcggcatctgtattagcttctttgtatgtttgtctcgcgacgtcgaggaggctgttcacaccagcctagagtaaactatgtcaggcatgcaggggaacttgcacatgaggcttacccggacacagtaaatgcgctggttcctgagatcaagtggccgggtttggtatgtgacatgctcgttgagagtctcttcaatcatctgctgaacagcccggtggcctgctggggcacatagctgtatagtggttagctaccgcatgacaatatcaacatacagctacctctcttatggttgttagaagactgctttgagctgccatcagtgccttgtaaactgacttgattgatcccacgtatgtcttgaccatgatgacattgttgacagactgctcagcgtattgtaaggctcgtttattgggcacaaggatgagctggattgtcagtaagctattaagaaggctagttctccacttacagaagtaagaactttatccgcatcaacaaagcctttgagagctaatatttggtatggttagaatagagtcatatatagcaggattctaaacgaaccttgtctcactgagacaaacatgtcctcctttgtagacaaatcctcaacagcatcgtatcgtgcttgcagctttgattcctcggttgatggttgaagaatgttggctctgagaagccttgcacccataggtgtcagagtctcattgagaagtccgtacaggctatcctttgatttcgcattgtgtatattttggatcaactccaaggagacaattgtggatagatcaatggacatggacccctgtgatggctcgaacctgatacgaagcgagtggcaggtgaaggttctgtttagctccagctcgacatactttaagacctatggaaattagtcgtgtcagccagacggttgtggtgctcaccgcagcaaagcagcaggcagcataatagttccctcccaggacgattttgatgggttcaacatccccagaaaaggcgagccggtctacatagtcatggccagccctctccgaccagaacttgcggtctaaaaaggtaaatgtagtatcttggatattctcctgtatgatgtagaacaacttggattctttggcagaggttgcgaacagaatctcggtcggttcgaataccccgatcttcgtgacagttctgacgtacgtctggctatcgcatatctgacacaacactgtctctgcagtggatagattgacaaaagcaaggccaaccgtcgaagagatacctctggactcactaacggcacagatgatgtcctgagaagcaacgcttgttgctgttgtcgttggcctcggcgttgttctggggaatgtgctggttctgaaaaagggagcaacagagctagcagccccaatagaggagcttcgagcaaatgaaaccgacattctgcgttttgcatgatttaccagctgaggaggagagcgtttttccattgatgcaggatatagttagagctgccgtccggaagcggactagtggcgatagactccccgcgatagcgacggctatcttttatctttttttcggcgaaaatcttcaacgacaaaatcatccaacaaagagcgacacaatggcgactcttctacctcccccgtcgaagcgtcagaggacagagaatgctgagcgggcccgcctgcagcaggagatccagagtgttccagagaacctgggtagcattcgtgtgcaattcttcgaccaggcgacgggatctgcgaccgggccggcggtgtccgttccagttgctgatgccagtgtgaagaatctcgagactcttttgaatacgttacaaggcaatgtaggtatgcagcaaggcattgttcagcatataccagagactaatagatttctttttgcgccgcaggaagaagatgagcgagtaccgtaccggttcacataccaatccgatggcaaagacaaaaacgaccagacaatcgatatcctctctgacttgtaccactccctcttgaagcccggcctgaagacaaccgaagatactgtacatctctacttcactccccaggctgtgttccgcgtcaaagccgtttcacgatgctccgctgcgatcgccggacacggcgaggcaattcttgcgaccagcttctcccctgttaactcgtccacaatggttaccggcagcggtgactctacagctcgcatctgggattgcgacactggaactcctctgcacactctgaagggccataccagctgggtgctggcggtcagctactcgcccaacggcgcaatgattgcgacgggaagcatggacaataccgtgcgcttctgggacgcaaagaagggaaccccgttgggcgcgcccttgaagggacacgccaaatggatcaccagtctggcctgggaaccataccatcttcagcagcccggccggccgcgcctggcgtccgcgtccaaggactcgacagtccgcatatgggacgtggtctcgaaacgcatcgacaccgttctcaccgggcacaagggctccgtgacctgcgtccgctggggcggaaccgggaacatctacactgcttctcacgacaagaccatcaaggtatggaatgctcagaacggtaccctgcgtcagaccctttctgcgcacgcccaccgcgtcaaccacctggccctgtctaccgactttgtcctccgcactgcgtaccacgaccacaccggcaaggtgccgcaggccgatgccgagaagatcgcggcagccaagcagcgattcgagcaggcggcgaccatcaacaacaagatcgtcgagaagctagtatcagcgagtgacgacttcactatgtacttgtgggagccggttaattcgagtaagccaattgcgcgactgctgggacaccagaaggaggtgaaccatgtgacgttctcgccggacatggcgtacattgcgtccgcgggattcgacaaccatgttaagctgtggaacgcccgtgacgggaagtgagtttttaccacagcttcaaaatgtgacatacaagtactaatggacaatagatttatcacgacactccgcggccacgtcggcgccgtgtatcagtgctgcttctcggctgattcccggctgctggtctcgtcgtccaaggacacaacgctgaaggtatggaatgtgcggacgggcaagttgcaagaggatctgccgggccacaaggacgaggtgtttgcagtagattggagtccggatggacagaaggtgggaagtggcgggaaagacaaggcggtgcggatatggaggaattagataccacacagcgtattaagttatctaacttcgtactatactagtatactactatagaacgcatgacactgttatgactgacaatatcataataacaacaacataacaccaactatactgcccaccagactaaatcttacaactaatgaaatcaaaatcaaaaatatcaacaatcattgatcacattaacatacatatacaaaacactcattaataaaaccaaatgaacacaaccactatactaccaacccacttcatctataactactctagtatcttttcctcaaccaaccaaccatctccaccaaaactaaccccgccccgaaaaggaagtagtactaagtagtttagatatactcccaagcagcgacagaaccattggtagccacagcgagggcatcaaagcccaagcaatcagcgacattgccactgggcacggtagcattcttagtagcagcaaacacctgccacttgttaccctgatcagggcaagccatgaagcccgtagcaccggcaccggtgaaagtccagctgccgaagggcttgccgggggtgtacttgaaggggccggtggacgagccagcggggatgtaggccgagtgggggacggtgaaggtcagggcgccgctgggggcgacgtagacttgctggccgccggggacttcgacgtcctatttcattatttcattagtatatgggggtcttgtgtggttttgatgggggagaagagggtatgggaaaggtaatatggttatggttatggtatgggggaactcaccaaagcagagccatcaccagcaaaaacggtctcagtaccagcagggcagccggaagagatcgggcagtaagaagaggtgtttccacccaggtagaaaccgccgctgttggcgttcaaggggagaaggtggatgggagagccggagcgggcggacatgatgccgaaggtagagggagtggtggcattggtggtatcgcgctgctgggcgggggcagcggcggccaggaggggaagaagagtagaggcgagagtgaacttcattttgatggtattagaaagttttgattataatataatatagagataggtgtggtggtatggtgtggaaaggtatcaagttgttttgtttgaaaacgaatgtctttggagtactgaaggggaagagaaggaggatccttaggctgtatttatatccttcgatgatcagactatgagatcaaccagttactattagggaaagaaactaagtggagagagagctcgaagagaaagagtgagagtggccagtcgagcaagggcctccatcacaagaaacataacgagggcactacggtgcactatggatagcaacagacaaaacatcgcctccggcatccatctcaaccctgccacagcagaaaacgcagggaagcggcacgagccgtcagagaataatagagcctaaacctatcagaagaggcctcccacttactatctgctagcccagcacactaaagtgaaaccgcatggagacgaagaccctcaccagccgtgcagagtggctcaattgaaggaaaaaactggggaacccatgagctcatgacgtgccggttaaacgacctgtctcagttgttgctccgagacacggcaagggaagaagaagaaggaaaagggaaaaaagattgatgcccgttggcgaccgtttaattatagaacgacgatcatctccaatcaataccaagaagtttagggaaaacagggtccgtccagcagactagcaacttactatgtagtcagggttcccggttcccgaatatccgatgccccaatctaactcttttctcacttgctctttttttggtcggtcggacaagcccgatttacctagaccatcccttacgaaggttttgctgaagactgagcttcgagcgcctttttccgacgcccgccacctttcccatggaagctggtggccgatcgacgtcatcgtcgacgttgcgcaccgccacagtcaatacgagctgcagaggcgaccatgtctcggtggaacgatggttcgtccggacgaagcaactgcgcgtgtccgaacagaactttaacctagtccagagggttgatagaccgcgaaagagcacaaaggaatggattactgctatcaggctatcattcatacattctcctagggtaatgcaatacagtacagtcccccataagatgagcattttcgcctctaaccgttgtgcgcgggaccgtaggaccaggcgcgaaaaccatcacttcgtataaagcaagtcacacgaatcgaaagcaaggaagcattaatcaaatatcacgtagcaaggagaaatgaaccaggagaacccgaagaaccctgtgacaccggcccagatagtaacaatacacccccattccgtttgaaagagcccatcaccaacaccgcagaaccaaaccccgcgtccaaccttgacccgtatatatataaaccgcgtgagcaaaaaaagcaaccaaaaacacaaaacatcgcccattggtatcccgaattagcaaacaaccttggtttagtcgtaatcgtccccggcatcgtctccgtcgctgtgacgcccgcgagatccctttactccgtccttgcggatgggaatcttgatcccctggagggcaaagcatttgctcagtggtgtgctctcaatgacaccggggaacttcttggccgaaaatacgtggaatggctcggagaacaccgaggccagtactggcgcagagccgtggttgatcacggagaccccgttgggggaatcgccggactggctgcctacattcacaaagctcattttgagactgcacgcgaaatcagttacatcaatcaaatcgtgatcggctcaaaaatctgcactcaccggaaagagccctctgtgcggacactcaggtcctgcaggataaaccacactccgatcttgttttccgggtcggtcaagcgaaacgcgctggcgctgaggctgccgatgaggttccgcgtgaacatgccgccagggccagaggccacaggctgcgccggggaaatgttggtgggcggcatgtgaccgccggcatagtaaggctgataatagggtgcttgtggattcgctccatacgggttttgatactgtagttgggggttgccaccgtagtagttgttcatctgagggtatccaacaggctggccgtaggcattttgcgcgtagggcgggtaggaaggcgagacactatgcggcggaggggggtatgaggaggacatggccgtcgatatcgagggagaagtggcggagtgcttgacgaggtttacctcgctggtcccttccgcgttccacaggtcgaccatgagcacatagaaagacgtgtcgatctcactagaatggccggtcagcacctatcatcggcagagcggaatatggtgccgtcatacttaatgtcaatctccttttcagtttgggcatctcggacaaccaggcgaatgcagggaggaggtgtaatgggtcggcgatcctgagctacagtcagctacccatcgaaaaggtgggaagaaaagagcggttcaagacagcacagcaagacctaccttatcgccgaagccacacatccgggcgcgaaccggctgctgaaccacctgcaaagaccaaatgcgattttcatggacggtggaaagcggcgctagatggctcgacggcggtaacccgccggcagacgcgacgcctgcagagcccggagtggggtatgaggaggatgggggagggatacgatccatcgagagcggcggcgggggaggcggtgcggtatgtgtgcgatcgtccagagcgtacatgacgctcatcacgttttggaagaaggtgaaagtcgaggaagtggtggcggggtgaatgcccgaaactgctgcagcaagactcgcgacaggcaaacccaatctatcacgagtctagatcgggcaacgacacaggctcctatggcagtcttgcaaaaaggaaccggatgaattaacacgcgtcgtttggaggatggtgcacagttgtagacgtgaagctcggagaagtgaggattgaactctgggtaaggcgcagcgacgagctgtcaaaatgcgggagaatcgctgagccttccacggatcggccgcaggaccacaggttccccaacgatgaccgctttatcctgggaggtagcacaaggacaggaacccgcagggctaaatgattggcggctttgaagctgcgagccaacccgaagctggaacaagacagaacagaggatagactggaggaggaggaagagaagccaaaaaaaaaaaaagggcggggttgcgaaagagggcaggctgaacgtgaagagggaagacggagagttggtgcggacagcagaaaagattggagcagccgaggaggggacgaaagcagaaggtgagcgagtcacgggcagctctcgaggtccagaaccttaagtttgggaggagatgagctcatttgcggtttctacttaagttactgtgtattacatctcgatattcctacgggcgctggtcctttcgattccattttatcgaatctgatagacgatatactattctactatatccaaggaagcatgatatcctaatctcaaagtatggagtcagtcatctgttgctggaagggatttccatagaacgcggattgaaggaaaaaggaaagccagtccacgggtcccgggggaaggaggttagagagggagccaacagtcccagcagtccccaagcaatccccagcagccccggcagtcactaagattggggggcagaaggattggggctaatgggcttagctggctcttttccctctttcctccctgggtcgtagcgtcacggatcaggaggcgatcaacccggcgcaggaacctcgcgacccagacggtcgggttcagcaactgcttttttggcccagcaactcccgctggatttttccgcaccggtcctttgtttgctatttacctttcttttttggtgtgatccatccatctattcttctctccccaccccaaagttttcccttttgattgctgtttattttccctgactctcctttgtctgtattcctgccaataaagccagggggggggggggcattttcatgcagcaggcctttgctgtcaccgcaggagtgggtcgagcacataaatgcaacgaaaaagagatgcagccagctggagtctcctctacagggattggccaactacggcaacccaccccggccaaggtgtgcacagttgtggagcagttgctcatgtttcaaccaatccactgcctggatccctagtattgggtcggattgaaggctgtggtcgccgttccaggtttaggcggcaggaaatcaaactccaaccgttccgttttcagtcaagacggaccccatcggcaaggaaaaatcccaccggtgcaccatccactttgtgccgccgggagctgaagtgtgtaagacttccgatctctttttccctctggagactttaccttcaaccaataatagatttagatctcacttatcttacattccctgactcaggggaggtgggatggtgattggaggggagagcagaccaatcgcccgtagacggatgatcaccgtggctgttgcaccaatgcgctgccggagaaaatgggaaaaaaaggccctcgctaagtcagtactctaaataaaaatccaacaattccatcgggcgcgggcaccaccggtggatcggtaaataggcgctgcattggtacccggccacttgccactacgtacactcactgctcttactgtatggggatgcggttgatttatccgcagtactgccggccggtcatgctccgtctcgcttgcatcgcatgttttgtgagcaattacaaatactcggatcgagtgagatactacacatagaagagagtcatggccaccgcgaattttcacaattttatgaacatttgggcataagtgactagacccagaaggtcttcaaattttctgtggtttaaaccacactgagtacggagtacacagtagagtaatgaacaattgaatattacttcttggtcatcaaaaccagttttcgcgcacaggcgcgttgctcaatcaaacagttaaaagtcacctgcaagagaatccatagaaggcaggcgtctggaagatcgttacgccttacccgtgtgacacatggtaacactaacaactactaattaactcaactatatgcatgtactttcctggagggacagcctgtcatcgtccccttctgcccggatctgcataagctctcacctaaatagaaactcaaatagcgactacgaagatcagagcctctttgactgatggcatcaaccggtttgtcggacatggttacaccgtgactaagaatgaagtcactgactcctgcaacgcgatggattcagcaacaaggaatgtccatgccggtctgcagctatccgatggtccctgatgaaattgtccagtatgtggtatgcccttcggtcgcttcattatacccatattccgtatacattccctggtggtgtcacaggcaagggatcgtatgtatccagggctggggccagaccaatcctgcggtgacaaaggtcccccgaaactcccccaagtctgataccaagggattgtagccacattcaggcggttccatggtggtaattacttggcttcatcagcagtgccagggggttccattgttgcgcaaggatgaaagggcgtcaacaggagtttccaaccctcggaaaggaaggcggacgataaagctgcgggataagctttggtgctaacgagagtctgcagggatgctatctcacaaacttaagcataacagaggatcacacgtgcccgcgtgccggtgcagaagacaaggttttcttctgaggaagaacctcggcagaattacaggctcctctgcagctcagtcactaaccgaccatatcttgccctgaatgtgtccctgggcctcctttgaatgcagccctgggcctttttaagaagatttatctcccgcatgtcttttccgaggatgggtagatcgtggattcagggacgacccaacgatgagcccgacccgggagccccacgatcagccatggaaaaccatctcaagggtctgccaactcgcgagggaaaactcggcagaggaagtgtacttcgctgagtgacctggcctggaaacaggattgaagctgggttgtgaacatctggaatgcgggggtagtaacctttgattgaagaatgtgagagcccggggccggcctagaacgagccgaggacggcgacaaactgacaagaaacgtcgaggatgatctacgatctgaaagattcgatctgccgggcccgtctcagggctgaataatgaaattcatgacccaggggtaagttctaggtccggggccgcgattggtcgccgcctggctgggcagctgcttttacatcccgaactatggacgagaacgaatagccatacttgctaccagttcctccatcactcttgtgctagattccaagcctatcagaacgacaaatattgtgacccactgtttccagcaaaagtatgtacctgaatcaaattgtgccgcaggcgatgatgatggggacggggtacttgaatgccgtatgccctggaggctcagcgtgctgccacgggtgagcggcgacattattgtgtaacacatacaccatctctttctgcctctcttcctgcagaccatgaggtgctttggggtttcatatctccaatgggtctggggatgcgctcttctgcaaattgtcgtgtctgcctcctttgctcccatcctgcctccggcttacccccttgctgttcgcagcccctatctgtcttgttagtctacctctactctggactacagtcctgatttgcattgcctacattgtgtagaatcaattgtatactgacgtatacagcttggcttcccggaaatcaggcctctagtcttccctctagctctcctcaattttggtttggaaataacctcacatggtctgtcattgctcgcgtagatggacaggcatacagtcttttcggagtctccaagaagttggaaggcatcgaggctgctactgtcagagatggcaatttcacctcgacgcacagcacttttctgctgacagccgggtcgaagaatttcaccctcgacttcttttcgcctgtctccccgacaaactatctacgccagtcactgcccttttcgtatctcacgatatcagttaatggggtatcgagcaatgactccgttcagatctattcagacatcgattcgtcctggactggtcaaccgaagaacgcgacttgggctttctcagaaactaacagtacctcagtgtttcagctgagtcccgtggaagaggccttgttttcgcaaaatgctcaagaacaagcgctgtggggcgagacggtttacgccacgcgggctacaaatggaagcgtcctgtcttctgcttcggggccgttatctgctatgcgttctcagtttgtggccaatggatctctgagcaactcatacgcaaattggacatctgatggtgttgtagcatttgcgcatgagctgggatctagtgcaaagaatagttcaattactttcgcgataggccatgtgcgcgagcagaccattgattacctcggtagtacgcaaactggatactaccgagcagattatccaaatactgcgtccgccgtctcacatttccttgatgattacttggatgcactgaatgagtcgatcactatggacaaattcatccagaaaagtggagagtcatcatatggcaccaactactccgatatacttgcactgtctcttcgccaaatctacggtggcatggaactcacaatcccgaatgatacattagacaccaacgacaccatggccttcatcaaagagatctccagtgatggcaacatcaacaccgtcgatgtcatctacgcatcattcccggtcttctacgtcctcaactccgaccacatccgactcctcctgaaacccgttttcgagtacatggccaaaaccaactacacctacgactttgccgtacacgacatcgggatggactacccaaacgccaccggccacagccccaaaggcgagttcatgcccgtcgaagaaagcgggaacatcctcatcatgacctacgcctacgaaagcgcaaccaacaggaccaacatcacaagcacatactctccccttcttcaaaaatacgcacaatacctcaacacctacggcaaatatcccgacgcacaactctccctcaacgacgccctaggcaagatcgccaaccaaaccaacctcgccatgaaagcagccagcggcctagcctcctacggccacctgacctcacagcaaaactacaccgacgcaggcaaatccatcgccgacgccctctataacggccggctaggcacagaccccaacggcacctatttcacgattcagtacggaagcgactcctggttcctcgcttacaaccactacgcggacgtcctattctccctggacctcttcccggacgaagcctacaatgccaccaccgccttctaccctaccgtccgcaaaccagcgggcgtagccctcgacgctaacctcgactggggccaaaccaactggcaggggttcgtagcggtaacagtcaccgacgaagcaagagacatgttcatctccgatatccatgcctacatcgctaatggactcaacgatgtacccttctcggaccggtactgggtaaacgatagcactactggtgaggctggtgagtactttgctttccgtgcaaggccggcgctggggagtcactttgcgttgatggccctgcagggggcggatcagtggggtgggttgattgcttgatggggttggcatatatattgcattctgcgtgcatttgtaaatagttttaattgagttttagatttgcagtgatagagagaatagatccatgcatcattcctaacttgctcagttgtgatgagtaaatgtaaaattatctgcatctcctgcgacttatattaatgatgggatgtacttagatcgggatagtgttacacataacacccacaatcagaggcagaaatggtagtagaccagtaggcacaacgcaacgtactctcttattatttacttttccagataccggatatatatatcacagcagaatatcgaattaacattcaatgaaaacgcaataccaactagtacaacgtgggtttagtatttatcctttttaaatgacatagaaagccaacaactactaggttggctggcaataatatcattatcaaaaaggctttggaattagctgcataaaagttttgtatcatgtatgaaacatctgtattgataatatttctgttcaattttactacttaaggtattcaaattgtagttgggattaagcagtccgtggttacttatatatatatttactgattgtctacgataatctcctaccatcatactgctagttactattactaactctcgggctacactagtatggagtcaatattagtgagatcttctgcaaattaactcaagatcttatacttgtgtccatttcttgaaatgctatatatatatttggagcaattgagataagtagtattatcgtagagatacaaaaggtatgacttgttttagtattaatagtattactacatcattagaaatactagtaggaatcgagtaagaacctaagggtgccgagagacgaaaaacacctgatagtaaaagtgtataatgaatccccctcctcctcctcaattctcttaggttacgactagtagtcacatcaaagtcaatcaccaccaaggccaagatatactctgcatggtattaattcaggtaaattctttttaacatcgtattagtgtgttaaccttttttacacgctatacgcacaatgtgtgatttctgtattctaatgtgatttattgtgtagagatgattattactagaggggctgaatatgagtgtgattttgattgaagtatactatcgtcgtaaggttgggtgcgagactagataggtgatgggatgcaaatgagtgaggtttgatagggtctagatagcgcgttcggtcgccattggattcaccgtaatgagtaaaggtttccgaggtggtaatggtagcaaagcaagtaattaaaggatggatgaatgtccggtcaggtcacggttagcaaagggcatgggtagttgtggaatcgaagacaattggtccagaaatggcagcaagctcgttatgtaggatctgtgtcttagataagttgaagcttgagcttacacgtgtatcttgaacagatgggatatgctacatagttagagagacgcctgcggatggtaggtcgagacgtaatacgctcatgttgctgttcaatatggttggctgataagactatctggttagcaagtaaaatgacagtattgtgattgttgagcacgacctgcattgcagatgcaattctaccatgctgtcaggcaagcagtgtaatagcaagtttagtagtgtagtatcgtgtgtcaaaatctacatagtagaaatctgttcgcattttatcaacaactctggtgattggaacctggtcttagacctccaacctcgtagttgaagagcaactgccaggtttccggttggatttgagatggggcgaatctggagtcactctataacgcaacaaactgcaggagaaaaaccatcagcggatgcattcggatgcagacgtacaattccctcaagctcggaccttttgcctcgtaattgtcgacagcttctgtccgttcttcagacagaccgaagccccactatgggcaaagcatcatttcatctcatcacggcgactccgtatgctgtgccagtcgagaagtaaacgtagtaacctcccaagttgcacacatctgtacacatccggctcttcggctcggcgtatctccggcccagctgacccaagtggtctgacgagaattccaacatgtccactctctaaccgagcatgtccaagattctgggcgaatcaatatgctgacgccttatcaagcgccctaacatccagtcctatgcgctgcagctgtgggctcgagacgatgctaagccgtcaagcatggaacgagcgtcccggatagacagccaggtccaacgggctcatggcaccatgccccatcgttgctaatgcagagtggccagttcgtttatcaccgagtggcccaggatgacagatgagttgcgagatggagggattcatatataagcaagacctgcattttcccagtcgggaatgacgatgacgtcttgcaggaagagaaggatttgcggagacggtgtatctgatgtgctggctaatcagcagctccaacacaccggtatggtccaatccgatatccaacgcgcgcgactttttctgacgccatgcctattcgagtcaaagcggccggccccccaggcgcatctgggcgcatggagaaatctaccagaagattcagcgaagaggtctgtgatctggaatccacccgtggcttcagccaggcccgctgttcgaggaccttggccccaacagtggtcgttccttctggaccgacttcgattgtcccgtcggcacgattagggtaaatccaatcccccggcaagaatcaggtggacccactggccgccttttgatcgcggtacccaacggtgaggccggttaccttccgccggccgagatgtagagggaactagtatagtagtatctcgattctagctagccctggtccattccagctgacgctcgaggattactcacacgcgcaatgttggtggaaaagcgccgggcggaacggtcgggcttttagtccggagtatggctagctgtaggatgcatgcacctcgcactgtgggctgagcttgatcattgggcagcgagggcaacgtcacggacgattggtgggatgcctatgtgtgatgctgctggaaggcgtgggaggcgtgggcgtgggtgtgggtgtgtgtgggagaggctgcggaagaggctttgtcgcagccggggtccatcatccacggaaagtacgccatggtgccaccgtgcccgattccatcgagcttcttgtgaaagagcaaaatgacaagcgggtaggtcagtaactcctccgtgacgttagagccaacggctttcccctcttcagcggggtattggctcttgatggattgagtgattcaggatgatcgttaacgaaccatagctagctagctagctagctatgagaggattggggttttggctgacatcatcgggtccaacatctcatgattgcggagccgaaggagatattcggagatgtgagacacggatgccatgcaacaacagagacacagcgtggacggagaagaaggagggattgagacactagctgtctagtaagagtcgtcgtgtaggtgtacagtagcgttagctcccaaagtaacagttgggtgaaggaacgaaccatcgaatcaggcctgaggcagcctcgggcggcgggagagtcacgggcccgcaccccttatgccagatccggcaaggcgggaagaaagcaggccaatgagaagaccgataggcccccaagaatctgagttacccaaaacagcaaaagcagggttcatggaggcctagcactaagccgcgataggcaaagggccaggagccgaagatggggatttgacttttaggttttttggctgcaagtggatttggggtggatcccggctttgtcccaagacggcatgacgagagattcattgctggcctgtcggggtggaagcatccattttttttcttctcttgtcttctccccatccatctttcacctttatcccggaactgatggatatccgtttcccggatggagatagaccgcttcttattcagtttcgggggaagatctgggataaactacacttagtctcacaaatagtcggtagattattgttaggataaacgggggggcgctgcttcagggggtgtgactgcttatgcctgattgggtcaattggggtggtggtcagtggggcatgtcaaggatgggggaagaaaagcacaccactaaacccgactaaattaatactagttactggtattagatagtagttgtctatctactagtagttgtgaacagttaaccctctttttttcctttatttttttttgttttttttctctttctcgtggaagatcacagacggtataccatgtagagtaggatgaacactggacatgcacagtacttgcttaattgtacttctttttttaaaccaacaattgtacatcaaatctttctaatcaatgatcatcctctcaagatggcaagtcatcagcgagcagggtcatgacagacaagcgacagaaagaaaagaggcaacaatgatccagggttcagtacaccgcgacccaagacaaccatttgcccattcgaccgcatgatgcatcaatctgtctctgtctctgtctctttgccttctgctgctacggcggttggggcgccgagcccctcgtagcgctgcattaaaacacaacaaatcctttttttgcccgcatttactggtttcgtctgtctttgggaggccagagccctccaaatccatccaaacccatgcccataccatcggggattcgcactcttactgcctccgtgcaaaagacgacggagtggggcagcgatctatcggctagcttgggacgactttggaattattgttggaaaactgcttggtggtggagggaaaaagtgggttgtggaattgaaggtggtcgatgagcgggttttggaaccttctgccggaaaagaggccaacagtgacctctttccttcttctctctctctcctcaaaaagcatggggagtcgagtcgagtcgtttgaatattaaatctcatggatctccagcaatccactccggccaagaaggtgctgttgaaagttgagctgtaacagtcggaggggatctaggatccccccccctcccccttctcccttcagcccttccagcatctcctcctccttctcccggaacttggaaagaaggaaaagagaataggacaacggggaataataataaaaatctccaagggaagaaaagaaaaataaaaagtccccagcaatgcctgcacggcgcacctatagagccccggcgcggaatggctgttttgagtgcaggaaccggcgaatcaaggtaggtgctcttggggttttagtcccggtgaagcttaacttaagttgcctggcctggcctgctattttcttggttgtctctctggtccactgaaagtttccatcctttttcccttcttctgctgctgctgctgcttcttcttcttacattttccctcttttttaattttctcccttctgtttctttcccttctccattcaccaattttcctctccctttcctctcccccatcattgcctgggtgcctggatgcctgaatgatgcagtgatcccttcccttctcttcccggcctcctccctctcctactttagatatgtacctatcagtggagctttatctgcttgtttgattgctgctgtggatcgggacctttgctactttccattcccaccactactaccaccaccatcattaccacaaccccccctcctccctcccctgaattacaccgcatcacttcttaatttcagtggttcttttcaaattgggactggtggtcctgtgtcgccctcatagatgctaattggaccgggatgcagtgccccaacgaacacccccagtgctcccattgcaccagcgacaacataatatgtcaatatattccctcctcccactccttggtctggcctagggtcaagtctcgctccaccaccccgacccttcccccatcccgcaccgcctccccttcccacatgaaccccaggattctcgctgaataccgcgtcgtcatggaccccgtcgccccttccaatcccaccggggagctcaacatccaagacctcgagttgatgatgcaatggtgcacgaccacataccgctcggtctcgcgaaatacctcggtagagggaatctggcagggcgtcgtgccgcgggaagccatgcgccacccattcttgatgcacggcatcttggctctctccgccctggacctgggcttcaattgcccctccggcccgcccaaagactactacatccgaaccgcccaggcacatcagtcccgggctgtgaccggtctcggcaaggtcgccggatgtctggatcaatccaactgcaatgccgcttttgccttgtccagtatcatggtcgtcttttccttcgccctccctcggacgacgaacaaacacggggacgtcctgaatgagcttctcaacatatttcggttcacacgcgggtcggtggacgtccaaggaggaatcatcgattgggtcgcggacggcgaattcagcccgctgctcgagtgcgacacctcgcagccaaccatgcccgacacgtctcggctggccatcatgtcgctgacacgaatgaatgcggacctcgccagccgcgatcctgcgcatgataaggccacgtatgacacgacgatccggtacctgagctactcgctggacaagctggcccggggcggagaaaccatgattattgccttccagtggatcttccagatcccgccgcgatacttggatttgctgcagcagaggcagcccttcgcgttagccatcttggcccattacgcggtgattatccactcgctgcgaggacattggtggatgggcgagtggggagcgcgactgatccgggagatcggccagcacctgggtgcagactggagagactcaatcagttgggtggtggacgcgacaggctgctatattcctccagtctgacacggttcatggacgagatttataagtacctatttttccactctccaggccatgatctgcagttcagacaccgacaatggatgcatccgcacgctggagagtatcgtgtggtcaacatgactacccttgaaagacgcgtgcagcgtgcacgctgcccgtcgatagccttgaacccaagggaaacactactgccatccgtggggccaggctctaacttgactggcctacccggaactcatgcaatcgtgaacaagagggaattatgcagtggactgcaacagaaagaagaccaagacatgacgggaaatcacatttggggaggccgaccggggataagcactaagagcggagcggaataaaacaccacaacgaagaaagacaaatgcaataaactagtggaacacttagttggctagccggtggacatgaaggaggaaaaaaaatgccgaccgccaatcactcaacagcacaatctgaacaagggtgctggacatctacaacatctaccactacctatggcatgatcacatgggacacatactcacttggcatgagatggatgatacctcatcagcaatacacggcgtactttggtatttcatttcggtttcagagcaagctatgcatagatacatttccaatccaatcatagattcacacacgatctacactatttacctcggcatagactgagtaacagaacccctcataataatacccgtagtaatagccactaaagaaacaaggcaggaaaaaagcaatatgcagccatccccattcccagtccccatagataagtccccgcgatttcattggagacgcactaacaatagtgccaacaaccacatagtacaaaaggggcccggtgagcacttgttcaatttaaacaggaaaatgagattatattactaaaacagagacatataatgataccccgaatccaaacacaagaaaaataccacaacagcaatcaaaaaagatgacagtgaaatgacaaaatccgcccatcgcgccgttctttttcccacgtccgggtttctttactacatgggtattcttcaaaacacaaaaacagatccagatcgaatgggagggaatatgaaaggaagaagagataaggaaggggatgtgagagagatctctccatctttaggtggatgggtatagagatggagagataggtaagtgggtgagtgggtgggtgggtgggtaggttggtggtgtcgagcacgacctgcacactgattgctggatgttgtgtggagaaggtagtgcaggtatcagtcggtcagtcagtcagtcgaagtatagatagatagatgggatgtttccatcccatccatctcgtcggtccagtccagtccaatctatctcaagacaaagaggactggaacacaagcacgcacacatgggtgcaacaaacacacgtttggagaaaagtcaaagccagaaaggcacagcgcagacatagcagggaaaggaaagagaagagtaagttgtggtgagcgagagcaataccagctcacttactctccctcactacctccccctaccacagcacaccatgccatacactaccgtgtcatatccgccagcagaaaacaactgacagaaatgacatcccagcagtaatccaacctcatcctcaactccaaacatgtgctagtcaactggacggattccgttcttcaccacctccaccaccggcaccaccctcaccagcaacactcgcggtctcaccatccttcctgcgatccttcgattgcgtgcgcacacgccgcaactgctcctcttcctgttcgcgcacgcgcttctcttcttccgcggagggaatatatgcatttgcagcgccgcctggataacattacaacccattgattagctcattgccttcattgcttgctttcctcgagggacaagtaacacacggactaaagggaggtataggaggtatagggggaattacctcggcccataaagtgcggtgcttcttccacgcgcaacgggggcgactccacatcctgcatttctcgggctatctcggggtgttccggatcattgtgcatcatgttaccggagccgccgcgaccggtggtgaagatgtcttgtttgatggtgggggtgacgaggtcctttggggtggtgcgggattcattgttgccggagaagatgttgcctatgtggagaacgatatcgcgttaaaagaaggagtttatttttgagttggggagagagaagctggtgaaagagatagtgctgaacatacctgcgccgccgcggccgtgggagatgtttctagcgccgcccattgttgccgaacaggggggaggggaggggaggggagggcggagaggatgcgatcgggagagtgggttgagcagagtaaggtcgaagtatgggatgcgattgattgcggaggcgcaacgacgcaaggagatttctcgatcagacaaagaaagaaaagaagatgatgaagaggaggggagggaaagcacgcaatagctaacccaacgatgatcaacacaagaaaaaagagagctgggggagccgcaaaagtggcaaaggcccgcgagcgagcgagaaagaaaaggctgaatggcggccaagactttgattttgatcaaatgacgtcctgctttggggccgaatgaccgagacggtttttttcatttttatcttttttctttctctccattccacctcttccaactgggtttctcggatcctgtcattaacatcttctccatataattttatcttccagttattcatccattcaacaattcttcctcctatccgtctaccttggagaccgcgttcatattctcttacctcatgggcaacgaccggacctggaagtggaaactaatttaacttacctgaccccactttttcctctttatattactatattaccttggattatgattttcctattcattccagacgccgactggaaacctcctggaaaattcttcctattgttctttggatactagtgtcgtttgtggcatgttattgattatgtcgtatttttggttgattcattgtattgctgctgtggcagtagggccaggctttccccgcagggattactttctctcttaatgctattatctctctgttatttggaaaaggatcatagctatgagaaatagggtattgtataatactactaatcaatggaagaagaataattgcatcatacattagttagggattatggttcccccgtgactatttcatctattgaggggggtagttcggtattagaaagaggagatgggcgatagagtatagtactagttccaatataatgcaatcgttatacacagtcaattgtatagtgactctataataacaaaccaaggaaaccattatgtatatatatacacaccataccataaacattaacccagtcatgcgtgttcataaaccagtgcatcccatccatgccatgcgttgctgcatacagcgtatataaatcatgccgaaccgtccatctggaataatcgatccatatccgtctcgtacgcctgctcaaatcccatactccagaccccatgcgctcccttgacgcgatacggtccctcccacttccacgacttcttcttctccttgtacgagactgctccgacgtgctgcatctgcgacggggagatggccagtcggtccagctcggcccgccccgcctgcatctcaatcacgctgtccaccgccttggtggggaccacgtcctccatgtgctcgaagtactccaggagggctggaacattctcgcgattgaagagaagggcctgcgagcagcagccgtgcgcgttcattacgtgcaccccattctgcatggggtaccaggtcacccgaccggccaggaagaagagggtgatcagtagcggcacgcagaagaagcagactaccaacaggaacgagttggtgaggatgccctgcgtagagcgaatctttcgtcgagtgtacatgcccgcactggcgcaaagggagaccagcagcacactccaggacaggtagatgggccaattctccgagttccagccgaggaacttctccgtgtagaagagccgcaggtatagccagtccctgatcgtatcgtgccggcgccagtcttctacctgttgaacgctgcgcatagtatgctcgtaccaatcgcgctgggccacaacgtcgtcttccagcatgatgatccacggcgcgtcggtcatgtcgtagcatgcctgtagcccgagtcggtagtcaatcagagatttcttctttatgttgttcttcttctccaagttcattatgatatacccgggcgcgtcgacatcgtcgtaggtgagcacgcggtcaacgacatttgatacccatgtctggttgtagtccgggtggtcggagggtttgctcaaggcaaagagcacttggacggtcagcgcggcccgctgctccggtgaaagggtatcaagaatcgaagcaatggtagtgtcgaggtcctgctgcaggggacgcttcacggtgacgatgcctacacaggcagttttctctcgcggcgggctgacatgggagacgggccgggacggggcagcatcggagcgattaaaggctgacagccactccagcgattcgttaatacgctgaagactgtatcccgggcgatagccttcggtgggctggaagaagaacgagcctgggtcacgggcggaccgaaagtgacagaggacgacaaggaagaaaaataggatggcgaaagaggacagaagcagcctctgctttctgttgaagtgattgagagccatcggtcacatactggttggcaaacgatcagggagaacggaggagaggatggaggggaggaaggaaaagagggaaaaggaaaacaaaaggcaggaccggattgcgacagcagataagccagcagcggactagcaagagttagcttggagccatgattctgaggcttgctgctttggaggtcctgggccctcagggtctgcccatcgcttagtttgctattagtctttgctggccagctgatagtccggccgctcttcgtttatcggcccagtggagcggtggtcaaaaccctgtgagttgacccacgtccgagtagccaagttttgggatcgcgctggcccattggccgatcacgcggtgggcgccagggctgaggcatgctgcgtaaggcattatccgagtagggattcgataataggtgcagagttgggaatagcgcccaaagccattgtggatttctagagggtcaattggctgagagagagagagaaagtcgggatgacgataagaataggctggctggatggcttgctttgcttgactttgcttgactgtctcggagcgaaagagcgaaattgcatcccgcgcgggctaaaaaaagcctgcccagaaaaagcttagcctcaaacggtgcccgccgccagaagaagaagagatgagcagagaagaacattgtggaagaacattaggaaggggaaaataattgacacatttccttgcatcctcagaagtctcatcatgacacaatcaacagggcagtgtcaatgaaacaattgatttagcgtctgatggcgaagcagtttagcaccactcattgtctcaattattcttggttttggatggagtcggttctcgtattgaacccacttcagtgcgctgtgcatgcctcatcctgcactctcaattatcgagtccatcctgcagactcgatcacattaacatgctcgacctgtcaagtacgtcaaggtgattaggtagcctagtctgttaagctaggaggtcagcctaccatatttactgtagggtgcatacctcggcatcaagggaccggattacaacatccgtcaactctaacggcacatcggctaactagttagtagtttcctgattacaatatctggcacatctgacagctacagctattcagatcttcattttgcatagctactgaggtgaacatagctcttagatctcatgttagaactgcggggtaaactcaccacattcacggagtaatagccggacctcggcgcacatcatccatcatccatcaccagcatacttctatagtgtttactgaacaaactctgataaccgagtaattgactatgttgcatgttgggacagactatataaagcaagatagtaagacaaggtgatcactcgatagcagcatcatcacaacaatcagtcccaatcatcacccatttcaacaatcatcacaatccatcataatcataactactatcaacatgtccatctccctccctccatcctacgaatcccacccaacatcccacatcaaactctcccatcacccacccaataccccctcccccacccccgtcatcatcatcaccctcaaccggcccgagaaacgcaatgcctttacttccaccatggcccaggagctcgaatgggcctttaccacgcttgaccgcgatccccgcgtgaaggtgatagtcctcaccgggagcggagatacattctgcgctggagcggatctcgagattggattcagcgtaggcgagaaggggaagaagttgaatttgggtgattatcgcgataggtgggtatcatataccatcattactacggactttgtctatgacccgttgaactctcgaattgaagaaaggaataagcagctaactagagatatgaaaacaacagcggcggccgcgttgccctctccatccaccgctgccgcaagcccaccatcgccgcaatgcaaggatccgccgtaggagtcggcatgaccatgactcttcctgcggctatacggtattccactcccatctcccctcttccccaccctacgcacaacacctaacaatatactgcggtatagaatcgcccacacccccagcaaatacggcttcgtcttcgcccgccgcggcataaccatggaatcctgctccagctacctcctgccccggctcattgggtactcgcgcgccatgtacctcgtctccacgggggcagtgcacccgcccacatcaccgcactttgggggactctttgctgaaacgttcccaaccaaggaaggggtggtgaagcgggcggtcgagttggcgagtgagatggcccagctggtgagcccgatggccggggcgttgaatcgcgcgttgatgtggagggcgccggggagtgtggaggaggcgcatttgctggagtcgagggttttggggcatatgtttgcttcgcagtaagttttttgttctttttccttcggtgttgattggtgctgacaaggggatgctgtagggatcagaaggagggtgtcggggcgttctttgagaagaggaagcccgagttcaagtgtgatttggacgtggatgggccggggaattatccttggtggggagaggtggatattgatccgaggaaggaggtcgaaaagtcgaagttgtgaaaggcagaaaaagactaggaggcaacgctggcatgtagatactgtagtagagaagtgaacatattcaataatcatttttaaatcgctcactgatatgaatattcgtacaaacaggaagtagagaactcaatccacggggttctcgagaatgccataataacaatcactcaaaagaaaaaagaggcatcccatgcaaaacagaaccactaaactaaacgatgaaatgacgtctcttgcggttatacgcccgctgatccttcaaccactggcgataaccctgcacactaccgatcttctcaccatagtaatcaggaacgggattagcaatggagttggacgaggggtcgacacggaagcgtctaatgcggtcgaagaattccttctctttctatacacatacacaacccaatatcagtatccacacttcttctcaatagcaacttaagtaagggaaaggaaagaaacttaccaccataacagcaggcttatatctccgataaaccaacccccaaacagcattccctacaaacggaccgacaagccaacccgccgcaccgcacgccgccgttgccatacccagcaccacaaacggatcaagacccatgacctgcgccccgagggactccagatcctgcgtcgagagaacctgcacaccaatgaccgtggtgaacagggagctcacgatcgacgaggcgagcgagtaccggcggcggctagcgcggagtttgaagaacgagtcccagtcgagacggacggtttcgctcttggcagcggcggcggcagaggagttggcgcggcggagaaccagagagctcgggagctgcgttgtcgtcgtcgagggacgcagagctgtggtgggcttcagggtctgtgtgctgcggactcgcatggaggaggtgcttgcggtccgggtctgagagagcgcttgatacaacgggttggtgcagctgctggggtgggcgaaggggcccagcgtcttggaggtgaggcgtccgctcagcatggcggtacgcatcccgctaatcgagggggcgtgcatggtggatggatgttgggttggaagtggtaggatgttgtggtgatggtggtttgattgattcgttctgaagttcggcgggtaaagctggggattatgtaagcgggactgagacatgacctcattgggaaatgccgcggtaaatatggactatacagagcggtgcttgctttgagtgatgagtgctaaaagatatatctattgcgttcagcttctgctaaaaactacagtgcttatagaaagctcattggcacgagagtggaatatggcattgaaatactgcaatgttcgaggcattactatggtcgctaagcaaaccaacaaaatcgtgaagcagatgaaaaatgcatgtcagaattaggtgtacaaataagaaaatcccgccatgttgcatttcaatcaccacctatattggtggtgcgttgtagaagagaagacccgctggttgtgatcggttgatctggtgcttgaataggatgcgaagatgaagattgcaataccgatattgggagagcagcggattgagaccactactagggggttcgagtagtttctctgaaggaagattgggccgaaaatctaaggactgtagaaggcttgaataggctggttgtttggcagacactatttctgttatgtaatttgctcttggtgttgaatgagctcggctataaaatgcgggggtccagagcgcttgcggggtatcgagtctagtggttgaagaaagagatgcgtaatattgtatggtatatctcgggagtaaaggactcgtatatatcgtattaattggctgaagtgttagatgctggtaacaaatatgatcgcttctataccttggcgggttatatctcgtctgaatcagtaggtccaccgtcataccctgcaactcaagatatacgattagatactgccgttgcttttgatcgctccaggacgagactgggctttggcgctcgttccgtatccgttcacgcggccatagagccatttgagggttcccgtgctcagcgccatgacaacggcgctcaaggcgaagagtccaacgcgaccctcaaatcctacagcatcgaagacggggtaaggatacctgtgcggtcagtaagtcgcatctccataaaggcaaatacaagacgtaccatccgttgaactggaagcaacgctcgatccaaaaccagtatccaaaagcgattgtactggacagagctagtgcagggagaactgtaatcgtccaaggaggggaaaggagaagaaggtcaatcagtaatacaatcgacggtacagcatggaagccgacatcttgcactcgatattagcaagatgagacctcaagtagatccgagtccgactcaccggcatgcataggaagtatcacccaatcaggaacaaccaaacgcttgtcgatctgttaaacaattagatggcattctaatcgtccatgaggaaagtaattaccagacggagcccccagtataggatgctgatcaacacttccattggagcgctgcatacagaaagaaggttcttggctaaaaatagccgagccgataacgtcatatccgccagcagaccggcggtaaaggtgagcgtggccagcgtcagcccaatgacggtcaggtactggaaatgccaaccatatgcttcattactgtcaggaagggtcaatcagcatcctggttactccaggccaaggacatggggagcttacgccctattggggttctcgtgcatgctagagaacgggttggttagtgggcgggccgagcaccggggagcacgagctgtagcggaactcaacgtactacttgaacgagaagaagaagctggcaagaccaagagactgccatgggggaaagaaacatcagcccaaggaacgagcgaccgacacggataagtgctcacatggaccaaggccgagaagcctctagacgggctggacaggcgctgcaggggatgtttccgctgaagcgaccgaattgttgcagaagacgccatactggaagcgggatagaggtagaaaatggaaggacttcgattaattagaaagagagctcggttacaacaacccggacactttgcaatcactgccgaagaggcattgaataagagagatagggatctcactaatgcaatgatctaaagagctggctaggatgcccggctattccggggaggccttagtaacctggggcagctaagcctgacggggtaaagctgggcacagctgaacaacaaccgaactgggcagaccgccgtgaaccggagaaacccgccgcccggaccagctgggctcttggcttatcaggccggtctgattgatggagacggccgatggcctcccccccactgactggttatcggctgggcttgaagactgttgactggcttgtcttctccgccggtctcgtgtagcatgtatcttggttcggtgattacttccactcctccccttcttttcttccttcactccaaaagtcctaaatctcgctggcttttgcttcttatcctcgaacaacaatagcgtcaccctataccttccctaaattcttggctactcttcagcttgcaaacggagtcgatcgactagtagggttgctgtcaaaccacatagattaccgtggattcttccccacaccccgatgagtacgaacaacgggtgtgggtgtcttgtcgattatcgtttcttatcgtcttgggtgaaacgccctacacgcaggaaaaaagccatcttcagcctcttgtctagatcgtgatcgctgtttcggtctgtatggcgatcttactctgcaaggtagatcggaaccatctcagattccggaccatttatcgctgtggtcgcgattgctgtttgtcggatttaatccctcagccagatcgggtgtgaacttccatgcctcgccccagaagacccggcgcgccagagccgaaacgacgatcacgtaagggctgctggtgagtttgccaggatgccaatttaccaataacctatcattaacctgtcccaggccttgcaaagcccgaaaggtgaaatggtttgtctaatgcccaggccttatttagtttgctatcagaattgctcttcattaagaccgttatgccatcacatttaaagttgacgacgaaagctaatttctatgcagtggggaggagaagccatcgtgcctcaactgtcgacgccagaatgaaccatgtgactatagcatcaggttgaattggggcgggaggacacggagaaaatcttctgtagactcccccagctctcagtccagtagtccgtcgggccactatgccaccttcagtttctcgccctcaaaccaatttcatccggatgccccgagtccagcccagcaattcacgcctatttccattcgagacggaacgactgcgccggatcaagctacaggggacttgctatgggatgtcggacttgcaaggggtatggaaataggaacatccacaaccagtcctaaaggattacttgatatcctccatgaatctccgactgcctttggccagttaaataatgaatccaactgtacaaatggcaagacctctgtagacatgggagctgcgtcgcaagaacaagaagcgaccaccccatggccagacctgtcccccgatttagccacatcgtcgtcgagcgagactctgctcgctttctccccgcctgcaccccagtcgctggacaccatctcatacccatcgcctacggatacgaactcgacagtcggttcattcgcggctttcgccttttcctctgccacgatatcggggcccatctcatttctccggcatacatcggatctccatcattccccgcccgactctaatcacatgcccgattctcgtactgagttttctagctattcctcgtctacggatgtgatgagcatctatgcagacttcaattcacatgcatcatcttctgctcagaatgcggcatcgccagggtccgcagaagcaagtttgctttcgtcaggattggctcacgaggccccagcgctgcaggcgggtccagccgtccatacggagaacttcttcagcaagattatgaacgatccgctgcatcctgatagccaatccgatgggggttattctcgcccaggatgcgtttcccatgctgctgacggtgcgggtcagaacctatcggaaccagaggacgtttccatgtcggagaagaggtggcaggcttatctgaccagggtcacggacaattacgggttggattgcgggcgcccggatctcgatctcaacaagaacgacgatcattccgccattgacatcaactatgcattggacctgttcaacgcggacagtcaacctgcttccacttcgacctcggaaggttcgcatacaggtaatgcgaagtacaatggatctgactgcaacaagcgtggctactatgtatcgccagtaccaataaacataccgcggtatctctcgcctttgccaccgtcactcgtgaagacgccgatcaacttgatgtatttccaccacttcctcaaccatactggccggatgctggttcctcatgattgcgaaaataacccgtttatctcggtgttaccgaccagtacgtaccattagttgttgacccaacccagcgcatttactgacatgaattaatcagtggcgattggcgactctaatcttctgaatttgatgctggcatattccgctagtcatcgggcgcggtatttgggccatcctgagcccgcaacccggatcgcacactgggtgagcaatgtctttcccactctgcgcttagcgcttgaagatccccgtgagaaggtgaccgacagtcatctggcgactgcaattatgctcctttctttgaaaatcatctctcccagcacgtttgaagtgcccattccatggcagagtcacttgaagcttgctcgggacctgtatttggcacgacaagagcagatgtcataccctggaaaccgtgtcggcgcattcctcgcgcgctggctggggtatattgatctcatgggcgccctgtcatgccgacaaagtggaccaccactgtctgcatatgattctgtcttgtccatatgctccgatgcaggaccgcagggcgaatattgtgtcgactgcttcagtgggtatacaccaaagacgggtctattcctaatgcggctgggaagattaactcacgagtgtgataacgagcgttttgacgaacacggagtctttgtcccggactgggaaccatcgccagatgttgtttttgaagccgaaaccttgatagcggatctcggcgttctggacacctacgcctatgctgatgcaacacacttcggtctgggcaagacggatttcctagccactgaccgggcctttcactatgcaggactattgcaccttcatcgtcgggtgctgaatgcgtcacccttctctgatgcggttacgggggccgaaagggagctcttcaaggcaataggcgacatccggcagagtgcgtctgcagaggtcggagtgctgttcccgttgtttactgcgggttgtgaagcccgggattctgcgcaacgagcagaaatccaagagcgcttcgatttcctcgaaagaacaggaatgaaacaggtgagtcggtagttatccacgcattagccatgtctaactttgccactagatgcaaagcgctcgcacgctaatgcagcgatgctggtccgaagacttgccatggatcgcattggcccagggcgaatttctagggtagccaggcagattgaccttgtacatcttttcttgctcataagtcactactatcgggtgaagagcatatgtcgtacctgcggggtgtgtcacgctgattgcgcttatttcatgtaaagcggtcgcagacagcaggcctgactctattgaatatactatgtacatatcgagaggtcgttgagggagggtcacttgtagaagccattggtctttgatgttcagtcgctcctcacacatgcagtactgctaggtacccatggcatgctgtatactcaggaataatgcacgtttggtttcctgccctgatggcgacacaaccatctcagatctctctctctcaaagctttctcatccagcttaatagagtatcctaattgccctctaggcttgaccactttcaactcactctaccttccacggctgttggtagcaatttgctagtagtcctttgaagtctactgcgctctcaatcctcacctaacctacaatattccctcttccacagctcttggaaccgatctgctagcaatcctatataaaggccatcgatcctttgatcctcttccaacctacataatctcctcatcctcgcataaaataccttgactgtctgaacaaagggaaggttgctaggtgacgaagctcttcaccaagttgtggcgctcgagaacttcacaacacacctactaccagcgccacttcccaaaatggaagggtgcccctcccagccataccagaatgggccccagcgtgactcagggaccatcctagtcctgttgcttataaccatagtgtttctttgctttgtggtctaccgcatagaatcttatgtattcataatgcttcagacgatcgagcggggagacatggctcacaaaaatgaaaagaacagtctccagatggagcggaccgcgctggctccagtgaatccatgtgctcagaacagtactgctccgctctccagtctcctcgacagcgggcttgacgacatcaaagtccccagcctacagccactgtcacctatcaaaaagtcttccgttatccggatcacaattcagaagcagcctacagagagagcgacgagcctgctcattgaccagcacgttgacagtctgtctattcccgtgctggaaccccagaaagtgagtcctagttccggtgcagctaccactatatcccaggtccaactgccatggttaacccgcccggtgtgtgttaagaaacagccgttcgtcacgatgaaaccaccagtgcttgtgccgtgggatggtacaatcagatgggccctcgcaggatgcagtgtctttgagaacacggacgaagaactcgacgcgttgctgtatcgcccgaacattgtcagcaaaggatctccagctgagctctggatgtttcagttcggtctgcgctatatacccgctgagagtgacagagatgtataccgcgccgtcactattgagaaactaccatcagatgtgactctgcagcaacttttgcctttggtccacggtgaaatctattcagcgcacctcctcgatactgtatctatcacagggtctaacaccgctttcattgccttcgttacccaggcagatacttttgacttccttgaaacttcaggcggaagtctcgccctgggagcgacacaggctaaagtgaccctagtctcgactccaacatatcctatgacggctggtatggcacggctggttttcgaagagggtcatacgcggtgtgtctgtatatctggtgtgcgggacactttgaaggcagaaattcgtcgggtcttaggccggtcgccgtacttggactatcttgaacggatcgaagacggacaggcactcggggaggtctatgttcggtttcactctatcaaggtggctactgccgcctatgggcttttgaagagtcatccgagcttccacgagtttaaatttcggtttctgggagcaagaccttcggcgcggcgatcccgaattgggatttgggattgaagagcagtctcgtcttcccgtgcgtctgtacagtagatagcctttatatcgttttattgctggcgttaatggaaatcttccagtagcaatcgagccttggtaagctggtaagcaagtaagcaatgcctagaacttccccgcgtgggggcgggtctccaacattccttagccgagctctaccccggccgtgacccatccacagtaaccacccccattatccattgccattgatccgggtgcactaagaaaacacagcatctcagatgtcattattcgaactgaatgcggaagtgaacttcatcgccgtgctagcgcattccacggtaacacatacatagccgactcagacatggtagtccttgcttcatgctgtgcagacatccaccgcggggaataacccttcgtttgggcccgactaacttttgggtttcctcctccagttaatctcgggccaatagacctcacgcacacccttggcgatcaccatgattggtttctcgttgggtccttttgtgctgatcggtctgtctatcctcgcttcttgaccctagatccttcgcgaagagcatcgtcattcagctgcagctatgatcacgataggattaccaattgccggaagcccaccctttaaaatgctactggcgcctcccctccttttcttcactgttcctccctagtgtctcaagtcattgctttctgcccgctcctcctctttgtccatctgccacgaaacatcattatggcgcaggtcgacgagaaaccagcgttaaacaattcctcacggggcgtggtggatacagaaaaggctactactgtccacggtataccagaggagtcgcaactggactttcttgatgatccggatgaaggtttgagtgaggaggaaaaggcaaagatcgtgagtaacctcccctggtcaacaccaacagggatgatgagctggactaatgcaattgccaggatcgtgcattactgtggaaacttgatttgcggcttatcccgtggttgagtctgctgtacctgatttcctttttggacaggtgtgcacagttaccccaatgatcgtcgtaggaaattaatcgtggcttaaataggacgaatgtcggcaatgcaaagctcgctggtctccaaggggacttgcatatgaccaactcgcagtacaacgactccttgaccattttcttcgtgtcatacgcgatcttcgaacctatcaccaatgttctcctcaagcgctggcggcctagcgtgtttattccgattataatggtagtatgggtatggataataaagtcttatgcaggttgacttgcgctgattttgggacagggcatatgcatgacttgtatgggactcgtacacaacttctctgggatcatggcggtgagtgtctgcatacatatactatcttcaaataaaggaattcacgcggcgcaattgatatccctgctgacggtagtaggtgcgatggttccttggtctggcggaagccggtctctttcctggcgtcggatacttcttatcctgctggtacaaaagatccgaattcggcgttcgcatggccatcttcttctccgccgctgctcttgcggggtcgttcggcggattgctcgcggctgcgattgccctgatggatggcatttgaggcaaggcgggctggtcttggatcttcattcttgagggtctgctgacgatcgtcatcggcgtgctgtctgtatggatggtctacgactttccggaccaggccagattcttatccgaaccggatcgcaagcgtgtactgcgtcgtctggcagctgacaagcaagccagtgctgcgtacgagaagtttgagatgacgtatttctggagcagtctgaaggactggaagacctatctcaatgcgatcatctacatgggttcatgcatgccgctatatgcattctccctatttacccccactatcatcaatgagctagtatgtcctccacaacctgagcatattgcacagcactaacaatagatagggtttgttttgatactcctgtgattcggtagggatctaaccggcgcaggctataccgcgattcaggcgcagcttctcagtgtcccgccttatgccgcggcggctatcgtcactgtggcagtcgggttcatcgcagatcggaccggccaacgtggcatctgcaacattgtggtgtcaatcctcggtatcgccgggttctccttgcttcttggggcgagttctgcaggggcacgatatgcaggggtgttcctgggcgccatgggtatctacccagcgatctcgaacaccatttcctgggccagtaacaacgcagagggtatgcatctctattgaatagtggataaccatggctgactgtggcaggtgtgtacaagcgcggtgtcacgctgggtattgtcattggctggggcaacctgaacggcgtcgtgtcgtccaacatctaccgcggcggagacgcgcctcagttctatccgggacacggggcggtgctggcatatttagtgctgtttctgtttggcggatcagtagtgcagtatgtccttctccgacgggagaacgcgaaacgtcgtcggggcgatcgagaccactggataacaggactggagagacaggagatcgagaagcttggagacaagcggccagactttatatacacgctgtagctgctatacccaatcaagaccaaacaacatctccactcagcttccatcaatccaaagtctatatatattcttctcctctgactgttcaaaccgcatcccgcaaggtataataattcacaatatcctgatccttcttcggccccttgaccacatgtctactcgcccaactaaccacctccccaatcccatcccccacccccatcccccttcagcacccgaaacgcatacgccgtgcgatacatatcattaatacagagatgatttcccctcgccgtaaccaccaccgtctctcccccagcagctggcggcaccggcgcactcacatactcatcatcctcttccccttccccttccccactggtagatgtatctgatgtatccgtatgaaactccatcccatgaaacaaataatccgcgaccttctcatcccctactttcacaaaccacactgacaaatcatccttgactgtagatgtagatggagttgataacctccaaatataagacttcttccattgcagattatgaccgatatgtgcggggagggtgccggtctcggtatagaggagttggcgctgcgggggagattgtggttgtgcggtggtggtgtcaagaggagtgaaggatgcggtgccgtgcaggttgccgttgatgtcgtgcgggtttgcgcttttgaggacgcggaggagggtccattgtttttgggggagggaggtgaataggtgggtgaggttgagggctggggttattgttgtcattgtgggagcatggtatggtttgtatgtgatgtgtagatttgtggtagtgtggtgaagagaggagaaggggatggagtgacggaggaggaggaggggaaagaggaagaaggtcgggtggggagctgcgggaggtgtggattgtgacccactgagctagtcttggattaatacacttagtattgatctagcattaatggagtgaggttggtgttctggggtttatctttgtttgatcattattaatgagtaatgttcacattgagatgaatgtacatcttcgcttggtatattgaggtcagatggtttgttggttgggctagcagcacacctgatctgatgaattccggcttcggatctatccgcaatccctgccctctatctatctagtcgctaacaaatctctaatatagtcctgtacagagtacacgggttttaaaggctaactccaaaattggcgagctctcctcccgcagcaatcaaatcctgtgtgtattctctgctaatctcattttctctacagagcagacacacacctctactccctccgcgctcaagactcgaacatacaatcaaaaaccaatgcatctaaagatgtctgcgagagaacaagacgaagattttccttcattatttttatatgattatcttttcatccacccatatggaccgtaacagcgcatcttgctccaaacaagcatacactcatccactgacgcaactaccccagcaacaccgtctcacaccaccctagttcggcctaggctgattctgcggcttgcggtccttgtgcggcttgtcgccgtgaggcttgggctggggcttcggaccattgtcatgcttcggctggtccttaggaggtttcggaccatcgcgcttgtggttgtccccatgtggaggcctaggatctttaggagcggggccctccttgtgaggcttgggcttgtgtgaatcgtggggttgagagttgactttcttaggtttgggtgcattgtcaggcttgggaccgtcctttggtggcttcggtccatcatcgcgcttctgtggggacttggggtctctgatatgggccccgtcctcaagagattgaggcttgggcttgggctgatggtgaggttggggacccttcttgggcttaggtgcgtcaggcttaggctcatccttaggaggctttggcccgtcacgcttgttgttgtcgtggggtctgggaagaggggggttaggaggagggttggggtgatgatgaggttggacatcagtaggacctgaaagtgttagcatgcgggtatgtgaaattgttgcaagacatacgtggagcaggaggggcagcggcaaccaggccggctaccatcaaggtagaaagaacggcagaaagcttcattgtgatgaacaacaggaaatgaagaatatggaagaataagaaacgccagttttcttgatgttccagtgatgatgttgctgatgagttgatagccgggcttcgacgtcccttttatacctttcgagacacgcccattcggagcatcatcggcctctcaaacagtcatttatcaatcacgcagggaaacttcgcccggtattctcatccggatatgctacgtttgtctctaaactgaataaactttcgcgtctaccgaaccatgggcctgatgtatcagccctgccgtgtttcagcatcgcatcaagtttgcagaattttgatcgggatggaatcaactaccatatacaccatccgaaaatccttcgctcaaccacaatgttggtcaatttgtaacgaccagcagtttcgtctctgatagactggcctcaaacttctcaggagctctgtcctaaaattgggtgcaggtgcggtgcacatgctgtgttcctcgggttctcgggccggcagccctcgtcgatcacgaagcttagcatttaagtgtcgatcagttgcttggttttagtggttctatgagtcgacggtatgataggcaggcgtggtgataaatctactacaggcggtttggcatactgtagagtagcccctaccaagagtatcatactctgcatcaccagtaagtgatggtaaatattcctactattccaatgggcgtatacctgcttcgtgtacgaacatctaacttttatacttctccacatacttctcttaagctgatacccctagcgtaaatttgactaccggataaccttatatccacctcttcaggagggaggatctagacctctcgaccagtccctattcccgccggtgaagggttttttttccatctgaaacactcacacaaataatccttatacagtaaccgagcctatccggatacatccaacactgtatatcaatctagaaccgaacaggcggacatacctaatatattaggtatatgtccgtgcccacataggggtactcattcccggtctgtgtcattgggaaactttgatgacaagagagtctaggttgttttcttcaggaatgtgccgtgcaatcataaatagcgattactgcttgttataggtttcatcacgaccaaacccttccaattagaaaaaaagccaataacattctcaagcatatccatattgtgcttcgtgataattgacccctggcagcgtagaagtatgcttactacatctgtctagagaaggaaacagcatacgagacaatcctacgcttcaaagccaagaataatacaaagacaacgaacaatgccaagcaacaactccaccacccagataaaagtagtacccctccgtgatcggcgttcgcgaaccggaccgtgagtcaaaagacacttggctaaacttggcatcatatagtgagacggatacaaagtttggttgaaggggagagacgagcgggagaggtttgattctaatatgctgatccttccctgcttagttaacttctatggttcttgagctaggttgttgggatatcggatgtatatcatatagagtcctagacataaggggtttcatatgaatagatagtcccgtcaacccttttactcggtatagacagacagccctctaaaattcaatactagtaaggaacaaccggtaaaaaagtccatccagcagtcgagatataacccaaagatgcagagacccccgaactcggtatgatcacactgacacaggaacagttttggttgagtctcctcctttccaagttctctggaacagggatgtacagctgccgcagatctacctttccccttcgtgtcgaggaaacattccagactctcccatcctgagggaataggagacaaaagacgaagaaagtcttctcgtgtacttcctttgttctgaacgtagtacaaagcttcgcttactactatagtagcagtggcagaatgttattagttgaccgccctgtttaccgctctaaacggcagaacctagcgaacctcgctctgaaaacctcggatttaagcggatttaggagcatacagtccccaaaatgctctcactggattctgtatgttttttgaccgcttttggaaggaggtggcagaaaatggtcgctggtataacctcgttatagtatgagggtagtcgattcgtctggatattattcatgccatttcttttttcttttctctttttcgttttttcgattatgatgtcttattcagtgttcgaaaatggacttatgatattattgtcttgtacagcttggtttatcgggttttcttcgttgattagttggctcctacattagtatatcaccagggcttcttcggtcatatcatttacatgctcatatgatttctgatgataacattgtgatgatgggagtgatacttcttatatagggggttttcactctaattgttcaccctgtggttgtcttcattgaagaagcctattcagctattgcttgttgcgcgaccgaacgcaaatttccaattgttttgatatcatatgcccttgttataatgaacagattataacggccaagcaattgtagatgacagtaaaatctttgacttctgaagatatcaaggctcaattcaatcaagtgcagacctagcggttgcaggagcaacctattgctccaggctactagacaaagcccatcggtcgattaatgcagcatgtgcggggatcatggcgtgcgcaagaaccccgcatgccaccgccgtcgatccatctctatccttaattctttcaattcccatgatagttcattttggtattccaacatcaaaagccgtccagtcatgtcgtcacaaaaggtttatctcgaccatttgcttcttcaattcagcaagatcgagttcgagtcgccttcgaaatggttgactgatcactttactatcattgagggcggtactcatgcgggtaagatattaatatccctcgtttatcggataagatcttttgcacatgcttatcactggcaggtggtctgagtcgcaacaaattgatcatcttccccgacggcacttatctggaactcctaaactggatcaacaaaccagaagattggagagaccgaccgggcgattttgcgcttacatctttagcaccagtctcggccgaagataaccatgaccgtatagtcaaagcgctgaataccatctctgatgatagcctgggggtgacatactcacagccgatcgatggaggacgtcagacgcccagtggggttgagattcgttggaaactactaaaggcactttattccgatacaaaatcaactacgccagatcttcatcccagaggccgcacagatgcacccttcttctgccatgatgtcacggacagggttcttcgcgtcccgtatgatcagtcttctatcgttgatcacccatcaggcgcgacggggattgcgggcatcgagctgctcgtgcctaaagataagctgcaatcctatgtggccacttatacgtgcatagtgggagcatccccgcgcttgtccactaccgaagcggagttcgagctcagagcgccgggttccctagatttctccggggttcttcgcattcgggctgcaacttcggagaatgatgatcaatatctgcgggagaaagggattggcatttcatctctgataatccgatcgaaagctatcggggattttctctttcctgtatcagattatctgcattgaggcgctcgtgctaatccgtgtatgtaccaatgcaacttggaacttgaatcttcgataaggaactagtcaaagagaggaaatgatcaatcaacatcagtgtactgcagtcgcagatctcagtccattgagagaaatcatgatgttatgctctgtagcctatgattgcgtacaaggttctagcaggtcataagtagtcttcaagatgctctctagacaactgttccagaaacagacagatgtctgatcgagcaagggatctgtcatcctggcctttccgaccgtataatgatctttttataggtcgcagatcgatcaggaggtacatggcccttgcttatcatttccgcattagtagaacttattctggcttgttaagaatgctcgcggggcttctgcttgaagtcagctgtgttgctcaccgctggagcggtcactgatatgagctcgttcagctgcttcagagcatgctgcgaagtcgtatcgcttaaaggtactccgtacttctactcctatctgcaccgggtgagccacacttggacaggtcctggtggcgtcatggacacattcctccctgcccctggaatgaccgatcagcccggggatgaaggagatcggttccatacggcatccagagcgatccgtggatccacggcctttaaactcaaatcagaggaatgtgtcaaacgatatcaacaatgtaaacttagaattcatgtagatgttagattgttgagtggtgagtagtgagcaaagcgacggacagattgggcgaattcagagggtcatcagtcatccaaggagggcgagtgaagtcgatacctctgagacagtttttccccagaattagaccctcgcaatatccctggatgtgaaggtatcacggcaccgttgcatagtggggcttggaaccaggcgccccagattattgggaatagtgtgctgcaaaagatacccacaggtcagtttgacagggcaacagccacggattcgggacgacgcatgcggcgagggttgaggggagactgaaagggtccgcggaaaccaggaagatgtaacgaggtactgttagggagatggggacaagtggatcccaagttgcagagtgtgagatttgaggatgatgaagatgaagatctggaagagtacggagtatagagattagagaaggggggcaaagaaacgcaggaagaatgagatgcgatggggcaaaaatcagccagaaaggcgttcagggtccagactgcgcggccagagattaaaataaccggcaactaaactggaggaggaaaagagcatccagcaggacttcgtaaaagactccattcttacgcaaacctggacttcgggcgcaaatgaattttcggcgctacgcagtgggactaacaaggactaacaccaaggcagtaagcatcatccgcccgcgtctccctccggccgcaaccggccaggcaataatccttcctcaatcttccttctcctcttccttccctcctttcgttattattattattattattattctggtcttttcgctccctcgcctattcccgccgttgtcgagggctgactgtcgcctctccaaccatctattccgtcactcgttcgtctccgaccttccaccaccaccaccgcttccactgccaccttcgctacgcccgcccatcgccaacttttatattctctccctcctcgccaccaccaccgctcactcgccttggactagattatcgtcgtcatatcatggtgggcacctcccagtgagcgattcctctcccccctcgacggtccccaccgccctcctttcagccgcaagatacctcgtcatggcacgttggccccgggccttgacccccagccatgctgccagttcaacctcctcgaccatgctcttctatctctccttgatgtccatcgctctctcgaccgtcgttcgcgctcacactgtcacccttctcccatctgtcgcctcgtccgacttcccctcatgtgccttgacctgctcggtcttaaaggaggcccagaatgagtgtgtgcctcccgtcgccgcccagactgatcatgcgacctacgtctcgtgcttctgccagtcagctctgctcgaccagatccattttccgactggggtctgcacagaaagctgtcccagtgcctcggatcgtgcgttgatccggacatggtatgacgaattttgctcgtccgaggacaccctcgccgcaagagacaccactccttccattttcgcgagagattcgcgctcccagacctggtaggtagcccccgccccggtgaccacctggaccggcgcagatattgacatagctaggtggaccacccactaccagtgggtgatcatggttattgttctggtggtcgcgttttccgtcatcaccgtcgtgggcgtctggctcaagcgtcgccacgaccggaaatatcctggcctctatcacgctaccaacaccgcaggaaccgatagcgcactgttggcagctcgtcagcaggacaacagtccatcacctcaaccgggacctcccccacagggcgcgttcaggcccggccgattcgaccccacgttaaactccgagtcgattgccagcagttcgcgcaccaatatcaccgctccgacgacccggcccgctcgaagttcgtcgcgtctacagaaggcccaaccagttccagagggtgatattgaaattcgcgaagttagccggtgatatccgtgcatgattatggtttctttctttctgttgtttgctttttctatttcacttcaagtgtcaatcttttcccactttgagagcgggagaaatgcgccgttcacgtcgttagtaccggcatgacgtgggtaaagccagtcgggaaacaaatcggcgcatctcgcgaaacaaacttgcatatacctggcgtttacgtgtttgtggggttcaactgggagactcatgtccagtttcagtccgattccatatcgtcccaccctacacttcttttcttcttcgtcttttgactctctctgcctcgcctgctccgaatgattgtgcataaatatggttcaggtttctatttggctgtggttacctttgacccttgtgtgatcgaatatagtcccttccgttgctcgctttctttgatgcatcgatattatactcctatacgtggagcatgaccaggatcgaatatcaatatatatatatgactgattattgtaagattcttacttcattcaaggaggggatggacctacaaaatcaaaacagagaattcaatgaacataaagtgacacggatttcctatttacttttgttggcaatcccagagaacaccgtgcttatatattgacaaatgaatccgtctttagtgtgccttcgggttggaattgcagcctgcaaatactacctcgttactaatcttttcgccctgaagtggtgcagagacaaactgcactgtatactaccaacatgacaggagcttattttctaaagtactaattcagatcatggtctaccatgattgatactacaagattaaggcataatctcatacctcctactaaccgattactgatgcttttggtgcatgtacgtcatacttagttactagtattatagtatataaatggcccactggcctcagcattctcacacaatactattgaaccccccccaaaatcactccgtgcatgcggatagcaaatacaccctttatctgtgtttgctctatgcagcaacactttcatatgctagtcattagacagagactggaaatcgggtgtaaaccatacccccaacgcactcaatagtcgacatggttcaaagcaacacatgatataatccctacgttgtctagctagttttcccagggccatcatcttctatagtgattatataaaaatcatcagagcgtgtggcatattagtatctagttggtacttgcataaagtcactagtgatacagcaatacagctcagttcccagtactgatttcaatgatatattttggatgctaatttacagggtagtagtatataaaaagcggtaaaagaaaacacaaaatcgctgaactcgatataaaaaccagtcatcccaaccagaccacacaacaaagaaacagccccctaagtaaccgttatactcacgatcttaatatcctgctccggcttctccttgaacgtcttcgtgttctcaatcttatgcacgacatccaaaccctgcaccgcacggccaaacacagtatgtttcccgtccaaccagggcgtcttttctgtcgtgataaagaactgacttccattcgtattgggacccgcgttagccatggacaaagtatatggtttatcgtgtttaagactggagaattcgtcctcaaactcgccgccccagatggattcaccgcctgtgccgtctcccagcgggtcaccaccttgaatcatgaacttgcggatgacacggtggaagatggtgttgttgtagtagccgttgcgggcatgggtggtaaagttctcgacggctttaggagcagcagaggggtagaggcgaaggtggatgtcgcccatggtggtgtgcaggatggcggaggtgccgagttcggcggccttcggtgcggcggcttcacgtccggaggcggcttcgcgcggccgttcgttttggatgtcgcggtttgatttgctaatttcagtgtcattggtgaataggtagaagcggactttagcaaatcctgtgctgacaaggattggatcgcgttcttcggcttcttggaggagtgggttggcactggcagccatggatacggtcacgacgcccttcttttgcggttgaccttggtacatggcgaggttgagggagcggaatggctcctctttggcgtagacgcgaacgacgcggttggtgtatgtgttgatgcatttaatgccgtagagggagccatagaggatgaagtgaccggattcgtcgaagaggacgttgatcttgggcttggtgatggggttctcgagttcccgttctacagcaagtcggcggccgaattcgagctcgtcgagttggtagattgctgtgccggcttgttgcattgcagtgattgtgttcagtgattcgtcgtacttgcggtagagcttgcccgtggcgaagtcgaagacgcggacttgacggtccgggaaggagacggcggcaaattgctgaccagacggggagatgcatagcgacgcagggaccgacttggcctttcggaactcgaagaggttggtagaggacttgagctcgaagacattgtcgggcttctcgaaggaaccgtcacccgctcgccagtactcaatcatgccggagtcgtcggcggagatgacacaatcgtaggcgtcgttgaaggcaatggcggccacggggcttcggtggatcgacttgacggtgtgcagaggggtctgattttcaccgcggccatcgaagacctggatcatactgctttcttcgtctgttacggccagcaaaggtaatgaggcgccccggcgatggacccaacatacacagcgcggagtgaattcgagggtgagcatggcaagaaggtctgcgatagtgttagtgcactcgatcgctgcgataataaggagcttatatgcctaccaaacgtgataacatcaaagatcttgaccgtcttgtccgctccggtcgtcgcaaagcttcttccatcggcgctgacgctgacgctcttgatctccgaggtgtgggcgcgaaactccttcacgaactcgacaccgactgccatcttcttccaaaatttgacgaagccatcaatagatgaggttataaggaaatcggtatgcggagtcacggtgacaaaggacaattggtccttgtgcatgagagacttggagtaccgcggcgatgcgggcagcgcgtttacgtagaccttctcgaaagggagcttgcgacgcttctttttcggtgcatcagcggaagggagggccggtccgaagtcatcgtcagaagatgaatcgtctcctagaagagctagtcagtagctgttcagctgcgcatcttgtcttcacagctgctcgcaggagctgttcccgacactgcagacgtaccattctcgtcgctaccatccacggcggaatgggggcgcttgttcgtcgccagcttctgttcctcctctgcaggcattttagaaaaagaatcaagggtaatttattagtaaatattgggatgagcaagacagcagcgctggtcaagaagcgatggaggagcaaggccgggcggtctgccaccgccggcggagctcgggccacatcgcgaacttttctggttgtcccgcattggttggcctcgccgtctctgagtcctcaccgtccaggagaagcatccccctgagctaccagtcttttcccccgacggtagcccatcctttcatccacaatcagtcaccatggtatgttgtctatgacgcccttcctcttgttacgtcgctttcgactaaatactgaccgcccctcaaggcgtccttcgccaatcccacgcagatctttgcggacgatgtcatcgaagagaagggtgagaatgctcgtttgtccgccttcgtcggtgccatcgccgtcggagacctggtgaagagcaccctgggtcccaagggaatggacaagatcctccagtcagcgtatgtgggatgacccattcaagctaagcggggttgcaccccccgaacaccacactgatattacggctgatataggtcgaccggagacatcctcgttacgaatgacggtgctacgattcttaagtcaattgctctcgacaacgctgcggccaaggttctcgtcaacatctcgaaggtgcaggatgacgaagttggtgacggcaccacttccgtgaccgtgttggctgcggagttgctgcgggaggctgagaagctcgtgaaccgcaagatccacccccagaccatcatcgagggataccggatagctagcaaggcggctctggaggccttggagaaggcggctgttgaccgtagtgccgatatggagtcgttccgcaaagacctccatgccatcgctcgtaccaccctcagttcgaaggtcctggcccaggaccgtgatcagttcgctgccctcgcctgtgacgctgtcctccgtctccgtggctcgaccgacctgagccacatccagatcatcaagaaggccggtggcaagcttagcgactcctacctcgacgagggtttcatcctcgacaagaagatcggtgtgaaccagcccaagcgcttggagaacgccaagattctggtcgccaacacggccatggacacagacaaggtgaagatcttcggtgcacgggtgaaggtcgagtcgacaggcaagctggcggatctcgagaaggcggagcgtgagaagatgaaggccaaggttgagcggatcaaggcccacggaatcaactgcttcgtcaaccgtcaactcatctacaactggcccgaacagctgtttacggaagctggcatcatgtccattgagcacgccgacttcgatggtgttgagcgcttggccctggtcactggcggtgagatcgcctcgacattcgaccaccccgaacaggtcaagctgggtcagtgcgacgttatcgaggaggtcatcattggcgaggatacgctcatcaagttctcgggcgtggctgccggtcaggcatgcaccattgtgctccgtggtgccacggagcagctgctcgacgaagccgagcgctccctccacgacgctctggccgtgctctctcagacggtcaaggacccccgggtgaccctgggtggtggctgtgccgagatggtgatgtccaaggccgttgagcaggctgcccagaacacgaccggcaagaagcagatggccgtggatgcttttgcgtacgctctgaagcagctccctaccattctggcggacaacgctggtctggactccagcgacctagtgacgcgactacgacaggcgatcaacaacggcatgaccagctccggactggatctgctcacccctggcggtggcattgctgacatgcgcgagttgggtgttgtggagagctacaagctgaagaaggcggtagtgtcctctgcgtcggaggctgcagaggtaagaatcacattcctttgagtttatctggcaaagtttgattatactgaaactaaccaacctacagcttctcctgcgtgtcgacaacatcatccgggctgcgccccgtagacgtgagcgtatgtaagggacgagggagatgtcaagtaaatatccaatatccaatcttatgtgagcgtggaaaataatgtgagcttgattcaaacccgccagggatgacttaggaggtggatgggatgtccactgtgctctatagggagcgtaattaccatgctatagaccttccgaagggaaaaaaaaagcagctgacgaatgatttttgaatatgcttatatttctttcttttcctttacctggacgatgacactcgtggtgcctctcgctgccttcacaatctggtatggtatgatcggcctactttcgattggggctgcgtaagagtgtccttgaacctacgctgtgtagtaattacagcactctgatcatctcagacacgggagtttagagctggtgcgatgtgggtcgagggagttgttcctgccgccagcctgccatcatttgacgtggtacaacatatggccccaagtatgacgaactcatgtttatcccagctcctcttgcaaatacgatgacaaggcacccctcgaccagcagtaggcagaaacaataaggaagtaggacagcaccctttgacaataagtaatagttagtagatagtactcgtagtctactaatttagacgcgacaagttccctgtaaacagcccccaacgtacaggaggacatgggagaattgcagcagcacccagccatgatgataaataactaactaattagacgatgatggctgtgccaggtcaatccagcatctgcgccaaggatgataagcggtcgaggatccaagttccaaggtgtttgtgcgcaccaaaaatttcctggccgatcatcccagcagccaagactgacacgggcgatttcctatatttagtgagcgttaaatgttgtggggggacagacagtgttgttatttctccgaatatgcgcattttgacagcggatgtgttagggtcggtcgcatggcttacttggagatataaatgcggacaacattatattctagtacttgaatacttattatgtcctaattctatagtgctgcccggtttcctcatttacacttgactgcgatgataattctgttagcgtccactgagtactgttccgcggggcgatcgatggagcagcccccgcaagaacgggccagtcagaatccccagcgacaagccattgcgcgttcggcggtccccccaaggcaccacaagcaccacaagcactgctggaccctgaagctaatacccgaaagttagtaactcccagttcccagggtccagcagacagacgcccggactaagttagtttcatcgggtccctgaacatgaactgggtggaaacggtgggaaagccttgggaggggaaaggccctgttcatcgtccatcatccttcgtccctcccttggcactgacaatacgaccccatggctcatagcggaaggggttgcgctccactgctacctttctgtgactttattaccaccctccactccagtaccaccccccccaagtgaactgatgccgtcactgcagtctcactacaactggtcctgtaccatatccagccacacctcggctgctgctgctctttcactcgttcctcttctcctgtcgtatgtcatgtcgactgctgcaattggactggtcaagatctcccaggctctgtcagcacttgcttcggtcactgcactcgtttagatccccagttgcaaggctggacgtgattgatcccctcattcctctccttccccctcccttccgcattccgcccaccacgttccgtcttcgtcaacggaattttttcatccacttcttcacacgcgtgttgatgctgctgtcttcttcgtccttcacttgagattttcgcatttagcgtctattgacgatggtggtgccaggctggatatgggcggtctttctgaccatatttgtctcctttcagagaacagtgacggcgctgcagctggacattaacgatgaacgtaggtgttcccgactcgtgcaggaatgacgcacacaggtgcaggtactgatcattgcgcaaatatagaatctatcaaagatgccgccaggaccacggccttcaacatgatgagctactatcatggcaacgaatcgggccaaacgccaggaaagctgcccgatacctggtgggaaggtggtgctatgttcatgacgttgattcagtactggtactggactggcgacacatcctataacgaggtgaccacccagggtatgctctggcagaagggcgacaacgactactttccagccaacgatagtaactatctcgggaacgacgaccaggtcttctggggtctagccgccatgacggctgcagaactaaactatcccgaacaagatggtcagccatcgtggctgtcgctcgcccaaggtgtcttcaacacccaggtcccccgatgggatacgaccagctgccagggtggacttcgttggcagatttggccttaccaggctggttataccaccaagaacgccatctcgaacggaggtctgtttcaattagccgctcgtctgggacgctacaccaacaacgatacatacaccgactgggcagaaaagatttgggactggagtgcgacaacgccgctgttgcagacggaggactggtacattgccgacacaaccaccacagaggcaaactgcaaggatcatggtgatatacagtggacgtataattatggaacctacctcagcggggccgcatacatgtacaatctggtcagcacctattcctccaatctgcaaatttaatccctggctaatcagattctagaccaatggcgccgacaaatggaagaaaggtctcgacggtctgcttgcaagtaccttctcaaggttcttcccgaaggaatacggcagcaacattatgtccgagatctcctgtgagcccaacatgatgtgcgaccggaatcaggactgcttcaaaggtttcttgtcctcctggcttacctttactacaaccattgcgccctacactgccgatcagatcctcccgaagatccagcaatccgccctggcagcggcaaagcaatgctcgggaggcgattccggcactcagtgcgggcggcggtggtaccaagcgcagtgggatggcgagacatcgctcgaaagtgacatgagtgccctgagtgtcttctcgtcgaatatgatcacgcatcggcaaagtcaaggtggccaatctcagggtccgttgacgtcggacactggcggcaccagccaaagcaaccctaatgcaggaaccggtccaaaggatgcacccaataagctgcccgacatcacaaccggagaccgtgcaggtgcctccatccttactgtcctctttgtcggcagctgggctggtgctattacctggctggtctatggaggttgagcgacatttgaggatcttcacttgcaatttcactttgtacataaaatctgcttcattgaggcagagacggctctgtcgctgttgtcttctctcccctacgacctgctggcttgaaactgtgctgaatcgcgcttgctgccagcactgtggagttgtattgcaatttgttgaagtgttttggagttacttgggttggaaggatactggagttgtggtgttaggagcgagtcaagctccacagccggaagacccggattttgttatgattgacgtgggattagctataaaatagcagacttgcttcccgctttcggctatacttttaatatgtgacctactcaccctcaccaaggggatatcaatcgtccacagtaatgcaagaccgacgcgagcccaaattgactcgtcaatccgctctctatagcctgtaactatagcatttcccaatccggttaagaccagccacgccgccctaatttggcaagcggtcagacgcgctgcaggctccacggcgggcgagccaataaggcggtgtcgaggcgacaatattcatcagatagagcgatagattcacttcttctggcagcagcaggaaggggaccacaaaatacctgtcaatcccctggcccatggtctaaggtcggtgttactagctgacacttaccgtcccgccattcagtctcaccttctcacctccagacctccctctacagcttcatcttccctccccatccatcccgccatccaaatacgatttatcacataactgctcagtacattacgctgtccttgttgcacggataatgcttattgcagctgtccctgctgctgctacttcaaccgtctgacacacacatacacacaccgattgcgcgcgcccgtccctccgccgatatggtcttcctacgtctacgagtcaaggtctacccgcgcgagcaggttgcgcctacgccatctttctccttccgctcgatcctcggtgatcgcgatcgcgatcgcgatgacgctagccgcggtactaacggctcgagcggaggcaaaccggtggcctttctgcttgtgcttgagaaacccgaggatattacgctgggtggactggccgggttgattcaggataagtggaggaagttgagacctaatgcggagtaagtgcattgctatctggcttgtctactctgtcgtgcttggcatacgttacgtgtaatacagacggatcggctaaatcgcgtcacgttagacctctggacatcaagaaactcctcgacgacgatcatgaatccgacgacctcgatgccgatatgactgtcgcggaagtgtttgtcgataatggcagagctcggcaggatttgtccgaccagcggggtactgtccgtgtgatacagaagcctggtcaatatgcccctgtgcggttcccctccgtcactcaggactgggatgccgctgcgcaaaactttgagcgccagatccaggtcaagaaggaggccgtcaagaaggcgatggatcagatcccgaccattcatgaagaagagaataatgaatattcgaatgctggttctgttagtgcacggtcgtctgcgtggagtccctatgagaaccgtcggtctgaaatccccgtttcgtctgtggaaaaggatgaggtcccaggctcgcctgcgccttgggataagaagccagtactgcatgaggaggattctcagaatcaggttggcagcagtattgcggctacacctttgcataagcgcatgcagagccaggaattgggggactccccatcgcacaccccgacgcctgaagagcgcgctgcgtctagacacaattcctcgcaaggttccgcaagacagccggtcaaggaggcgacggaatcgaaagctaatggctcgcacgagatggagagtatcgatggatctctgtcgcccttgagtactcggaaaccaccccagcggcgacaagtacccgaaccccagccgccagccccagttgttgatgttgacagcgagagcgagagtgagagcgaagacgagagcgaggatgagacaggagacgaaaataacgagaacgtggctcccccgtctgctcagaagaataagctccagaatggtgatgtcgaaatgcatgatacggtggaatctacggaggaacagccacagtcgagtaacagcaactcgcgcaagagaaaattgagccaggacagcttcgaaccgagcaaagagccccgcctttctgagccaggaagcacgcatgctacgcccaagggcatcaaagacagcatggtaacagttgaggtgagtccgtatactccaagcaagcgcgcgcgagccccatcagttggatttagcccccgccgaagcttcttaatgcgtgccccatccgcacccccaaagcatggtctaggcttgggaatcacaagaagccctccaaacaaccgacttacacgctatttgacccaggactcggccgtccccccacccaactttctggcccctaatggtaccccggagattcccagtagcgcccctactatccgccgtggctcagtatcgcttgccccgtactccacaccgtcgaaggcccaggccccactcgacaaagtcaagaacctgcactcggccttgcgtaagagctccccggctgaacggccgtccgaacgacgatcagtatcgttcgctgagtcagacgaggtagtgtttgccgggtctcagccagtgccaaagtcgaaccctcagagtacctctaaatctcgagccaagagttcagaccccgataggaggacgtccgacccaagctccatggtcttccctgcttctgtgcccaaagagcggctggaccagctcatggaagaagcaaaccggaagattgagcaggataaacaatacgaggagaagttgcaggctaagctccagaccgcacgggagcagaaagctagtgctcagtatattcgcaagctacaggaactgacggacgcatggacggctctcaagaaggctgaaaagcaccaaaagacgaaaaccgtagctcagcgtaagttcgatacacttcagaaagaggtcgacaggcttgaggctacgcagaaacccaagccagcttctgctacaccacagaagaaacagcaatccacgacaccacgtactcagcccactgatgccgtcaaattgccgacgccgcatgacacgaaatttgcaagtgacagcaaatctccagcttcggaaagccatactcagcctcagaagacctctccgatgcagatgcggaccaggtcagctagcaagctggacgcttccccgaagattgtccccagcgagcctcagagctcctttgcttccgacaacctggacctgccacccatggaccgaaccgttcacagagctggctcgtccaaacccagcggaacaccagttcgtgcaagcacggtaaaatcgcccgaaaaggctcctaagccgtctccgcaggcaccaatcgagttgtcgtctgattcagaagagtccgaggaatcggattcggaacccgagtcggagtcggagtccgaggaagaggaagagaagaagcctgcgatccgtcaaacagcgtcgtcaccagtgaaagccaacaccgcaacaccttcccaggtgccagcctcacaaccagctccgtcgcagacatgggcacgtccttcaagtgcaacgcgcacgacgcgcacgacactaaagtcattgatccagaaccagaagaaggagctggaagcgaagacgcagccgaaacgcgcggcgaactcacaaccccagaagcgaagcgtgtactcgccgccatctgatgacagtgaaagcgagagcgagagcgagagtagcagcagcgacagcgacagtgattgaatcatacctttcttcattcgaccttttttccattgacattacgattcttccgggtggttgtatcatcatcatcattgtcaagcgcactgcgttggcatttcggctttctttctgctatagcgatgaatagttattccgactcatttggacgtgtgtacccaacagcagcatccggcgtgcattgtatgtatgtatgtatttgcctagctcaatattgaacaagatagtactttttatcccctcacccaagtagcaaactagtagatacttttaaaatcaaggcacattaaccgcattctcctttcccacccccactccctcccttccccataaccccctccacctccctaaccacccaattccacccaaacacatcctccacctcccccgtctgaatcccctgcaacaaccccaacaacttcctacacaccgggcccccttcccccttttcaccaccacactcaaacccccacttatcccccttactcttcatcgtaatactcctaacaggaaccaaccccgccgccgtccccgccgcaatcacctcatcaaactccctaatctcctcatacttgacgcttctcttctccaccgtataccccagcatcttctccccgatctccaacaccgacgccgcagtcaccgagtcaatcacgttcacgctatccggctgcacgagcgtcactttcccctccccctccccattattgttatatttcaccccaataaacgcactcgtcgaaaactcatccacctccgtccgcgtcttactatccaaatgcaacgttatcccatacccctctttgtaagctgccatgctatgtcgttgcactggagcatagttgccccccgctttggcgctccctgttccctttggggccgtgcgatcgtactcttcgaggatcagcgcgtccacggcggatatcccgtggtacaggcctgtcggggtcacgaagacggcgaaggtgaatgtttcggggggcgttagggagatttggggactggagccgaagacgaggggccggatgtagagcgctgagactcccggtttctctcctgacgtgggtgtgagcgttgtgtggtgcggtgggacgtattcggcgttggaggccacggccaggttcacggctgagaggaagatgggggttgggattggggggatggagaggatggtggaggagtgggcgaggcgggtggcgttgagggttgggcggaatatggttattttgtcatttctgctgctgttatcgttggtagttgtggtggtggtggcatggcgaaaggctttcaggccttcgtaggcttgttggccgtagtttagggctggggagaggccgtggatggagaggtgcggggatttgattagttggggggtgctccaggtgtgggtttggggggtgtaggtgcattcgacgtggtagtttactaaagtattggagatgggttattagtgggttggtgagaggaattgagggggaggggggattaggaatgggggcataccgtcgcgcactttgaagccgatgttggtccagtcgatggagcgggttgggggtggggggaagggggttgtcatcttgtcgtagtgtatgttgtatggagggataactagggtggttgatggaagagaagtagaagattaagtcagggatagaatagactactgtcagattataagatagatagttatacgaagtaaggtagcaagcagcatatggcaggaatgcagtgcatgtggcatgccggaatcgagtctactggagtcccctctgcagcgtctgcatccgtacctaatgcaccaccattactgaaattccatcatgctacatcatgaggaatgtggttccgcggctggatgcagcagtcaagttaattccatccatgggtcgcagtgcagtgcatctctccgcatttcggcttttatccccgcaaactttagtatcctgctagtcgggtggggggtattgtccattagcagcatcctcgaagtagaatacgggatcagcaattagatcagctgtcaggtgtttgacttttgcttgctggtctagaatttgcaagcaagttactaagacagtgcactactactactgcgtgaatcgtcgacttggctagaatctatgaaaaggcccgctagcaggacacggtccatgttcccatcccgctctgctcaccgatccagcatttccaactccttgaatggcaaaacttattctaatccactggtttgtctcacgccaagcaaagaaataccgagggatggatgactgcttactgctgacagggttactgccctcatacctcgtccgtgcatctggcttacgcgagatattacccttcgtttgtgtgctgatcaaccctaagtacaaagtacctcagtgactgaactgagccttgcatggcacaataactagttagtggattaatatgggcagtggctggacctggagtcaggccgtggcgataacaccatcgcttgtcgatgtggtgagacctttagtcacaatcgcacccttgataacactctcgatagtacagagtacccttgaaatactgaaacagtttctcttattgagtcacgccctttttccttacgcaacccagtgctgtcattccttatttagtaagctctctgctggcatatgtagttatctgcaaaagtcagaacaagtcagattgtctgctgcagagtgaagtgtgaactggctatatttgggtccatctcggcccgcgcaggagagtatggggggacgggctagagtggatatctgccgcgacgggaagaacaaagatcgctacactaccagggaagagacagcgatcagcgaaggaagtagagtagtagagtatgatggcggaataagtgaataactgtattgttggagatatattacttttttttctgaatacattatgttatgtccagaggagacagaaactcaaggaaggaaagggatttgcccctgtcttacctgtaactgggaatcgactagcccgtgtcgggaatccatccccgtcccgatgcaaaagtcgcaaacgcgtcagcacatcacgtgcgcacagcctcccctcgatgcccccaatccaattcatccattctattccatcctattcatccgctcaatgctgcccttcaattgcccatctgctctcgattcttcttccttctcttttggttcctcccacgcggattttaccaactgatgacacgccccgtgccatcggatccctcactctccagcttctctctccatctggcccactgtattggagtccctcagcatgcggtggcggctgcctggcgcccggtcgacccttcctgccagtgtcgcactcctcctgctccccgttcttgttgctccgcagcagtggcatgaacatcaacatgagctctcctccaccgtttccgtccctctccgaccgactggtttcacctccggcgtcgatacccctccctctttcgacgtgaaatccaacgatgcgagcgccctagcaaccctggctctggccggctctggccgcgccgttcgagcccctcctgcccaagccagcagctctaccgctggcctggctccgcagcttcacgcgcggtccctgcaggactgggaggttgaggactttgtcctgctggcgaccgtcgacggttccattcacgcacgcgaccgcaagaccggtgccgctcgttgggccctcgaggtcccgagcagccctatggtcgaaagcctctaccaccgagccaatcgctccagcttcgaccgtgcccaaccagaggacgactttatctggatcgtcgagccgagtcagggcggaagcctctacatctacagctcggggccagaggcaggcctccagaaattgggattgactgtgaaggaacttgttgacgaaacgccttactcggggactgacccggccgttacttatacggcacgaaaggaaacgacgctgtataccatcgatgctcgcaccggaaacattctgcgggtgtttagctctagaggtcccatttcgtcaggtcaggaatgtcgaaaggttgatggtctggatgtggatatggaagaatgcgaatccccttcgggtactctagtccttggtcgtgtcgaatacacggtagccatccagaacaccgaaaccggtgatccaatctgcactctcaagtactcggagtggacggccaacaaccgggatatggacctccagagccagtacctccgcacgatggatcaaagccatatttacagcatgcatgatggtgtagtcttaggcttcgatcattcacggatggaccggccacggtacacccagcgattctcgagtccggtggtccgcgtcttcgatgttgctcgtccggtcagcgccgactcatctaacgaccctactccacttattctactctcgcagcctctacagcctcctgaccccgactacggtacgcttgacgatcgtgatgaaagagtattcattgattacaccgagggtggtggttggtatgccatgtcggaggccacctacccgcttgtcaccgggagagccaagatggctcaatgctacgaaaaagattacctccgccatggtcaacccctaacaagtctgaccccgagtcagcaacaagatgcactagcaggagtccattctttgaacggcccacgcgtcgtccgccgtcacatccccagcatttctggcccctcgtcagccgatatgtccaatgacacgcctcgggagttgatctatagctcatcggacttggcactgcctccggctctacgccacagcaccattatacggaagggctgggacaatgccattgatatttttgtgacgctcttgcttctgtttttcggcaccttcatctggttcaattctcatcacattcaggagcttgctaagcagaagctggatctgaaaaatatcatggcctcgtacggacagccgcccatgtctaccccctcaactccaatcgtggaagcccctcatttgaaacgcgaggctagccctaatcgcatggcgaatctgactgtcgacatgaatgtttcaggagagcagccgcagggtggtgactcgacgccaaggcccaagaaatcccagaactctcttgcgcccgacacaactccacgcgtacgcatccgggaaccgtctcaaggcccagatggcgatgacgatgtggacgagctcaatctacaagacggtgaaaagcctaagaagaaggctcgccgcggtcgtcgtggtggcaagaatcataggcggggcaagaagcccaatagcgacagcgaatccagggacccggccgatcgcgttgttgatgaagtgaacaagcttcaacctcagcctcgcttggaacccgatgtacagctggcccggacggtgtcgcatgagatcatggaaatggatggcgttctccagatcggccgtcttagggtgttcactgacgtggtcctgggacacggcagccacgggaccgtggtgtatcggggctcgttcgatggacgcgacgtggctgtcaagcgcatgctggtagaattctatgatattgcatcccatgaagtgggcctgttgcaagaaagtgatgaccatggcaatgtgatccggtactactgccgagagcaggctgctggtttcctctacattgctttggagctctgcccggcctctttgcaggatgtggttgaacgtccatcagatttcccgcagttagtccagggcggcttggacctgccggacgttctgcgccagattgtggcaggtgttcgctatcttcattctcttaagattgtgcaccgcgatctgaagccacagaacatcttggtggcgatgcctcgcgggcgtactggttcacgctccctgcggttgctgatctcggatttcggcttgtgtaagaagctcgaagacaaccagagctccttccgcgcaactacggcacatgccgcgggtacctcaggctggcgagcccctgaattgctggtagacgacgacatgagcccggctatgcagggtagcgagtcccaacacaccgaatcatcagaaccagctgtggtggatcctcaaaccaaccggcgggctactcgagctatcgacatcttctctttgggctgcgtcttttattacgttctgacgcgggggtgccatccttttgacaagaatggcaagtttatgcgcgaggccaacattgtcaagggcaaccacaacctcgatgagctgcagcgtctgggcgactatgcctacgaggctgaagatctaatccagtccatgttgtcgcttgatcctcgacgacggtaagtcgatgctcattacgtgccatgcatagtactaacttttctagacccgatgcgagcgctgtgttgacgcacccgttcttttggcctccatctgaccgtcttagcttcctctgcgatgtctcggatcactttgaatttgaaccgcgggatcctccttcggacgcccttttgtgtctcgagtcggtcgctccacgagtgatgggcccggacatggatttcctgcgactactgccacgggactttaaggataatctcggcaagcagcgtaagtacacgggatcgaagatgttagatttgctgcgagccctccggaacaagcgcaaccattacaacgacatgccggagcatctcaaggcacacatcggcgggttgcccgaggggtatcttaatttttggactgtgcgattccccagtcttctcatgagctgccactccgtcattgtggagttgcgtttgacgcggtccgaccgtttcaagcgctacttcacggcgactgactaggtggtgttcacccacgtagacagtcatttacttgtatacatgcatatctagatgacatatgtcacaatcaataagttatacgagtcttacttatcattctatcaatgggaattcatgctgcagagtcgtccggtagtgtgggcggggtagtcacgtgtctagtctagtgaccggggaagccctcagcgatgagtcatggaaagcgctgattggcccaagcgcgttatctggaagcagcctagcgtccccgatgtcgctgggggggagtcacagtcatcgccaggacggtgtgattcagacttgcctaattcagccagccagtcccgtcgctgtcctttatcaacaccgtcaattctttcttctcttctttccatccatccaatcttcactatacacacatccaaaatgagcggtaacaaggctgtcgctgaaaacatgctctggggaggtcgttttacccgtaagtacaccaatcccccctcaatgcctctcaatggcacagcggctaatgttctcgtccggctgcagagggcctcgaccccctgatggtgcagtacaacatgtccctgccctacgatcgcatcttctggaagcaggacattgccggctccattgcctttgcccgggccaaccacaagaacggcatcctgaccgcacacgagttcgctgagatcgagcgcggcttcaagcagatcgccgaggaatggagcaccaacactttcgtcgccaaggagaacgacgaggacatccacacagccaacgagcgccgtctttccgagattatcggcaaggagattggaggcaagctgcacaccggccggtcccgtaacgagcagattgccacggacatgcgcttgtggctgcgggatgaactgcgcaagctggaaagcttcctgtgcgatctcgtcaaggtctccatcgcccgtgcggagtctgagctcgactacatcatgcccggttacactcacttgcagaaggcccagccggtccgctggagccactggctgctgtcccatgccaccgcctttgccagcgaactccagcgtctgcgtgaggtcatcaagcgtgtcaaccgcagtcccctgggtactggtgcccttgcaggaaaccctttccagattgaccgtgaggccatggccaaggagcttggctttgacggtctgctctacaactcgatgaacgctgtggccgaccgtgatttcgctatggagaccatgcaatggggcagctccttcatgctcaagatctcccgctgggcggaggatctgatcatttacagcagcttggagtttggctttgttcggttgtccgatgcttactcgaccggttcgtcgttgatgcctcagaagaagaacgcaggtcagtgcccccttgattactataacacgcaaatttatactgactttctcaaagacagcctggagcttctgcgtggaaaggccggtcgtgcctttggccagatggccggtctgatgtgcaccatcaagggtctccctaccacatacaacaaggatcttcaggagagtgtcgagcccctgctcgaccacatcaagactgtcggagacagcattcagatcgccactggtgttctctccaccctcactactatccccgagaagatgaccgccgcgctggcgccggagatgctggccaccgagattgccgattacctcgtccgcaagggcgtgcctttccgcgaaggccaccacatctcgggccgtgttgttgcactggccgagaagcacaacgtgcccatggacaccctgtctctggagcagctgcagactgtggatgcccggttcgacgagggcgtccaggcctgcttggactacgagcgtgctgttgaactgaaggatgccgttggtggtaccagccgccgggctgtgttggaacagaccggtgttcttcgcgcattgttgtaggcgttttttggtttttgggatggttggttacggtaaaagttagcgatgctacgggatagagatttgtatgatatccataattcaatgatttattagacgacatcgttcatcatcctcactgccgtagtacaagaccaaaaagtaagtctgatctatctagtgtgtagtagagtgacgattaagatggaagtaagggcgaagggaactgaagcctcttcagttgccttggcctgcattgagttgacacaccggttctcttctccaatcagtattccactcttatccttgggtctttcaagaattctgttgcataatcccaagccgcttcactcagtgtggaagtggcctccgctatcttccttggtgtcttgatggctagctctgtaaccaggctgagttttcttttcaagttgtcgttcagtagccttgtcgaggttgaagggagtgagtgcagtagtactatatatcaatcatctcccgacaaccacaactaccactgcagtgcactttaactggtcgagttagtagcgagaccatcctattccccctaaaccaacgatataaagtcagtctcatcatcactccctacttacttaactgggacacccccatcatcccacaaccccagcaaatcccccggcacccccctccccacggccccattcccatcatcctgatacaccctcaacaccccatccccattatgcaccaacgcacacttatgcggcacccccctcacaacctcaaacaccctctccaacaccctcaccaacttccgtatcttctcctcattatccctctcccactgcgccaacctcccctccttctccatattctgcgtccgcgcgggcaaaaacgtcccgtcgggctgatactgccctgtacacagtatcggagtatgcgagaaccacatctgcgataggttcttggagttatcgagtcgtttattcacagggccggttttgatctcgatgatgcggtgcggagggacgagggtgccggaattgattatatttatccctgtgggggtttgctggttggtattattgggattgggagtgtgtggtttcccgggcatgcatgcgtctacttcatagcgaagcaggatgtgtatcccgcccagggtataccgtaccactctgttgtggatgatgcttccgcggatgtagcgcggcgtccaggtagatgttttctcgaaggagtggccgtagccttcgaatttgcctacgaagttggtgttggttttgctggatgtccaggtcgagaagagtactgtggagtggattacttcgatgttgattcggaagggctttttgttggcgctgacgaaggagagcaggaggcggaggttgcgtcggtcggtgattaggtccgttgtggtgaggtttaatcttggtttgggggtggtgctggtggtggagatggcgcggaggagaggttccagggagcatttgggaaagatgtggctgttggggtcgaggatgtattttccggagtcggcggggatgaggaggggggttgtggggggtttgtagatggggggtgttcctttgaatctataagtatccgggtttgggggtgaatgctggggagggatctacctggaactaccatgctcttttccttcttcggaagaaggttataggatgtgattgttttgaggtcctttttggtgcagctgatgctggggtctggttggatgctgtctaaggggatctccccgatgggcaggaggaggccctttaggagggggattttgggcatggtgtggtgctactttggctgtttgtttagaattggaagtagtagtggtgggatggaatgtagatgaagtccggataggttgtgtttgctgggcacactactagctactaggagtgtagaggtatacgcaaggctcaagccgtgatctggccatgttaccccgcagctcaggggatacaccagcaacaaatcatgccagcaaatctggtaagttgaatgcgagtggctgtgttgtacttagtccgttttgaattttctttgtgtcagctctattgaagcatgagtgaagcggatgaatgggtgggtttaacggcgattgttgcttatttgcaattggggccccttttcttctccacttggacggggccagaaggagctcacatgttatgactttgaacaaggtatgtgagacatcctaggatatgagagttggtttcattggtcattagtacttatgtatgaggggattaggtgggtcaatgtgttgtatggaatcagaacactcgcaacagtttccttgtatgttaatacataaatagtatggatgtatatactagggtcagggtcctgcggaacgccagatgaatcggacacagatcgtgccattgttcagataggctctttagccgcccgtcgaaacactgtaatgcctggaccctgccgctattagtgtccagtcgtaatgacaagcgctcatgattgttggtgcctaatcgatatgataattaatgttacattcaccccagcagcttctgatatataatggggcagtgctacagatcagcgatggggtaatttccagatagtggggctcaagttgatgttcgtctcagattctagcttcatttaagtgtatgaactatgggtagggccaaagtaccaggaacaatgctggtgaatagaggtacaaagtcaatggcagacatggcgttgtaaattaggtacacaaaagccaggagaatataaaactttaaagtgagcagtgtaacaagtactacgggacgatggcgcatctgggagcgcgtcagactgaagatctggaggtggccggttcaagcccggctcgtcccattctttttggttttttatttcttttattttttttttccccctttgaccatccctatctatctctttgtcgtttattccaaccctcttcttatgcttaccactctttcaattgcgcactacgaaccgtagttcatcacagcaatccgtaattagatgatatagactaatcccaacaatcgctatggcacgcattggtatgtacaccgatcgcccgccctacgacagtcaagcaaggagatttgatctgttccgcctgtcccgatgcttatcttaggttaactgtcaggatgatcagcggtccattatcttaaatacgcccaatgaatggaccctatcatcctgtttggggccaaagacgggtgtacctggtaggatcacaataaaaattgcatagtccatttgcatgatagaatgtagcagcatcgctcgattcagtatcaaagcacccactctttaccgcgcaacagttccatcagcgccattgctgctcctaaactaaccgattggtgcaggctggtggtagcgccggaggaactcagtcagcgttggatggcgatcgggtctaaatttagctgggggcatccggccccgaagggtccagcaaaagaagcctgagcccaaccaacaaccctctagtcccttgtaggcaacctgcgtgaatccattgacacccgcttggcacctgcaaagcccgccaaccagatggagaaaagcctggccactccctccggcgccactgactcttccaacttcatgtccccgtcagacttatatcctgcgtgtgactgtcgcttttcctcccgctcaatctctcgctaactcccctcgacaactctgttgcatttccctattttgccagccatttgacgacatgtcagatagcacgctggtgtcagtcgttatctggaatcgctagttgctcaccccccgtcattcgctcccatttatcttcacttccccaccaccccctaaagtgagacgtgagaatgcgctggtcaacgtgtcttaccagcgccctcctcgcgtctacagcaccgctggccgctgcaaccagactcattgaatcaaatgctttgaatatctgccaggatagcaacaattttactgccacctacttcagcgtccgcttcacgcccgagaatcgttccttggttctgagtttcgatggcgtggccgccatctccggcaaagttactgccgatctctcggtcgacgtctatggctaccagttgactggtgagacgttggatccgtgtaaaatgaatatagagggtctctgtccgatgagcgccggtgccattaatgtccagaacgccccggtcacaattccggaagatgtggtgcgccggatcccgggtctgtagtatcccgcgcattgattgtctaatagtattattaacaaaattctaggtatcgcatacactgtgccagaccttgatgccaccgttcgggtttacatcaactccacggataccggcaccagtattacatgtctcgaagcgaccttgtcgaatggaaaaacagtctaccagaaaggagtcggatggacgaccgcggtgatctccggcgtcgggcttatcgcttcagctgttgcagctggtctgggcaactcgaacactgcggcccatgtcgccgctaacgtgctggcctttttcagcttcatgcaatcacaggccatgtttgggatgatctcggtccacatgccgccgatcgtggaagcatggacccagaacatgcaatggagcatggggatcatccatgttaagttcttggataccatttgtacctggtaccaaagggcaactggcggtacgccgtcgactgtcttgtccgagctctcgactacgtctgttgaagttctgaaacgaaagcgatcttttgatggcgtcaccaatgtgttcaaacgacaatatgcccagtcggagactgccactaccggcaccacagtggtgcggggaatcgatcgtgtggggttcagggccggcattgagggcaccaatatcttcctcaccggcttcatcttcttcgtctttttcgtcgccgtggtgatgatcatcgtcgcgttgctcaaggtgggaagccactttctggcgaagaaagggaagaccaagaccgacaagtttggcgactttcatgtgtcgaaaggtatcctctatcggctcattttcatcggatttccgcagatgtgcgtcctttgtctgtgggaatttacgcagcatgattcggcagccgaagtcgttttggcggtgatcatgttggtttccatgatctgcacgctgggctgggctgccttccgagtcatcattctcgcacggaggtcggtagcgatgcatcgcaacccggcctatatcctctactcagacgaggcatgtctgaacaagctggggtttttgtatgtgcattaccgagcgaccgcctactacttcctcgtgttcgcactactgtatatcttcgtcaaggcgatgttcatcagtctgagccagccggccccggtggtgcagacggtggccatggtgattattgagaccttggcgcttattgggatcagtatcgtgcgaccgtggatggacaaaaaaaccaatggctacaatatcgccatcgcatccatcaactttttaaattccatcttgttgcttttcttttccaacgtcttcgaccagcccggcatcgtgaccggtgtgatgggggtcattttctttgtgtacaatgccgcctttgcgctcattctgctcctcctcgttctttactccgccgttaacgctatcttctcgaagaatccggacatgcgctatcggccgatgcgggacgaccgggggtcctttgccaagtcggggagccagttgatcacggagctggatgcgctcggcacgactgctcggggtgagggcacgccggagatgtggaacaaaggcagtttgatcgacgacactgggtctgttgctagtgagggactgcatcgaagtcaccaagatccggcccgcgacactgctcctggtcgtgagatgtctgagacgcccgtcagccaggcgaatttgtttcccgtcagtcgagggggcagtcctgttcatcgagtagcgtccatgaatgccgcaggtgtgcgccgcagtctgttgagtgacagcgatacggcatcggcgactcacccgcatgcaaacctatagtggatttccgatgaataggaggtagcaactgaggcgttattatgatgttaaatgtatctaagttatatcttgcgctttctaaatttatttcatggtctggttccaagctatatgattttgtaagtgctctctgcctctgcatgggaatagtcgggtgcagtggatcttcagcggcgggctaacccgacccccgtggggaattgcagcaaatgcagcgaacagatcctgtggactggccattaggcaacactcggcatttccggctctcgcgcgatccctcttgccgattctcctctctccccaacttttctcctcatcgcgtctcctcttttcatctcgaggacccatcgattccagtctcttgttccattgtccacctgccgatggctgccaagtcatgcattgcagtttgtctgccaaccaaccaaccaacagcacgatcgcctcacgtccccacgcgcgtcatttccgtccatcaccgaacctgagtagcagtggagaaccagcagatatgcgtcattcctcggaaggatgatctaccgataactttgatcgttgctaccatcggctgccattgtaccgactaagcttgatggccgatatttagccgtgcagaaagccagcttgagagacacccagtttcaccaaaatcatctcacaatgtggtcttcctggctgctgtcggccttactggccactgaggcgttggccgtgccctacgaggagtacatcctagccccgagctctcgcgacttggctcctgcgtccgttcgccaggtgaacggttccgtcaccaatgcggccgccttaacgggtgccggtgggcaggccacttttaacggcgtctcgtcggtgacatatgactttggcatcaatgttgctggtatcgtgtctgtggatgttgcttccgcctcctccgattccgcctttatcggcgtgaccttcaccgagtctagtatgtggatcagtagcgaggcatgcgatgctactcaggatgcgggccttgatactccgctctggttcgctgtcggtcagggagcgggcctgtatacagtggaaaagaagtacaaccggggcgcgttccggtatatgacggttgttagcaacaccaccgccacggtctctctcaacagcgtcaagatcaactatacggcatctcccacacaggaccttcgtgcgtacacggggtacttccacagcaacgatgagctcctcaaccgcatttggtatgccggtgcctataccctgcagttatgcagtatcgatcccactacgggagacgctttggtgggcctgggcgtcatcacctcgtctgagaccatctcacttccgcagacggacaagtggtggacaaactacaccatcaccaatggcagcagcaccttgactgatggagccaagcgtgaccggcttgtctggccaggtgatatgtccattgctttggagagcgtggctgtcagcaccgaggatctgtatagtgtccgcacggcattggaatccttgtatgctctccagaaacctgatggccgacttccctatgctgggaaaccattcttcgacacggttagcttcacctaccatctccacagcctggttggcgctgcatcctattatcagtacactggggaccgcgcgtggttgacccggtactggggtcaatacaagaagggtgtgcaatgggcattgtcgagcgtggacagcacgggcctggccaatatcacagcaagtgctgactggctgaggtttggcatgggggcacatgtaagtacacagcagaagacaatcagtgcaatgctaataagaacagaacatcgaagccaacgcgattctgtactacgtcctcaacgatgccatctctctcgcccagaccctcaatgacaacgcacccatcaggaactggaccaccactgcggcccggatcaagactgtagcaaacgaacttctctgggacgacaagaacggtctctacaccgacaacgagaccaccaccctgcacccgcaagatggcaactcctgggctgtcaaggcaaaccttaccctctctgccaaccagagtgccatcgtttctgaatcgctcgctgcccgctggggaccttacggcgcacccgccccggaggcgggtgcaacggtgtcgcctttcatcggcggcttcgagctgcaagcccactaccaggctggccagcctgatcgcgccctcgatctcctccggctgcagtggggattcatgctggatgacccgcggatgaccaactccaccttcatcgaggggtactccacggacggatcgctggcctacgcaccgtacaccaatacgccgcgggtgtcgcacgcgcacggctgggccacgggaccgacgtccgcgctgaccatctacacggccgggttgcgtgtgacaggaccggcgggtgcgacctggctgtataagccacaaccgggcaatttgacccaggtcgaggctgggtttagtacccgactggggtcgttcgcgtcaagcttcagcagatcggggggtagatatcaggaactgtcgttcagcacgccgaacgggacgactggatcggtggagctgggggatgtgagcggacagctggtgtcggaccggggagtgaaggtgcagttggtgggaggtaaggcgagtggactgcagggtggaaagtggaagttgagtaataattagcgaagctgaatatatgacgacgtcggtgtgatgccttcattccggcaatataaatgtcccagcacctctctagtttatttaaatctacacctctatactatcattcataatgcacctcccactaccatccttccttttccttctctcatccctcctactcaccaccaccaccacaaccctaatcccctccccaggagaccgcatcaccatcccaacctggcacatccaacccaccaacaccaacaccaccccaaacccactcaacctcacaaccacaaccccccactccacaatcttcgccgccctcctccacccccaaaaccaaccaaaccccatcctcccctacaacgaatccaccatcttccacagcaccaccctctccctcattcccacaacacccttccaatccccctggctctacaccacctcccttaccctctcccccctgctttcccacgaacaaatcctcctaacaacgcacggcatctcctcccgcggagacctcttcatcaacggccaccaaatagcctctatatctggagcatacaacggccaggaatatgatatttctagccgactgaaagatggagagaatgaggtggtggtgagggtgtatccggtggattatatgagggatttcggggtgggctgggcggattggaatcctcctccgccggataatgggatgggggtttggaggggggtgggggttaggagggtaaacggggtggggatgggaggggtgagggttgttgttgttggggatgttgatgttaatggggagggggatgtgaaggtgagggttaaggttgaggtgaggaattggagggatgagagtgtcagtgtggtgtttatggggagggtctttcatgatgatactaacgataaaggagtggagtttgcaaagccagtgactctacgaggaggagaaaccaccaccgtcgaagcagcagttactatcccgaatgccaagatatggtggcctgctacctggggaagacaggatatgtataccgtgcttgcgaatttcaccctcgatgatgggaagttatctgatcgcgcggagtgctcattcgggattcgctctgtcactgctacgttaactgaacatggcgatgaaaaagatatctcgttcaaagtcaacggatatcccttccatgtgcgaggggctggatacagccccgacatattcctccggtttgatatcgatcgcgtgcgcacactcttccaagctgtgctggatatgggactcaacacaatccgactagaaggcaagctcgaacacccgcagttctatgatctggctgatcggatgggggtcatggtgctggcggggtgggagtgttgcgataagtgggaggcgtgggaggtatactcctacccttatcccccctttacctccatcaaccacatatactaatagataaataaagtacaacaccgacctcgaaagacactacccctggacaaccaacgactacctaaccgcctcctcaagtctcacccacgaatccctaaccctgcaaccccacccatccatcctcgccttcctcctcggctccgactacccccccaacacccgcgccagcaccctctacaccaccgccctgaaccactccgactggaccaaccccatcatctcctccgcctcctctcgaatccacccatcgggaatgaaaatgctcggcccatatgactgggtgccccctaactactggtactccgagcagctcggcgccgcgtatggcttcggctcagagcagggtgcaggcgtagggacccccgaactccccagcctccgacgattcctttctccccaggaactggatacgttgtggaaagagaaagatgcagggatgtaccatatgtctccctccggatcgcagttccatacaaggggtgtgtataatgctgcgctgtgggagaggtatggtaagccgacttcgttggaggagtatgtgtttctggcgcaggtgatggattatgaggcgacgagggctgaattcgaggcgtttgctatacggcagaatagatccggtagggctgcgacgggggtagtgtactggatgctgaatagtgcgtggccgagtttacattggcaactcgttgacttctatttgaagaggggagggggttattatggagtgaaggtggggtgtagaggggagcatgttacggttgatcacttgaatggggatatctatatcataaatcacgggattgaggggaaagaagggagggtggtggtggttgatgtggtagatctagctgggaagaatctatttcatagagaggtaggaagtgtggagctgggtccgacgatgtcgaagaaagtcacctctatcttcccttgggttggagatgggggatggaatggagtggtttttcttcgattagttttgaagaaggatgggggagaagtgctgagtaggaatgtgtatactctgccttctcaacttgacgttctgagctgggatgagtcgacgtggtatactacgcctgtgaactcttatgcgaatttcacgtcgttgatgggattgccgagggtagaggtggttgtcactggggagatgggtgatggcggagggttgaaggtcacgctggtaaatcgggataaggtaccggcgtggtttgtgaggatcgcgatggtggatgatgctgatgaggaggtggatgtgtggtgggaggataattacgtgagcgtgttggggggagaaaaggtggttgtgagtgggagggtggatggaagggtagggaaggggaggatgaaggttgtggtggagggagggaatgtggtgaggaggggatgctatatttcttaatatgcttcaatgtttgaataattctttagataattgtgattgtattgatgagtagtatccacatctatctcaaactatgtgtatctaactaccatctaagacaaaactaagaaattatggccagcataatacccagctgcagcagcagcagcacctagaactgcttcaccgtcttctgcaaccccccaaacctcaacggctttctcgtaaacttgtccggctcctccctcgcccccttcttccaataatcaaactccatccacacattctccttcatctgctcgtccatcgcctcgaggaattctcccagatccggactcaacggaatcactcccgtctcaagcacatactgatcccacaacttcaacaacacctccatcctctccggctcattctccgccagatcgtgcacttctcccggatcattcctcaggttatacagctgccagcgctctggtcccttcggtttcgggatatacacgatcttccagtcgccgtagcgcagggccgcacgaccacaggtctcccagccctggatgaagtcctctgggtggatgcgcgcggcgctgccattggcccaggggtagatggacttcccgcgcataggaacaatttcccgtccctggtatgtcggtgcggggtgcttgaggccggccatgtccaggatcgtaggggcgaggtccatgacagtggcgaattggtctgttatagcaccggcctgaacctgaggggatgtctgtactgaagtagggaatctagcaaggaagggaacgcgaacgcctccctcggtagtgtatgctttatacaatctagacggggcggtggctgcctgcgcccatcgcggtccgtaccagatgaaggagttgtagttgcccaggttctcgagcgaattatcgtagtatttctgaagatgagggaggacaccactcttcacaagagggtaggcttcgtaggctgcgccctcggcaccgttgtcggacatgaagcagacgaacgtgttgtccagctcgtcaatagaggcgagatagtcgacgaccttgccgacgttggcgtcgatgcactcgaccataccggcgaagacttccatcgcggtggaggacattttctgttcctctggggagagctcagaccagggcttggcctcgtcttcctctgcaaccacaggatgaggctcgacgctgtcgggaatcatgccgagggccttgaggcgctcaagacggcgttggcgcaggacatcaggaccctcatcgtagacaccgcggtagtggtcgatgtactcgcggggagcttgcaggggccagtggggtgctgtgaaggggagataggcgaagaaaggccggtcatcgccgcgttcgtgccagtctttcaggtaatcacgcatcttgtcgccgtagccatcggacgagtaccatccatcagggagcttcttgacgtaatggtcgtcttccgtgtgcagggcgatgtaactagcttcgaggaaggtgggagtctcatcggtgccttggagctggggctcataggcatagtggttggagcaggcagggaggtgggcaagagaacggtcaaagccgcgacggtagggagagcgctctggggtaagacccaggtgccatttgcctgccatcagggtgtggtagcctccgtcgcggaggacttcggggagagcgacaacgcgctcgttgagatagccttcatatccaggcataccgcgctgaggagcggtgctcatgccgccgcccttggggtcattctgaccggagatgttggtccattcgacgaggttacccagaccggcgatgtgatgatcggtaccggtcatgatcatggcacgagtgggactggattaattgttagacactgttgagagtatagtggcaggagaggacatacgagcatgctgccgcagcgtgaaagtccgtaaagcgaacgccctcttgagccagacggttgagattgggagtgcgaatctctcctccaaagcaaccaatgtcagagaagcccagatcatcagcgacgaccacgaggaagttggggcgtttcggagccatgatgtataatatgggcaagagactaagatgtaagctcacagctgaactcacagctgaccagaagcgaagacaggggtatttaagtggcatctaccccgtactacgccatcggctctcggctgaggcacgcggcctcgccattaaccgcaccagaaaccagaatgatggcagaagagtatcagatggagaggggcatcaccatccgattggcaatccaagtgaggagacggtcaatccgcatgttggaaccaatcagtgaatcacgccatggtccccgcttctcacgcactcggctgtcggctgccttgcctcttgcgatcatagtcggatgatcactggaattgctgtctactcaatcagcagggtggcaactgaccggaaaagatttgggatagaggcaagttgcccgtttttgaggtgctttgcatcgctggttcacgcttacttaacagtggcgggagaagcacccgctgtaacggtgttgtcgtacaaccctcactaccatttatactgccgacccgtgatcttcaatgcttatcggctattatcttagcaacgcttgtctacaatcagatagtactgacggattactgccagatatcaggaatgcatattatcatatctttgggtggaatctactcatcccataccacactgctcaaccccgtcgatgtaccgaccacccccggttcgccgatctgcacatttgccacctcatcccccagctttccagtctgcgggtcccgcgctacgatcgcaacgttcgacgacgattgatcgccaatcgcaaccaaatcgcccgcctggttaatcacaaaagtgcggggaaccgtgccatacgatgaggtgagttcgttcaaggtgatcgtgttattcgaagagtggtccagatttgccattgaatcgttgggggcgaagccttgatcactccggatcgacacatacaaggaattgcccgcttgacggatttctgatggcgtggccccgtccggtagctggccttcggtgtacggctcgaaggactggaactcatcaaagccgagacagccatcggacgtgtaggagaccgtgaaccctttgaagtgtccgtccaattcatcgacaatgtacaggacttgactgtcctgctgccgagtcttgagttgtctggtgagtgtagagtgctccgtctgccagaaaaggccgtgtctcggtccgctcccctctggataagagaggtcaggacaggtcccatccaattcaccgctagacttgtcgatggcgtacacgcggacgagatccgctcccagatccggcacgagtataaacgatccagttgggtccaggaggacttggtgaggatggggcgcattctgctgcgggttctgtttggtttcggagaggttgtagcggaaaacctggaggttctcatctccctgattcaaaggaagacggaatgtcgacatcgcggagccaccactgcaaccgttagatacaaccacacgccgaagtcgaggaacatactagtgagcgatagctaaatactgagtgccgtcatcaccgctatagaagatactgttcacgccgcctccaggtgccgcggcagtggctatctccgttagggtgccgtcctcgtcggccgccagagtggtcagagatccgttggtggacgcatcgccagactcatcagagcagtatagaatgcgcgaggccgagtcaaaggtcagccagctgggcatcgagccgcaagtctttagcgaggaggcgatggacagggagtaggtgtcgtcgctgcgctggagggagagactgtagacggagccgtcatagtgggtagcgtagaggttggttgctgtggccaagggcagacatgttgccagccaactgagagcgaagtgtcgacccatgttgattgtggtaggtgctgatgcatcgagggatagatgaggtcaataaatagccaccgcacggggtcaggaatggatctgcattctgcggttgaattgttccagggacggtaggagcgctgcagctgcatgtctactgtcagtaatgtagagaaactctgtagccgagggtagcctctaaccagaagtatagcttcagttctcctcactgtctcagtctagccagccatcctgttcagtccaccaatcatcgctaacaaacgagacgagatcccttgcttggacttcagcatattcgcaccatatgttgcttatatcaactgaaacagtattttccagacacaaccagcataccgtgacttgactaaggcaagagaagtaaacaaagtcaaccgacatcgcttgcatgcaccttcctaatcgagcatcttatcacgcttatcgcaggaccaaacagtgcaaatagcaggaccctgtataacgcatatattactaatcatgcacatcggaaatccggaggtatcacgtggcaatgttctccgcggtttgggcatgtggcttacaatctaacattagccagtatctctgtcactatactgagaatacatccagcatgggctgggtcggggtcgccacactcattgcaacagcatgcttcctgctgtatcgctatccccccggaacctgggctcctgagcccccgtcatccaaaccacttccgaaacccgtcaacccccctgcgacagaggaaacgacagccaacggcgaagcaaagccccctattgacgaggatgatgctgcgagcgacacccagaccacccccaaggcaactccatccagcgcaccagcgctggaagtaccttctttccgactagacgacagcgccgatcatccccgcccctcagtaccgcaaatccagtccggcagtgacagcgctcgaacccaaagcacgatgaaaccaccatttcaacccctaaaccagaccaagatggtagacagcactctcatgcctccgccacccccgccacagcagtccaaccccgcaaaaagctcctctcttatgcctcccccggccccgccgcgtctccgtccgatcgcatcgcagactacttctgcgccctcccttgcaccggggcgatatcccccacgcccgaataatacgagctcgagctcattgcgtccacccccctccgctgctgcctccctgcgcgttccgccaagcagcggcctctcgagcagcacgctcgccccgacgaaggtgaccgccaaaccgtccagctcttcgaaacgagcggttctcgaaccgggatattcacccctagactgggctgcgttgacatccaacccaaacaacaagttgcggggagcaaacctccctccaaccttgatccgagtgacgccgtcgatgctgaaagcacaaaatggccgaaagggcatggacgcatggacatcataccaggggaaagtctacaacatcacaccctacctccccttccaccccggcggccggggagagcttctccgcggcgcgggcaaggactcgggcaaattattcttcgagatccacccgtgggtaaactgggatgctatactaggagaatgcctcgtggggatactcgtctccgagaacgacgagtcagataacaagctggatgcgatggattaaccccctgtatatttatttagactcattgctgttgatccgtgtacctaatctacactttagaagatgataccctagacgatacaaatagacccatatcgttataccccacatacacatatatagaaaaaggaattgagaagaaaaaaagatcacaactcatccttatcaaccccctgaatacccaccaactccgtctcaaaaatcaacgtcgcaccgccaggaatcggtccaataccgcgatcaccgtatcccagctccggcggaatcgtcaacgtgcgcttctccccaatgcacatgtcctggagaccttggtcccatctacacccagacaaataaatcagcatccatttccatagacaattcctcaccaaagcaagctagcaatggtgggaagatggtaaacacataccccttaataactctccccgaaccaagcttgaacttcaacggagtgccgcggttgtaactagcatcgaactcggatccgtcggaggcgagcttgccccggtagtgcatggacactgtatctccgttttgggtcttgcgggtgcattcgaccgcgtgggtgacttcgattccgaggtcggcggcggaggcgagggtggtgagggagagggtgaggagggcggcgagagttgggaggcgcattttggtagatggtgtatgtgtgaatggacggatgaattggttggaggttggaggtgggagttgtaggatgggaggaattggggagatgcggatacgtatacttaagtgagtgagagcggaggagatgcggagaggtaactagttaggtggtggttgccgggcggttagataagtactaggttagttagctggggagggagttgctagggggagtatgcagagtcaatcttgtggggtattgggttgtaattggtggtttgtatatagggtgttttctatccctatgggatattgtattcacttcgtacaaattagcaaagataaaaaaagcagacatgttgattgcgcagggagtggtgtgtttaggaaagatcaaaaggaaaaacaaaaaagtgactagactggggctcgatcccaggaccttatgcgtgtgaagcatacgtgataaccaactacaccatccagccaacttgttgtgatagtctgctaacagtattgactgatgaataaatttggagaaataagcctgaatattaacaatgaatgtatcttgttgaatccctagcttactttgatagcttatctatttctacgattttcgtgtttgagatctgatagtatggagactgtcatcatatactgtcataaatggtatctatatgtacaaagaacaagatctatttaatatttttaagcccatttacccagcagggccattagcaaagcacccagacatagcagaccgaaagccgcgagaacaatctgtatcggtgcctttcgcatcgaagtgctgaacatgaactcgtgggccagtagctccaccagggctgtgtagatcagaatgccggccgaaatcgagtcaaagacaccactgacgatcaacgtcgtggcgccgtcagatgcataagagtcgcgcacgcctagaccgatcgcaatcgcaataggcgtggagataccgtatccaagtcccaggaaataaggggtccatcgcttggaacgtggccagggaacggtagctaaccgggatcccagacccaggccttcgaaggtttggtggaagacgaggacaacgtagagggtcacaaactcggagccggtgaccgccagggtcaacccaatgaagacggagtggaagatgattccaaactcgagaatgaagatggaggtcaattgagcgacgtactcctccagatcagaatgctgcttcccgagctccatatcatggtgttcgcgggaatgcccgagatggtcttcccccggcatatgggtcttcatgtcaaccgactcagcaggagaggcagcggcatgctcaatcttcacgtgatggtcatcatcctcgtcgtgagagtggccgtggccgaaacgggcaaagcgcatgaccattagctccacgaagaacagtaccacaatggtcattaggacgattccctcaacccaagagtattctgtgattgggccggtgaggcaatcgtcggtcaaggcctcttctgctggggcaaggaggtgaataaatgcggtggcaatgataacaccggagccaaagtatttagcgatgaagaaggcgcattttgcaatcttggagtccttgaaactccgggccatcacgggaaagagagccccgcatgttgaaccgacgagaatgacaaagatagacgagatacgcaggcccatacggccgtcatatccattgcccgtctcacaagcaggtgttgcatctctggcaaccagactctgaagagaatccatgttccaccgtaggatgtatccgacccggcaagttctctgcagacggtctggagcagcttagaatagcacgggcccgcccgaagaaggtagggatgatcgaaacgaggtctgacaggtatccggtccaatggcgtgcaggatcggtgtgacaggaggatggcggaagtgtaggcacgtggaagaggaatgtcaactgcagttcggttgagattgctggaggttcgtctgcaaggtcccccgctcttaaattggtttctcaaatgtgcgccaagttgttcagtgtgagagttgggcgtccccaaggtccctaaggctggtccacgtcaaaagggtccggcgatgaacggcgctgaaccggtgctgaggaccttggtggcacaaggtgaggggttcgcacaaacgcgattgctgaggcgtcgatttggattttatttagtcaagaaacgatctcaaacaacttgccagcgcgcagctcgcctggacacaggtgagaagtcaattgagcaacacaacgcgaagcaagaacaggagttgaatgcagaggcgcctccatgatggcgggcgacggagacctccagtccgttctgggtaaagtgccaagttgcatcagatggggaccttgggggaaagcggcgggttcacctcaagagttttcgctcgaaagtgaggaccttgcggacgaggttttcttttactagcctttgattggctcggacggacataggcggggcattttgacgcaatggttagcggcccggaaccttgttgatccggtgttgctcatttcctgcatcccgattggttgctctagagcggtcagaagggcgggattcgcatactctggcagaaacaatagtggggatgaacacctgctcaattaggtaattatgataccttgagtatctatgctgccacagaatacatgagcagagctctgtcacaaaagactgttcacaccaatggagcggaagtataaagaaagtttagcgcactgatctgccaatttacgcaatggcagtcatgattcagtgaccgatatgtcagcaccaaccaaaccctgagcacattcgaaggttgccaagactacgggtaaatattccaaagcagcatcatgactattggcgcggaagccactatccttggctctcaaacttccaagtgttccactactagtagtacggatgtagtcggaaatggggcgtccggataaccttgatgtgtaacgtccgtgtgaccttgcattgaagctccactcaatctcacaaatcgggcaatatgttatcaggtttgttctgccttttcacagagtttatgcctgatgaccttacctccacacaccgaagttcattgctagttcaattccccaaagccgatgctgcttggattcggcgaccggtactaggggcgcatcgacctagcactgagctcaaagcggttattagccaattaaaacaagccatgcttcatttcaagtctcctctaactctgaatttctggatattagacgttttctataatggtaaaaggccaaagctttgaaacccggttcatgacaaagatatgcaacatgttggatcagctggcactatacacgcgtctaggctgacttatgatgcctaggctgttattttcactaatcagggttttaaatgactgtacgcatccaagtttctgatctgagcgcggagccgatgagcctttagcgacctacgagatactgtcagtagaccttcatggtgcagccttgtctgcggcaattgcatcatgatttgatgcatttaactagcgatcaagggaaatggcgatgaagcggggtatggacctatcaaagcgccgatgaccttagcgccgagcatggccgtgggctcaccatgtcgactgcagccttgtcacaactgcttactctcagaatgttgtatacgactcagttcttatgcgaccagaatgccattgcatagtttgaattcaagatgaaaatccggcgcgaaaggttgctgtacggggcgcctcaacaagtaatatatggacttataaaactaccgctcaaattgatctggcagaacacagagccttccagtggcaagaggcccaggacagtgcccgctgaagctatcaaagttgcaattttctgcgctttatcgtacgaggctactgcggtcaagtattgtctagatgaagaactcgcatgtcaaccacgaacaataggccccaagaactacatgtactctttcggccgtataggtgagcacaagcttgttatcgcccaaccagttcacatggggcttgccaaagctgctcaatgtgcagcaacggttaggcaacaattcccacatgtccagtttgccttgctggttggtattggagcaggcattccatgcccgaataggtgtgatatccggctgggcgatattgcggtcggcatcccgcgaggcagccaccccggagtgatacagtatgacttgggaatatacgaggaggatgaattcgtaccacaaggatgtgtcaacaaaccaccatcaatcttgataagtgcagatggatcactagaagaagatgagataatgaaccgaagcccactgcgagagattttgaaagacatcacaaagaaccctgggtatgaacgaccatcagggcaggatatactgtatgacgatgattttcatcacatcaacactggcggcgactgtaccgagtgtgagaaatcggactggaagaaaattgtgccccggactccgcgttctctcgaacatcctgtggttcatcgaggtcttatactttccggtaatggcgttataaaaaccccacaggatcgcaatcgcttacggcgtgggcatgacgacgccatttgcttcgaaatggaaggagccggcatagccgatgtgattccttgccttgtcgtgcgaagaatctgcgattatgcgaacacgcataagcaggatgggtggcatcattttgctgcggccgcggccgcagctcattgcaaatccatccttctcaaaatagatacacaaggagtgggagatgctactgaaatgagctctttattgagtgaccaagacgacctattaagagcgatcagagctatgatccaatgtcaaagcctagccaccgcattgtggccccttaaatacctgctaccattagaaacaagccatgatggtgtatgttatgaacagaaaggatgcttggacctgaatagactgccgatagctaaagatgctgcctttgactcatatgcagagcagcacgaaactttttgtcttccgggcacttgcatcagccttctccagcgcattgaggactcggtgtacgatgaaagtggaagatgcatcttctacctaaatggtatggctggaaccggaaagcctacgatatctcgaactgttgccaagaatttcagagaaaaacaaatgctgggagctagctttttcttcaagaggaatgcaggtgatcgaggacatgcaagacggcttttctcgacaatcgccaggcagctcattacacatctccctcagctctcacctattatcaagaaagctgttcgagaaaaccctgatatatccacaaagtcactaagggagcagtttggaagacttctattttcgccactgatagaactgggaagaactggaaaggacaccgagactattgtgatcttgatcgatgcattagacgaatgtgagtcggacaaagacgtgcgactcatagttcatttactatctcaattgcgggactcgggtgtagtacacccacggatcttcttatcaagtcgacccgacttacctattcgtcagagcttcagccatctcgttgccaacaagtatcgtgactttgctctgcaagaggttctaagtccaacaatagaacacgatatatcgctgttattgaggcacaggatcgcagaattcaaaaatgataacccacttccgtccaactggccctctgagcaggatttccagaagcttgtcacattgtgcgttccttcgtttgcttttgctgctgctttctgcaacacgctagaggagcctcaatgggatccggaggaagtccttggagagttcctccaaagccccaggctcaatctagatcagatatacctccccatattgaatcgcatgctccatgggcagaccaaatcccagcaagagcgactacttcgggaatttaaagaagtagttggtccgattcttatcctccagcgtgcgctatcggtcaaatcgctttcaatactcactggaaactcagagaagttgataaagcggaggctgggctctctgcactcgatcataaaagtcccagacgatgatacactaccagtggaacatcttcactggtcactccgaacctttttacatagcccagacacgcgcgagacgacacccttctggatcgatgagaaagagacgcacagtgaactcactgcgcagtgccagaagctcatggaatacacctttgaacaaaacacccataatccaccagcctccgacaaaccccaagtggactcggactcagggaatgggacatacaacaataccaccccggaactccaatatgcgtgtcaatactgggtacatcatctattgaacagtgcggatcctgttgataaactagacacattatttccattcctccaggaacacttctttcattgggttcaggtgctaaatgtcatcagcgaccgatctactatcacagacatgatcaatcgtttacagtcgatcaagcatgtaggtattcagtcctgtccctatatgtaatagaactaatcatgtctccgttttaggatcataatatgtcgaggtttctggaagatgtgaagaagtccattcttaaaaatgaaggtagacggatagaagatgaagaagatgatattacgcgatatacagttggccaatcgctttatatggccgggtgtcttggaatttagcacgcaccttcagcgttcgcatgaccacaggtctagtactagatttcagctcctactatttatagagttggcggccgatcagattgtcaagaaatctgcattggtatgtaataaatagggtgcctaacaatgtaatctaaggacgccactcctcgtcgccgttgttgtcactctcatcatcatcatcttcttcttcggcttcagcctcctcggcctcggccccttgtcccccctcacccgcaactgattgccattggcctcccggccccacgtaaacgatccttgctcccctagtgaccaaatgtcttgggcaataattgcccactagttctcgctgccttaggcccaatttggtgcacctaacgttggtgccgaggcaagggaggcattgcttgaaggggccgggggtcgtgcatccgcacgaatagacatagatctgatagaagcaccttcatcatagaagtcaatgtgagatcatctggaattattgctctacttacattttttgggagagtagaatgtgagagagtatagtgtgagagactatttcgattgtgctgctactggactatggtatgctaagttctacaaaacatttgtgctatgaaatggaagccttgttgcaccttccttaattggcacgtcacttcatacatcgtgcttacctgtcatggtccacatgatgtaatgttgcctctgtgttgtatcgagttcaatagagattctcatttaccattatatggtcctgtacgagtagtggaggtctgcaacgtgtgaggcatggctgtatccagtcggccgataccttatacatgcattaggtgaatttatcctcccctctctacacagaagcatgtacactttatgaaaaacagctctaataagataagcgaaggttgcggacaagcttttccgatgtagtgatatctgggacttccggtttgactaccaccttatgtcatagccatcgctatcatgacatcttccgccgaaccagacgttctttaaatggcccatatgcagtgcgcattgcggcggtagccttgcaattttattgcacacactttggaaacatgaaagctataaaccgttccttctaccacacaatcgaagctgagtcctatcctgataggcccagctgtctcgtctgcggctttgtcttcgccaacgggaccagtgaggattctcattacagttacgtggatccgagataccgtacagggagtagcatatgtcgagctgaggctctagaggattggaaagcttctgggaagaaaaactggtggaagagaacatggtggaacacttcccgcgcaagtcagtcacctaggtacactgtatgtcgtcagctgttgactgatcagttcagttctgtaccaccctgcaacaggcacatgccgactttctggagtcagcctgcatcctctgacaaccggattggttccaatgaatgagaaagatggatacgtttgcggtagttggtttggctggttatcccccaaagaacgacaacttttcgtaagtccggacattctatgcccaacccaggagccggcgcccgacattgagtgggtggcttactttgttcactctcgctgctgggagctacttactcatcatgacttgggggagattgcggagagaaacttgggcatagttctcgacgctctccgagacagacataagaccctccgagacatatgtaagaaaactggctaccgacctagatcctggtattggatgtattgtcgggaaggttagggtccccccaggtccgacattcgatgacgctgaacttgaatctctaacagatcccgttcgtacaaaatgcgttaaagaagccatttgcctagcacgaaagcacgaaagacgaaggcaatcgaggatgaaacgaaagggttatttggtcacccgaaaggcaccacgtcccagaccttgcgttcttccgatggaaatactctatttgattcttgagtatcttccatatcaaacgattgtagatttggaagaaggattgcgcctcaatctcggcaatgggttttggcgcactaggctctctactcgaatattctacgaagtgaagaagattgccaccaacgaggttaattggaagcgcctatccatgttgctggaacgacggctcaagaagtcaaacgctttggcaatccgacggttcataatatcgtctctggacagagttacgaagtttgtcaacgtgtatgtgatggagcagcctttattactgttcccacggtacgtctatccctttccatgttctaagcgcaagaatgcggcctaatggaaactcccaagaggatcaccgcaatcagccaaggtcctcaaggtgaccggggagcagatccgccagggtgataacggcatcaaaagtgtgatggtggagtcaaacatccgcgaaggtaacaagaaacagctcctgacctccaaaattgtaaaaatggcgtcagtatcaccgatggttgcatcgactggaccaccgagatctatcttagctttcttgctcaggtgatgaaagaccgccgagttcaatcattaattggcaagagctagaatagtcggttggatttggcttggcgcttatgtgaagtgttggttatatcataatgtttggtttttgaataacgtatcgattgactttaacgtagtcctaatcctcactatattttcgtcttgaagtccacaatatctcacaaattgtaaatcgaatacgttttctgatatgtctcaattgctgtagatcatcggcggacctatagtcaaaatactattcgtagatgttggatgatggatcaaatagtatatatactatatcgtgcacctcaactcctattcaggacgtagcagccaatatgtccaggaaggccctgatcttgatgataatgagtgatagaaatatttatcaaacacaaatacccataatagagattttcataggtattaaatgacaagtagtttgggcagtgcctctagtgctgtcttattatacttcataatcttgctatctagaacctgccaattaatattagcacttgattatatagaaatgtaaaatggagtattttatacttatatatttactaaaaaatgagttcttacaagctctagtggccaataacggattagaaatacactctacctatcaatatacgcttttacagagaggtgcaaaacagcttcaccaatttgcactcttcctattctttctttgccccactgccaaagcgctagctagagaatgggtagatccaaatgggctcaagtatattagacgggttctgtcggcgcccccacgaaataagagggtcctgacaccggacacaacgagaaggtctccagagatccatcgtcctaattgcttgaggagagcgtttacctggcgtgctcgccaaaggcccttacaagaacgggatgagaatctagctccgaccaaccgtggcattgaccaccatacatactcctttcggtttagtagtgctactggggtcttttattttctgattccgtgatcttttattccggacccactccttcggttccctctgccgaagagatgctaataaagccacagcccttaaacgcttgatagccagcaattctgctcaacaggcaatatttcaaaacatttcatacctacagtcatacttagaatgtcaaaatatcaatatgagtaccttttcttccgcatcgccaaagacaatgcgatcgtatcgtcggccataaagtacaaacagttacgtctccaggccttatccgttgcaccgacttcattttcctctacctacgagatcgaatcttctctcccagatactgaatggattgacagagtctcagagaatggaagggagattttcatatgcgctgcgaaacccacacaaaacaatcaaccaaattcgcaaatcctagaacagaccaccacgtgggtaggccagttgactttgcgaggcccgctgagccgggaggacttcattctccctgaggaatccgggcagaagaagcctactggaggaaagaaccaggaactctggcagatgctcagcttgtttactctgcctgaccatcgcgggcgcggcttggggaagaggttgtgtcaagaggcgttgagttacttagcctcatataaggattctccacgtgagctctgggtccggttgatggtaaagccggagaatcatgcaaccgtcagcttgtatcgggggctgggatttgtggaagctggaaagtgtactctcgctgaggcgttggttgcgaatggggacaaggacttgctaccagataatatcagtggggagaagtatacgtcgagaagtgggctgatcatgatgttagagattcgtcgctcgtgaatcggccgttgagatgggctccgatgaagcgctggatactgaatgggagtgagaattggtcaaacaaagcttggtagattgataggatacaacttgactgtcgatattaacagcctattgctcaatttatgcgattatgaggatatttatcctgaaccgagcggctagaccctggcagcagtaaatctatcgcgaccagccgaatgtattttcttggcaataagccgtttccatatacagaaagttggaaccattaaggttgtagaatacggccgccaatttgtatctacaagacaaagtccctcgtatagcggcgcggttatagttcaaagatgaaggttgtatcatctgatatcgccagattgaatgccgcttcgacgtccaaacgacggaatcctggtgcacatcctaaacacactcccttcaaaagaagttctgttgagaatttgcggtcagctttcctgtatatcacaatttccatacttatataagagggcaagatgacaaaccctgaagaaaccggtccacgttgaggacctttgcactttgccgaatatcctccggtgagcctagggagggctctctcttggcacataatgtcatattcctgcacgatttgaacgaatgcaagtccgatagatacataaaagactgtgcccctccaataataataccattctcttcgagccaaccctcgatatcccgaggatcgaaccatgtagtatcatcactgtcacatggcatctcttgtcccaccgagacattctggacaatgtcaagacctgcctgcctttcttggtaatgggtccctgcaccacccaacctatacacatatgcagttcggtaatcggcactagtccgtagcaagatgtcgaaagtcgaaatcatcgtatcagtgtccgagtagtggaatgaatactggaaaacgcgggcgacttcagctccatccgcgtgcgggtcagttagcaggccatgagcccgcttgatgcaagtaaaataaagccgctccgcgaaattcctcggtactgggaattttgtttcaaagagagtaatgggaagccctaacggaggcgcaagaatgggcattggtgtttcggtgggtgtagtggctggtactggccaattcgtagaccaagtgatgttagcgttgggctcagcccttgagtgattatggcagacatgtccatcatcaagtcgtggctcgttgacaggctcgatcatctgagaagcagatatgaaatcgcgagtaatactctggatcttctcgcgtgagagttccggctgcgtctgaggagtttccacctttgtaatatgggataacagttcaaagaaagaccggctcatctgctcgattcgattttcaagaacctgcacgtagttcatgcgaagagcagcttcttccccttttcgagacctgtaagcccgttgtgctttccgaacttggttacgccgcctctatcagccagttagaacaccaagtcagacttgatgagtatggaagagcagtagatccctaaacatgcctcccctagacctttttgcgtagggtcaattggtggcctccctcgctttcccgtacgcaatcgacgaaggtcgtccgaaactatagagcatcgcttgctttcgtcaggacttccagacggcatattggagcctgttcctgaatcagatacgctggaagacatagaggttatgtaggagtgcacttatggattaatctggctacaatcggtctaatagtagttaacagaatcaggagtccccacactcaattgatttagcgcgtcctcttacagctctctcattggctgtgggtattcacgggggtatcctgcatgataggcctaagtggctcgacgtactctcaagaaactatggaggcggaggtacagcggattacagcgtggtcacactatgattcttaaaatacaaatattagtactgttggtttacctgctgcagaatttattctataagtagtatggtaatctaactaatcagaaaagataagagataaattgtgcaggtaaacagtctttcacgagactttatattcatatagttcattgtttagggacgttcacacttatcaaaactcgttcatagtcctgtcagatatctggtttcagattaaaatagactatgcatggtaggctacagagaagttgaccacaggtcgtcatgacatatattatagatagattaatactaacagaatactatactaatatgagacgcatctgagctgatattattgtattcaataacaataatactctatttgatactctttctcagccgccgggaagaaatattcaaaagaatatcaataattgtaataaagataattaatacagtatctggatcctttctagtcttgatgctgtagcaaatattcagaatatatatatctattatcatccctgtaacaagattacgggaaaactcagttatgatttacgatattatctattacctatccctgccctgaagataaacaacaccaacttaagcacacattcgctcaagcctaaacaacctcaaactccgcactactaggccccgcaccattacaagccgtcaaatccatcggacaagcactcataaacacaacacactcctgctccgccctcaaaaccacataatcccccaccttactgtccggctccaaaaccttcaacttattcccattaatatcgaccttcatgaacaaattcagcggatcaggcgtccatccactctcaaggaaccccaaaacacggctgaacgctggctcagcacactgctgcacagcatcgcgaagattctgggcacagttatcatggtccgcggtaccaccaagttcgaggtatcgttctggagagcaagcagcgtagagaacatcgtgcgtgccgggagatgtgtcctcgacgatggtcaaaatagggttccggttgttgtcgacgaatgattcgttaacggatgggaggagtttctgtaaagtgggtcgagtgtgtgccattgacatgtatcttgggaagacgggagttgatgggatggtgaatgcccaggtgtcgatgacttggcttccggaggtgtttatgatcttgattgattggccgacgtgcagtcgttgatgagcggagcgacgggctgggatggtgggcattttgtatatagtactagcttatcgaagtctgggtatcgtaaggttgactttcgtgaaggtcttgggtctgagtgtaaccacgaggttctagtatgtactaatgtataaatgaagattaaagcagctgtaactcacggggagaacactgtagtattataataagctcagtttgcactgataagctgcgtgtctccaaaaagagagggaggtgacgtcacgtcattcctccgcggactctcatatcgggctgtcaggcagtatagcatctcttctgctgaaagttgcataatcccttgcatcttctcgagaaattctcttcctttgttttcttgtagatgtagcgtagctagccagtcacttggcctgatggagtctctacgatatagctggatcggtgtagattccccttccccaccctcccattaacctaacctattttgtatacgtccaaaccaaactaaccacacaactccggggtaggcgcttagtagcctgggtttagtagaaaagtagttagaggaagtgactcggtatactgaacccacaggcccatcacttcctgcggcatctgcggcgctgacatgcacgaatccaccacgggccccatcttctcccctctacccctcaacccctccaccagcaccactctcctcataaccctatgacccaaaatctccagcatcatcaacaacaacaaccccgacttgcatttcaaacaacgcatgcatcaccataatgccccccaccaaaaccctcctcatcatcggcataaccggcaaccaaggccactccatcgcctcgcgcttcctgcacgacccaacctaccacatcatcggcctaacccgcaacccaacctcgcccatcgcccaatccctctccgcgcaaggcatcgagatcctccccgccgatctcaacgaccccaccactctcatccccgccttccgcggcgcgaacctcatcttcagtgttaccaactactgggagccgttcttccgcgcagactgtcgcaaacaggctgcggagcggggtatctcgtgccgacggtacgcgtacgaggtggagttgcagcaggggaagaatattgctgatgcggctgccgcgacggtggactcgttggatgagaatgggtttgtggtgtcgacgttgagtcatgcggcggtgtgtagtgggggacggtttggggagttgtaccattttgatgcgaaggcggaggtgtttccgaattatgtgagggagaggtatcccaagttggcggggaagatgtcgtgtgtacagacggggtatttcatgacgagttataggttggttccgggggcttattttaacaaggtgagttttgaggtttttggttgggggtgtggctcggggcattatgtggctgatttattgcgtttagaagacgacggaggaagggaaggtgtcatttgagatgacttttacgactgcgcctgatgccaaggttcctcatttggatgttaacgctgacttaggaaactttgtctacgcggtttcgaagatgccacctgggaagagctatatggcttatgggtcgtattgtagctgggcagagtatatgagaatctgggggagagtgaattctgttccagcatcttatcggcaaattacacttgaggaactgattgagcagactcctgatccggagtttgggcgagaggtgggcgatatgtttacttattcgacagatccggggtatgacggcggtgacaaggaactgttgacggcagagcacatacgcaatgtgagtaccatgtgatgatttgttaaagaatccacagctaatatctacaggctggaattgagtgtccaatgaccaacttggaggagtggatgcaaaaggaggattggtcgtctgtcttaaatagttgataggctctgactggtagatgtcgctgtccaagtcttgctgccttacgaccgaggttcggccgatataatatgagggactcttccagattgcgaacgaccagttgactcttgcactcgagtaggcagagattgtgccactgcatttcgtatttcatccctgataagcgcagagaggctcatttgcacgtcattgaccaagcgagtgtgcattgaatcgagctggcctgataggcttgattgcgcattggtataaacggtactttgcagttgcttagcaacatctgatattatgtcattcttgtgactggtctctctgctagacatctcaatcaatgtcaggtccttccagcaagcagagtcaatatcgctaatacgtggaacgcgtattgtgctcaaatatctgacggtccgttgaagtacattagaatcatggttccaatttttaatcgtggcaaggcgcatcacagcggagtaaacttcaaacgtgaggtcttccactttgactctggtgagatatggtacttcgcggccatcatttataagtctgtgatactatgtgcacttgctgccgagctgaatcagatccttgacaagagaaagaagatcagctgtcgccagatactcaggccttagaccaacgcgctgtgatccagatttcgattcaggtagtttctcatcgtcatagcttccgcgctgcacatcaaggtccatggcaacaagatcactgagatctgaaggactcagccctttggttgcattctttggcaggccaatgaggaaagcttgaggtatctgaggagactcattgacggaggacttctgtggcgattgcgactcctccagaagatttctcatacatcccaatatcaatgttcctatgttctgctatgagttagtagataattgaagcagaaataggaatgttcacctacctcaatgatgtagttcagcccagcccagaacaacgccttgtacaggaagtcttcactttctagttcatgtttgtccatacgaattccgcttatgtatctcttgatgtcttccagttgttcaacaaatggaacagaaaattgataatctgcagccagattggcctggcaattctccagattccagagacagggaagccgtctccatttgtccaatgcggtagctagcagcttctggcgctgcgaaagctcctttgtgatggacttctgtggcaggaacaacttcctataggccgccacagtagaactgtcagtcttctccattctcctgtatgctgtagtccaggccttctggatttggtgtttgtcctttgctccgccagctttgagagctgcaataatacccttggagacaggtcttgcgttccacgcagcctggagcgctgttccgagtctaccaacaaccttattgggactggcaccatgctcaagcagcatttgcactgttgactcttgaccagctgctgacgctgccactagggcggttccaaagaatcctgctatatggtcgactgcgattcccccggaatagttccccgcctttggcccacctgcaagcagcaggctgacaatagaattatttccatagtatgctgctacatggagaggattgcctaacgttccatcttcagttccggttactttcgctttggagttgagtagcatctcagttatcgaatgatgtccttgagcggaagccacatatagtgcggttccatggggacctttctcggcgttcacgttgacatgcttcaataagtccgcgacgatctgcttatagccacgataaactgccacttgtagtattgtctccccgtcagcattgcgtgtgttcaagtccttaggatcagtttgaatcaattcctcgacgaccggcccgagattgagcttaagtgcgtagtgtatccgagagccacgcctttgtcttcgactctcggcttgggccccatccttgccggtcatagattgatctccaggctcaagccagtccagccaattatcgaattgttcagaccggaatagcccacggatcctcccttgaagcaaggcacgctcattggccataccgtcagctttctcgaataactggtaatgttgaaaccagtactcggcagcataacttctgagggtcagttcgaatctgttctcactggctgtgtccccagctttcagcgattgcaaaaggacatcaagacagcgttgggtaatttcgaaatgagcctgttcctcggaacaaaggaactgcgatataaggctgtgctgccctaggcgaacctgtgtctccagatactctttcgcagagagatgggcgaaccgaagaactctgtcgcacttcttgcttttgcgattaatggttaaggtttgcgtagactgggttacccaccggcctgtacagatctcgtaaactgcatcagcgtcatgaaggccaactgcagaggcaatttcctcttgagtaagcggccgtagttgtctcagaagccatatgaacattgatcttaaaaactttccatcaattgcgttcacagagcccaaatgcttctcataaatggctaccatgctgatcggaacttcgttcagttttgcctcaattttcttagggtcctttcgacactcgcgtatttcctgaaccaacgatgtagcccagagaaagttcctatgatttgttagccatagcatggatagtcattgcggtggactggtgtgactgtactttttagctccttctgtaagtcgtgtccaaatacgtgactttagggaaacagggagatcgctgatgccatcaccgtgctgcattgtcgtgtcaatgtaattgcgaatatcaatttcgagcccttccgctacgtcagtttccacaagtatgtctttcagatgtccgcgaaggcaatctcgtatatcttcttcattcttgctgaccaggagaatgtgtaggttcgaaagtcccgactgagccaatcgtttaatgagttcgagaagtttgtgacgttctcgatcttgtgattcttttggaacctcgtcaaggccatctaggactatgaagacgtccttctgtagctcaagcactgacaagatgctgtgcaggtactcgatgagtgtcttggtgtctggatagcgtgcgaacttccggtcctcgactaaggcactagatatctcttctgggaaacccccaaggctacttcccagctgtcgtaagacaaaacgcaacaacaagtcgatgcatgtagtgtccgtctcatcaaaacgaaagtaccaccgcaatagtaccctgtttttgtctttcttgaacaacgtttcgagttggttgatgatggtcgaactgtagggaattagcgggcttagaagtaatcagagggcactgggctggcgttttcgcataccataacgacgactttccacatccagctatctatactgttagtgtatgcgaaactatttctggctttttgaggttccatacattcaccatgcagccaaagtaaggattgtggattatccacccagcttgtatattctcggcgctcaagcaaccacctccctgctacctcagtagcatcgctggatacaatggcagaccttagctttctatgcttgccatcgctggccgcagctagatcgctggggaatagccattcaagtagctgtgtttgaatttcggcttcaaaatctcagcttatggttcttgtcaccagaaatcagacaccgtgacgtacctgaaagcgtcttatcaatcttcacaatccccttcatgatcagagatgtactcttggaaacgtcccctagaatagtctggatcttcttgacttgcttcatctcctcctcttgggctattaacatgtcagcacaaagagcgactcccatgagaaaacagcaatcgacttactttcgaacatggattgctgctgctcagccatcagttgccgaaaccacttttccaccatctcgtcgcttccctgaatggcgttctgcaagtctttcagcggctcctgagttagcgatttgaaactttgaataatccgatctaaccaggatattattagtcttggcatttttgatgatgcgagatatatccttaaatacccaatcttttcgatgtgaccgactgcttcacttttgcggcatactgtaggacacatatatacacattcacgatggcgtcccctaattcggtcgcattggcaacctggactcggtgataatgagcctcgatgcgagagtatcgagccaggagtacggcaaggtattcggaggcttcccaaatgcgctgcatccgttcctgattgttttggataagctgcaaagcgttagccatacgtcaatcttttgagatatcagttcaatagtcacaaaccgtcagaccgaaggaaaccacagtccatgcgatagacgcatagcctgtcgggtcgaatttgacgaccacatcgccgagcgcttgaaccgtcatgatcgatttcaagatagaacttgcacgatcatacgcgttccccttcgattttgacggccaccgctcctgatgaaggcgtagtttgcttttagtcagttccataacaccctctacatattccttgggcaattttcctatcttgatgttcctattttgccacttttgagtcagacgcttcctattcgcgtcgcccacatcgacggacgtccaggcttcttcccacaaatttcgtacaggctcgaccacggcaggctttggttttgctgctgctgtgccattggactttccctgtactggcttcggctttgtaggtttcgtagttggcggtttcttggccttggtggttgtgcccggcttggcctttaccttcaccggcgacggtttcttgggcgggtgtggagtgtcattttgtggtttgaccatttggcttattgaatcggtttgggattctgcgagagtaaatgtgtgatactaagggaagaattatcgcgagtgaagctatcatgatggaagatcgcgttcttgcgggagatttgtaccccgcgcgaggctctgcagaggtcaagctgatggggctcggtctgtttcatagtgggaagagctaatgccgttccaggatgaggggacacaaacgagtattatgattggatgaatagtatgcgttgtcagctagctagccagcgagatacgaggtgcccgcttggcctgcagtgacgcctgcaagctgcgggtgacactagagaagatgtagatatttgtgggaagtcaagtgcagaacgactgtcacgcggattaaggatgcgaggaatatgggaagcctagaatagtgcctggaaattacggcaggcgtgaaagcggctctaaccgccaaccttatcctctgaaagacacagggatcacactcgtcttggactgaaagtaccgagaatactgggaattgagcttacttggattttgcagtgataatgacaaagtagctatcgttgcatttaatgttattagtcgtgtatcaatctttttctcagtgaatgaacacccgagatacgcatcttctttccactcagatacttccccacataaatcacccacttattttgagaagctgaactgaatattttggctcactgatcctcccgtggttccacataccacggcaaggtaacatccatagtacgacgaaactcctcagccacatctccctccaacccccaagcggagatcacctcctccccaagcctatattcccactgcgtattaatccttaaacgggcagttctggcgttcttatcccggctgaatttcaaagactcacgactctcttctcccgtacgaaagttaagaagcgagagacacacactatctagtcgcggcatttgccgcgctgcctcgcctatggcctgatagagtacactcatgttggcgctttttatgtattcccgccggttggaaaatccgtctattgccaacaatagatcttctcgtgttagcggaggatcaagaccaagtaacggcgaccctgtgcttgttgagttagccaaaacacatgatgaaagtatatagctagttcgaaaaaggaatgatattgcagtttgaaagattgagaccaagcgcagagatacttaccatctatgtcgtatggaggcatattgagtacttgaagctgttcgagattcggccaatatgaagcattggtgctgctttccgctgatggccagaaaagagccttgctgatctgcatatgactcaaggtgagtgcccgtagccgcatgctcaaggtatttagtccgattgacagaagatccaacccattgtgatccaagtaggtcagtcgacggtggtatacttcgccttcatgtagccgacgggaccattctcggccgccttctacggaaagatcaaggctccccacagattgtggtacatggtgaatgaaatcaatcatttctaagtgcagaagcacgtcagtcagctcacagcaatctctaaagctaatagaagaaagtaaggtcataccttgtcttagcaagagacgaatctcacctagagaatcaggtatgtatatcaaatcatgcactgatgcatgcctcacattggggagataattaaatatcagccgaaaggatgacagcaatacagcatctgcacacgtccctagcaaatcaatcgatctgacacatgaaggactaggaaagtcttcaaggtgcttttctgtaagacaagctggaagtgtcttggaatgactgaacatagtctccctcaacgatgaatcttgtgggatactgggtctgaaagccttatattcaggactacggtggtagaggaccagctcgagacctggatttcgctttccccaaatatgcaataccagaaacaagtggcggagctcattgtggtactgattatcataccattcaaatattggatgattggagtttgtgtgaaatataggatcagtcttatcgggtaagacaatacacggttgccagaaaatatgtcgaatataacctaccctggcacaccggtagtcatcgcctgtagtatatctgaaaagatggaacacctgcgtgggacccaggaggcaaatccttttccagataaagggttccacactcctctgccattgacgggaaataacagagtattgggcaaggttcgatggttcccaaactcgtatcagaccccacacggggcctggattaggatcccagtttgaatgaccttcgtctgtgttaatcatttcgcgcaaacaatgaacgataatactgattatctcgctgggaagtggcttcatggttttgagtggtagtggcgttcaggtggaatcgagacttgctggctcaacaaaagcctagcatttaaaggcctatagaatgtgctcaggtagagttaggaaaatgaactttcctttatgagagaatgcaagtggagtgaacgacattagatataccattgtaagggagctgactcttacttcgctacgaccgttggatcaagtatcacccacattctgtctctttgttccaggggaacataggtgacttccacttttactaaagagttcgatatgtatatggaatacaccacccttttttttcctttctgtaccaagaatgggcttttcaaacatacctgcgaataattagtccaaacatatttaattcaaatcatgtagatgtctggaattttccgatgaaagggtaaaaagtatcgtcactaaaagtgaaggataccaagatctccatcgattttgccacctgtcgactcgaagctgctcacttctctgaatatcccacaattactattacctgctgcattgcatgtctacgttttgtcgggccgtcggaggagcgtatggaggggccactcagctcacgtaagacagactcactagtttattcatcaatttatctactaatccctctcaaggctagttgcagtaaagccactgtttattttgaaagcgtgatttgtagatggcgggattttgatcaaacatggattacgtgtgctatcaaaagaccctgtatttctattgagcgagaaactagcacgagccataatagcgcaatcgaaatagcaatgagactgaggctggaatagcaagtggcccgactcatcgaagcgctatccggcttctactgcgggtccataatccttcgaacaaggattgtagctgacagcttgcaggacacataagccactttgttgatgcctagcccgtagaaatgaattgaaatcacgtataaaccataacccccaacctccgatatttgttgcttcctaattactatacttgccaaaagttccttactatggcctcaccaagtcccttttggggcccatctacttcacatgccaagttagtataaaggtcatgaaccaagtgcaagctaacgtttcaaagtttctgcgaggaggtaattcgctgtatttcaaagcaaagaagatttatacgtcagagcttctaacaggaacaacacaggactacgtggtcaccagatacattgccgagtttatcaacactcttaccaatctcgtgtacagtatgtcgcgacctgccgcttctacaaataaatctcataaacaacccagtattctacgcaatatacggaattcgccatctgcatcgacaaccgaataaggatgtcttccgcgcccttccctattggggcttgatgggtgtgggtattgcctctgcagctttccacatgaacctcaagtaccatacccaaatgagtaagtatcaattttctgcttcacttttgagatgggctcgctgctgaaaaaagctaaaacagtggacgatgtatccatgctcctcaccacaaccccggtgctccaccgcgtcatgaccgtgaacaccagtcgcagaacctcgactattttggcaattctgctaagcgcagctcttctgggactcgtagtagtccacgtactgacagacgagctcatcttacactccgtcagtttcgtagtcagcgtgacgatcattggagtccgtacgatgcagctaaccactacccgtacgccaaagaattctctcgctcggcggcagatctggggtatggtgagatttggagctggtaagtccaaagcccccacctatccttttccatgttttcagaacattgactgcaaaagctatatttgagctgggattcctcgtctgggtagttgacgggtgggtatgtggatggttgagaagctcgcgggcagctattggtctaccgtgggcgtttctacttgaactacatggatggtatgtagcattttgctttatccgtcctgattcttattaaccccgggctgattatggatatgaaacaggtggcacatctgcacgggaattggagcctacatattcatcgcggtcattgatcacctggtgtctggggaagatgttgaggccattgagtactcatttgcctggcctgcaccatgggcttctcgttctatctttgcgggaaaaggttcagcagtgggtgtcaggtcggagttaaagacagagtgaggcgagagctctatatggggggttcgaggcgggagacgaagggatcaagcatcagatatgctcctaagccaagctttaagctcaaactcttcaaccactcaagctatgacggtttccatgtttaagaacattctgtacagtcatagcaatgattgatgaacccgaaataggagataagcttgcaccggaatgatatccagccaatgaagaagccagacttagtcacacgcggcccaccccttccaatcggcaatgcggcattgagtcagttgtatgcgatcggatccccgccatgcaccccgccggcaatttgcattgccggtgcgccccgccttctggtctcaaaagcttcgaactcctgccagccagaaattttcataatcgtattcagaagtaatttggacatatttgaagaaaaccaaacttagacgcaatggccaaccagctgcatagtgccccgcccttccgggccgaacatatgggttccttgctccgtcccgagagcctgcttgccgtgcgcgagaagattcgcgataccggcatctccgaggaggctgctggtctgcacgccgttgagaaagagaccgttcgtgatgtggtcaagctccagcgggatctgggttacaaggctgttacttctggtgaatttaaccggactcgtttctggggacagatgtgggatgagttcgagggtatggttcatcgttctgatcttatttctagcgcattgttgggagcatatcacttactgataagtcaggcacaatccgtcttcaggatgctgaagcctccatgttcagactctaccaccccgacgtggttagtctgattgagaaggaccgcaaggtcatgcccggtgactcggtgatcgctggaaccaagctttcctggaaccccgagaagtcggtgtcaaacctacatgaactgaagctggttcaacaggccttgcctgagagtgaatggcacaccatcaagctgaccatgatcactcccgcctggttccacatgcgctacaagcagggtaaggcttacactcccgaggcctatgccaacgacgaggagtacttccaggacgtcgcaaaggtgtaccaggccgagcttgacgccctgtacaaggctggtctgagaaacgtccagttcgatgaccccggcatggcgtacttctgctccaaggctttccgccagggctgggaagaagacaaggataacattggcaccgttgaggatctgcttgatgcctacatcaagctgtacaacgactctctgagcaagatccctgctgacatgcacacgggtattcacctttgccgtggtaacttcatcggaggcagacacttcgcggagggatcctatgacatcatcgccaagaagctgttcgagaacctgaacgtgaacacattctaccttgagtatgacaccgagcgtgcaggtggcttcgagcccctcaagttcttgcccaagaacaagaacgttgttgtcggtgtcatcagcaccaagcttcgcgagctggaggacaaggaggcgatgaaggagcggatttacaaggccgccgacttcgtcagcgccggtagtggtgagactcgtgaggaggctctgaagcgtatctgcgtcagccctcagtgcggtttcagtacccacgagagcggataccccctcagtttggaggatgagaagaagaagctgggtctgaccagacagatcgccgatgagatctggggacagccctgagctcttacagatgtgactgagacgggcggtgtcttctggccttccaccagcgaagaaatcgtgatgatgtgaaatgagttatgtatttaaacagacgtgtcaaagcagcatgtgaaaagatgatgtacatatgggagtggtgaggggggcatcggtaggcgtatttcgatggaattaggttgggaaacgcccatgtgctgtattccaaaacaagtagtcttgttattgcccctacgagtacaattcttgtgccgactgttcgaaattttctccgtattcttcaatttatagcatgaacgcacgttaccaagcagaacagatactaaacaatcactctacggcatgacagaaatgcgtctatctacagaaatatctcctcaacatatctcccgcgcggaaggttgcgcttccactctgccacatccgttacgtcagtcttgccatcgagcctatcccgttccagcaacgcaggacctagcacttcgaagaccgagttcgacatcttcttccctccacagaccctaacaacgccgccactggcccatagtgataccacgtgatcgagaaatctcgctatcgcagagtcgatgtacctgaaatctgcaccctttacacgactatacgctcgatggatactgaccacaccctccttttcatacccatccatctcgtctcggtacatatcatctagatctcttccgcgacatccatagaagagcagcgcaggaccaaccttcttgccggccaattgtcggaacctgcgctcctggatgaatcctctgaagggagctaagcctgtcccagcggctaccatgaccaagggtctagaattatcagaagggagacgaaattctgctgtacaagggtgtagcgctatgtagagggtcgcatgatggcgtaaagtggctaagtgattcgatgcgattccctgtactgcgctagcttccccatcatgtacaacggatcccacgacagtataggttagcgttccatatcctggcttttcgtttggagaggacgagaaggaataggcccgtggccgcataggtgtgagaagagatagaaagagcccaatggaaggattaatcgtcgggaaacgttccagaagatccaagacagaaacatatttatcttgtatctcgactttgaagagatcaccggccaagtctctcagtattgtttgagtgcaactatcaggggtggaatcggccaaggcaaggatgccttttggactggcaatctgccggagctcaacgtaggcgccgaacaggtccgaggctgagattggggtattgacagggagtcccagagattgggatctagtcaaagtgaggagcatatcaccctcaagatggaatcttgacaggacacgctgaacattttgagggctgttacggggaaggacataaagatgatcacccggttggtaagtaaacccgtctgggagacgaagttccagatgtcgcttttcgggaactccaggttgtgagaggcaccgggactctgtgatactcgtcggaacaaatcccttccgtagagtgacccgtggtggatcgctgagcatgacttgacaacttgacgacaccttgacaccctccgcatctcttcgtatgtgctcggtgcttcctaactccgggaacagatgtgtgacggaccatttttcaagatctgtaaacagatcgctcgttgcggaatctgctgtacctagaggggcgatccttctcccccctgctcgctccatctcagcatcaagcaacttaggcactgcgaagtacgtgcttgcccagtcacgatgacctgtataaaatttagtcctcgtgcaattgaagaagacaaaaatagggactctaaccgcagccgaaaacggaaaatgaaacgccacttaattcgtcacgtcctgcagttttcaaccaagctacaaagtcagacgcttcatctgctggctcgccgttgtaagaagccgtgataatgatgaccggattatctgttggtagcttgccgacggccgatcccagtggttcaatcttgcttctagtgaatccatattctccggcatcagctgccaggcgaagtgccagggcctcacagcttccagcattagaaccgtgtaatatggttatccgtgatccttcaacagtattcggacggattgactgatggtggttgatcagtggtacctgcgaggctacaggagcgtgaagtttctgggcaaagtcggtcgctcgcctctgacgtcgaagacgcaccttcatgtggaagccgacaggtcgaactgtcatggttacatggtacttaagcttataggtctcatccttaatcaaatcaaaattctgcagaatcatcgccacagcctatgtgtaacgtcagccaatatgcgtgacattttttagcgggccctgatcagactcacaagaagagattgctgccatgcaaagggccttccaatgcagctacgcactccgtttccgaacggcttccatgcacagggtggaagcttctcgaagttttcctgtgacattcgactgggtctgaaattgttcgcatcagagccgtaggtctcggggtcccggtgcactgaatcaaagacgatgaatatgggttgatccttcttcacataatactttccatctaagatgtcatccttcagaggcttaagataaaaacctggccccggatctcgcagccgaagagtctctcgcaagatcgattcaatgtatggaagtttttggaggtgctcaaccatcatggggccgtccccaatcacttggtcaacctcgtcacgagccttttgaagaacatcggggttctcaagcagataatagaagcagaatgaaagtagacttgaagtggtctcatgtcctgcaatgaggaatgtcaagagattatccactaccgactggtcgctcaaccgctctcccgttttggggtcgactgcagtgagcattgcgttcaaaagatcattcctttccacgggggatctgcggcgttcttgaatgatctcttccgttcgtcgacgcagattctgcgcatggtcatggaaatcagccatggccttatgtcggaaccagttgttgacaaaatcgggcagattggactgcgtaaaagcatcggtcatgacagctatgactgcttctacgaacggatcctcctttccgtcccgataaaaactgttgaagcggtaatcgatggtacagagactgatcgtatccaaggtcaaggtcgtgaagtttttgcacacgtccaaaggaaaggattccccaagacgcgcccatttcaaacacatctgctcgcatatgtctttcatgtcattgaacatctcccggatcttcatggtgccaaaaagtggcataaggatgcgatgtgctattgcccatttgggatcgtcgctttgggcggtaaagagtccgtctccaaccaccggcttcatcttttccaggccgcctgccaccaacttgcaaaatcgtgtttcatcgcacagctcttctgcaatcctcctgcttgtcaccatgatctctgttgaggatccgaaagtaagggcgtatatcgggcctaagtgcaatagaatcagcacgggaaagtccagtgacggcagcatctcgtttaaactataccatgtgctttgctcagccgatcaagtgactgcgttaggttgtctaggtcaaagtctagaatgtttcctaaaagcggaagagctgaattgttctgtcagtattatttagacctgactttaacggatggtagggcttacgtctcgggccaggaattgggataatttttgcatcgctcatggtgctgccagtttggtattgtttgataggattcgtaaagagcaattatatcatagagctggattcacttcttgacgactatctcttgtgaatataaacatacgacaaaaatggccaacttccgatttacttggactgaagtaggcaattgcacgcagtgggttcacagtacgatactggtacttaggctactattcattaagtccgtaccaattgacattacttactaccattatctcaaccaaccccccggatattcaggacgtacaaaagagacaagaaggggaacgtccgatcggactttcggtcaccactttcagaggtccgcgcccggatatcctaattgggtgtcggctaaaaaacgtgtcctggcagtcacccctttatccgacaagtctccgtagcgtctcagtcccatcgctcaggtcaaacgccagaggcagttgaaacgtaatatttttggtcatagttaggctttatcgtttgacgcgatgtcgagaggggtattcttgttttcgaaagtcacatacagcagccatacgcagcattatgtttgatgtgcaaggaaatgtaccaaatagtcctgactgacatttatctcttttgtatgggttgctaagtaggcttagtatgctctggtggcaggtggctccaagggtttgggaagagaaatctcactggcgttggtaaagcgaggtacgtcgaaggactgcaccgagagctcttaagcgttgccactgactctttgctatcaggagctcacgtgacagtgattgcgcgctctcaagatgcattggataggatcaaagtggacatggaagcggtacgcgtgcatggcgatcaagtcatcggtatccagagcttggatttgaccaatagtgaagaagtttgtacaattgaattgcgagtctatctcaacgaaactttcactgatgagatatactgcttggctaggtgtccagatttgtccagacatttggaaacaagatcaccgctctgttctgtaccgcaggtggcacggacgaagaggtgggccactttgtggacatccctgcgacctcaattcagagctgcatggagaagaattatcttacagcagcgtttgttgctcaggctgtcatggggacatggacgactgagttgaagcgggtaggagagtgcgacggtgcccagaaatctcgccacattgttttcactgcttccacagcagccctcgtcgctgtcccaggatacgctgcatactcaccatcaaaggcagcgatccgagcattggccgattccttgaggcaggaaagtctcatgtacccccctgctggggcgatacaagttcactgtagcttccctgggacattttacacggacagcttctatagagaacaggcgcggaagccgcaattatgcaaagaaattgaaggaactgttaatgatggtggtgggttgacagccaaagatgttgctcagcgtgttcttgttggacttgattcggggtgttacttcatacccacggatctgcaaacccggttgctcctgaataacatgcgaggtcccagcccacgggactacccattacttgactggtgcatgggctgggctgcctcgttggtctggccaattataggaacttatctagactggaaggtagcaaggtctggcggcggaactgtataaaagccttaccagaaagagacatatcctggcttcttacgtctatgggtttaatctacgatgctatgaattctatcttagattgagatgcagtcatcttcttttagattaccgaactctagtggcttgctgggtgcgatattcatgaatttgcaactatgctgatgaaaaccaacaatttgacgcccttgtcttttcatttttgtggtctaatagcaaaaagtccctgaacatactgctcagatagaagactccgaagtggcttccctgtccgatttgttgggatcgtatcgacgaaaaagacctaatagccgttgacatgtcagtgtaatcttatgaatgaggttgagcgagtcactgctactacttatagatataatagaagggggtttcatacagctttaggcaccttaaacatggccacgtgttgccgaaaatgtttcttaagggcggcttcagtgacttgtttcccaacttcaatgaccgctgcaacacctgtaagaatagatggtcaatgatgaacgacagacctgtagtgagaaaagcgatctggtgggtttatgacataccaacttcctccccatatatctcgtctgggattcgaaagcataccgactccctcaccccctcaaatgatgaagcgacatgctcaatttcgcttggacttatcttctctccacccttgttaataatctctttaatccttccagttaactgcagatacccatgctccttgactacccccaggtcgcccgtgcggaagaaaccaccaaataagaaggcttgttcgttcgctttggggttgtccaagtatccagtcattatactcttgccgcgcacacagatctccccaactattccaggctcatttgttaacctacccgcgtctggatggtttcctgctctaccctcgcttgggagtatcattacctccacggtagatgcgatagggtagtgtgccagccggcgcatcgaactgtcaagcctattgcagaagatagccggtgctgtttctgtcatcccgtagacctcaattacttgcgtcccaagctcatgaaggcgctggtatagctccggagaaagatcgctaccgccagagcggataaaacgcagtttaggcatcacatctggccggggaaaggagatcagtagtcggtacaaagtaggtactgcatgaaaccaagtcgcatttaggtctatgcaagactgccaaaattgacctggtagggccggaggaataatgacgcaccctcctgagaagagggaggtgagaagagagccaccgacacctataatgtggaaaagtggagtaataatcatgcaccgatctgcaggagacagcttatgggcatcgattataatgcgcatcgcgacaagaaggttttcatgactgagagcaacggatttaggcgctccagtagtgccactagtgaagagcaggaccgccttatcagatggccgtagatcgtatggcgagtggattggcacgtgtgactctgctcctgaagagctatgttctccttcgatatagatatttggtccctctgtcctgcagatagctacaggaatcgcgagatcttgtgcagctaggacggaggcagatatcaggtgcgtgcttttcatagaaataaggagcgatggccgcattaagcggagtatgtcctttaattcctcccgcttgtattgcggattcaacggcgcggctgtagctcgttgacgaatcacagcaagaaaagacccaacaaattcgagcccgttagggagaacgagtgcaacccttgtgccttcgccaaccccaaattgagcgagagtgctttgtacgcgagtgaccgattcattgaggtctttgtaggatacaactgtcgaaggggcatttttcgtagaaggtatgatgactgccggccgttctgaaccttcggccggtaaagcgagaaccggaggtaggttagccgcggcggatggcttatcgtcgtatgtcatcaggactggctccagaagtaatatcccagaggtaatgtagatactatgggtaacacaaaggttttcatgcactgagctggggtataaatggcaccatgtgggtagattggaccactacagtaaaggtatgaagcttgactaagtatgacggcgttacgaataattccaattattcggatatactacatgactgcatgggtaaccgatagagggccggtttccacattgggcaccggaaacattaagctgaaaatcggagaggaagcttcatgaaggctcactgacctacgcatgaccagacttaagcaaatagaggactggggccgaatgtgctataaagtgatcttatcatatttggtcagaccgtaattccgctatctatgtatcaaattgaaacaaaacacagtcaaatatgggaagcagcgcggagtccattattccttacttgccaggctcagtcttgcccatcgtgagccatggccttccattcgaagaagcgtgtgtcaggcatctgaaacctactctgggttgcagtaagatattcgtcctagcaagtgcctccctaagccgtcagacagatgctttgatgcggctagaggaagctctgggaaatatggtagtgggaaagaggcaggggatgaagccacatgtgctcctgcctgaggtcctcgaacttgcggtccaagtgaaagattccggagcagagtgccttgttacattgggaggcggaactctggtagatgcagccaaaatagtggtgtttgtaagatccattttaaggtgcgaggaatgccaatggatctgactgacaatacatcagacactcaagaggggaatcacaaatacggaggccctactatccgagatgcacgagagcttgcaatttaaatccattccgcctccctgggagccagatcacaattcaacaccattaaagatcgtttgcataccgaccacactatctggtggagagttcaacctcccgatctcaggaggagtcgatccaataacacttcacaagcaattgctatacgatcccactaccccagggccatctctaatcatatgggacccatatttgactatgaccacgccccttcatacatggattagtactgggattcgggctgttgaccactgcgtggaatcttatgctggtggttctcgggtgaatgccgaagcccaagactgtgcggtgcgagcgattcgcttgctccttcccgcgcttctacagacggcgaacgctccagatgattacgcggccagactagctgccctggaaggtagcatgttggcagttaagggctcgttcttttatgacggccctgctggagcaagccatggaatcggacaccaacttggccctcttggagtgtctcatggtgataccagcgccattctactgccagccgttgcaagattcaataagccagccgttcaggcacaacaggaggcgttgctgaaggctgccttctggtctgaatctacaattaataggctactgtcagaagaggggctagaggaaggtacagccgaccttagtcaggtcttggatacaattatcagagccttgggcttgcctagaaacctggaggacgtggggattggtagggacaagttcttacagattgcggaaagtagtgtgaaggatcgttgctgtcgaaggaatccgatccccctcacagacccagcatcagtggtgaatatccttgagtctgtaggcatggtttagcacggaagaacagcagactgaacgtcggggtcgcgagagggtctttccgttatgatgcattgctgaaagtttggctttcgtcctctcccaaagttcttcttgtttctcaatcatttccctggagagtggtatcatctgtatcatctgtatctccggttcatcgggacccggctactcttctgagccttccgaagctctgtaaatggtaataaacatttcgtttggaatgcatccgatagccagacgccttccctacataattccccattgaccagctcgatatcagtatccaatccaaccatagtctcacttgacactcatcaatagatcgaacagtcgaagcatcatgtctcaattggaagttcctcaagcggcagtcctaagaaatgccacagccctgagagaggttactgtgactaccccactcgacgaagtctttgacgcctggcacgaagacggggcaataataatcaagggtatcctttccacagagcaagtgaatcagcttgaaagcgagctagatccccttctgaacaaagtaccggaaggatcgcggtcatccgattatcgcatgcaggcttttcacggccgcaagacaaagcgtgccggggatatcacgaacaacagcaaagtctttcgcgactacctactcgacaacgattttctccacgctgtttgtaagcggaccttcagtgaaggtggtcaagccggtgattattggctgggtacggcggctactatccacgttggccctcatcaagaaccgcagacccttcaccgtgacctgggcagctatccgccttacaagaaactaggaccggaaggcaccgaggcgcagataaactttctcatcgcgacaactgacttcactgaagccaacggggcaacccgtgtgatccccggcagcaacaagtgggcgttcagtgagcgtggaagtccagagcagaccatcccggcggagatgcaggcaggtgattgccttttgattagcgggaaagtggtccatggtactgggagaaatacgacagaccgggtgagaggctgtctagctatgacagtttgtgccagcttccttactccagaagaggcgcatccattcattgtctcaatggaaacagcccgcgcgctttctagccgtgcgcagcaatttctgggatttcggtcccagtggcctcgtggttcgcccggtttgtggaccaaggattactctgagctagctctacacttgaaacttgatgattagtgtatgctacacaggttacttcttgatgatgacagatcctggatgaactgaggatcgatattgctaggtagcacttcccgatgagaagctcgcgcaattgaacgtattcccactcaatccatatctaaatacagacttagccgaatatgcatttctgccaccccacgctctgtggctaccgtatgagtagactggtaactcatttcattgtattcacagctcggttaaattgtgcgcttagatctacgacggttgccccatttgctagccgatgcgccatccaaatgctacatcagggccccgcaatatgttatcgagcgacatagctcaaatctgcatggttatgtttccgacggaccgatcggatgtggaagatggacgcttcttttgctcatcggtctccggctatcagacgagcttcttttccggtccggtacgcagaggggctacattcacttctcggagcgttgaggaggcatagaagctgcctcaaaattcacccctcatgcttaacaacggtaataaaaaggtttatgaactgggtagattagggaggtgtctttctaaagagattatctaacagagcctgttgccttcaccgcctgaataccatcatgtcaaccagttccacctttaccaagggtatgactgagagtgtacgcctggatctgacccgcccagatgacccccctgttgcagtgacggagaagctacgcttctttttatgggttgcaagtattgcattgggccaggcgtaccgggacttgaaagcatggcgtctatacaggccatttcagacggcagacctagcaatccattactttgtgaaccttccaatttatcaaacacccattgcctcttactgacccctgctgcaccatcagttccttcccatagggcgtatggacccaaggcttattctcggcgcacctaaaagccgtatgcttgttcgaaccatccccgagtcagtgacaagggattacgaagaactagatgatctctcacaatgcccgacacgagaggttgtcaacgcagcctccaataattacggcggcttcactcattacgagcaccggagcgctgaactcatacagtcgacacttagccagctgccgttcaacccagcgcctatgaaacttgaagcgcgggctaggaaggacttggctgcatacatgtctgccgaagtctgcgttacaacgacatctggatttggtgcaaatattttggctttcaggaccgtggctgaaactgctgctgcattatctcgcagatgcatcttcttgatggaccgggactgtcacagctcgatgttcactggggcctttatgaacgaacgtgccacttcctataggttcaagcataatgatcttggggacctggaatacaagctccggctactctacgagaaggctccggatgcttttgtctgtgtagcagttgaagggctttataggtgagtaggcatcccatagcctctataatacctacagtgaggttgggcttagagtctgacatgagatcatagtatggagggtgtcgtatctcctggaccggcactcttggcactaaaaaggctatatggattctgtctgctaattgacgaagcccatgcatttatgtcgatgggctctggtggacgcggttcgtttgagtggtggcagaatcgaggctacgactgcccattgagtgatgccgatattatcacagctactttgtctaaaagtgttggctgcactggaggattcgtcgccgcaaatggtatctgtgcccaacagcttagacttcaagatgagctgttatcacacgaaggggcagaatctttgtccacggtagctcttgtacggactttaagcctgctgaaaaagacccgtttgattgagtatcgcatgcgtcaattgaaggccaaagcgggatttgtgctccagagactcacagaagcaggatgcaaggtcctctcctctccagattcagccattatatgttttcctgtcggtgagttgcagtcccactcgagattatttcgaagaaccttcatgctcataacacccaggaactgttcgacaggcgtcaatgtttcatgcagaggccctcaagaggggctttgccgtagcctgtggtgtgccaccagctacacctctttggtaagcttcacaaatgttgcttaaggaatctgctgacgaaacagggcctgtcgaattcgaatgtgcgtgtttgctacgtcctcctgggctgacatcctgaatctggtcaacgcaacgatctcagtggcttgcaaactaaatatccatgggatcaaacccatggtattggatgagagctgccttccttacgatagtggggagccgctagatgtagctgcagagagtgaggcgacagataaagagtttcatgattatattaccacactcagagtgtccgatatgccttcccaagatctttttcctgcgccccaccaaaaggaggttgtattcgccgggcaggaggctttcaagaagtatggagttgggccgtgctcggcacggtggttttacggatcgtttgacatattcgtcaccctggaaagacgcctagcgaaattatacccctccctccaaattcacatgggtcgttgtcgaggtaaggttaaacttgctctctaacatttttaaatgtcttctgactctgtgaaggcatgatctgtgcagatactgaagtcatgctggtgtccctccttaatgcctgctccgagccagtctactcacaggagatacttaatctggtcttaatcccgagcgatgccccatgttcagtccgaaatggagccaggctgcacaaggctagccagcggtctcgaacccaggtttacgagacattgagtgacttgataataccaaccgagcaagtctcatggacaggccagaatctgcacttgacgatttatctacaaacggtgcagggaaacagcatcctcgacctagggcagagagtacagactattcttggcatggtaggagaagaccgagtgaaaggactggcccttattctggatgatcgacagggtctgggcaaaatcggaccccggaacctagggtacctggacctaatggagcaccaacacgggaagacctttttccacactgccctagggcctacagcagagaaaacaactgttttgattacgggatcttggttcgacagtttcgggcaccagggaggatatattatcggtggtgcttcaatgattgaatctctgacggtgaaggcgaaggccttcctgttttccacaccaccgatgcccgtgcaagcggctatgtctgaccgggctctggagatactttcatcggcttccccagagtcgtcggatcgaagttatgatttcgagcagaatccattacaaccccctgatgaaccggactacgctgcacatagttccgagtgctctggtgaatccggtctagaccagcttctgatccgcaaggatagcgccattgtgttcgtgactggggagcttgagagcgattcagacgaggccaaatcaaagctgtgagaggcccgagcagcccttcagtcatgtccttcatcatatgactggctggttgtgcttgatctcccaaggcctcctaggataaataaatacgcattcaacagtaatgcctaatacattgggtgaaaatgtagattgtgatgtagatctccatgttagtggaccgaacagtgtttcggatgaggaaagtccgagcagaagaccttccgttcggataccaaatgcggtaaacgattcctacttagacctcatatatgcgaattcgcaccataaaaatgcctccattccgtattttaatcgacatagagtccagcctccaacatgaattatcagcaagggaaactagtcctcattaccggagccaccgggcatgttggccacgctgttttgctccgtgccctctcggccggataccaggtacgaattacgctaagggaaccctccaaggcagcccttgtccgggactcgttacctggcaggtaccacctgaaccgactctcttttgtcaccgtctgcgacctcactcaacgaggagccttcgacgaagccctacaagatgtgtcctacatcatccatatagcaagccccctacaacgtcccacttacaccgactacaaccgagatatcattgcgccaactgtccaaggaacctccaacctcctgcactcggccctgaaccaccctacggtacaacggatcgttatcacctcgtctacatctgccattctagacatcaaccctaccaataatctacccctcacaccctcggaccaccccatttcgacaacccaccgccaccctaactatggcccggacttcatcacaacctccgaacacgcctacatagccgccaaaaccgctgccctaaacctcgcaagcgcttttcgtgctcaaaatttgccccatttcgacatcatccatcttctcccgggctacgtcttcggacccaagggtttagccactaccccccgggaagctatcagcggaagtaatgtgttcggaatcgggctggtgatgagaaaagggtcatggagagactgggttgttgaggcaatgtcgtgtcatgtggatgatattgccgaggcgcatgtcaatgcccttgatcccagggtagcagggaatcaggacttcatattatctgttccatttcggccggaggaggtgaagagcattatccgaaaaaggttccctgaggaaggagacatggtcaaagagggtatttttgcgggtggaaatgagtattaccgttggtttcatgtttcttatgatgtgagtagcagtgaagagatgttgttgggccgaaagttgaggggcattgaggagcagatcgttgattctgcgaagcaggttctggctttggttaaaaactagtagggaggtacgagatatatatatatatatctctctccagaatggtcagttgggagtaacatcagtatcagcggtaattagtagatggattttgtgaggcttttcttttttgttcagtgctagttatttatatacactgttgtactcgagataccttatttaccccagttacacagcagcttacgtggagatttcagtggtatgagatggtccattgtaaattgcgataactctcgtctttgcacggaagtttatcatgttataatttgtggactgattttcatggcaaataatcaacttcggtagttaattgagcaggccaacctactagtatggtcgtcctacgccagtaagcctccaacagttgtcatctcatctgcgcccgctagaacatccaccatatgtttcaagtcatgaaacaaggttgcggccttctcatggctcactagagaagactgatagtacatcttcaagcgaaaaactcctttctgctggtgaatgagaagaagaaccggccagtcactcttcatatcatagtcctgtaagtcacgccgtgtaaccattcgccagatgtcgcccttttgttcatcgtctgtgtatccttctggcatagcatagagctcagacttgaggttcacgagtgactgcacaaagggccgaccatccccaaggttatataccccagggatgagaccctgctcccactgagcggtggcaaggacctcatcctgcacgcgttgcacgaggtcctccacgcgctcattgtattgcgtcaggtcgatacggagcggcgtagcactgaccagaggccccaccatacgccgaacgtcctggtacgggtgggagcgaccatgccgacacagcccaaaagtgatatctcgtaggccagatagctttgccaaagcaagcgaccaggccgcaagaatcaattgtgtgtgtgaggcagtctgtgactgagaactaaagactgatgccggaacgacctcgatgatttccccgtcgagctccccaggaccttctgggcatagggagtgaggatgtatgtttgcgagattagagccattcagatatttttcccaatattcgcttaccgcattgtcggtccgcgtttcatggaggtgagtgacaaagtcgccaaaccagggacgctcgggttcctgcaaataggttgctggagaatgcagaatatgcaacatctctttctcgattaaataacgtgagaaggcatcacaaaacatgtggtggatactgatgataaagaagttcttgccgtggatatcgtcgttcatgatgagacagtactgaactgggcgtgctcctggggtcatcttaagggtcatcgtgtgttgcatgtattcctggatattggtgctgtggacccattccgacaagctatgttcaagagccacctgaatatattcgtctccggctttgacgatggtggtccgaagtattgggtttttattttcaagatgctggatgagctgctgtaggccattcaatagcagaggcccttccacctcgtagacgtaattgagtagtcctacatttcctgccatggccagagtcatgaaaaattctgttgcattttaaacatcccccactagaattagttctgctatgatgcatttatatcgatgatgttgggtctcaccttggattggcgttatccgtgctgctttgaccactgtcctactttcgagccccgaatccttgagggaggcttgaagatccgtaatctttattccaggagcgatgcaggccaattcctggcgctcactagatacagtattggacggtggctgggtagcgacgtagtcgttacctttagatgaggggtcaatctgcgtttttccggtgttgtccttggcccaactgtaaaactcgctcagggttgggtctatataaccaaggattaaacgagggctggaagaaatttaggccaaattccagtacaaaggttggcacgtacatttgtacagcatgtctagatcagtgtcaggggccaatagagctgtttcacccagtaactgaatggctttaacctttatatatgagagtcaatatgagggattagaatctatttcgatctattctgggtccgaacataccgaatcaccgcctactattcaaataagcagatggtaaaattagtaggtctttcggaagtaagaacggtgtcctacgctcaaagaagctgtctgactctccaaactcgtcaacaccaagacagagcacatcagcccaaatctgcttcaaccggtccattctgctggaaaggtagggagagaggatgatcgaaagcttgcaatgatttggttcagagattgctgcaatgcgacagtatgtgtcctaccatcaccctggagggtgcgactggatatcagagccattactcggcgtatatcggctcgtggctgacacattgggcgccggggcaccgtggtcggttgacaagaagggatatccgggaaatccgattacccaatctggtaccgagcctgaggtttgctacaggtgcagagttttagtaccatgcttgtgcataacatcacgccagatttctatgaacagctaggaggcgggtaatattgagccaactattcttgcaatagcacttaactctacatcgtagactataatctcaactctacatcgtagaatataatctcaactctacatcgtagaatgtaatctcaactttacatcgtagaatataatgagaaattttaacccaggcttgcttgggtttagcctctcctactaaattatggagttgcttggcctgtgagcttccgttttagatttcttgccgctcgaaatagtgaaatcgattggagtagctattcaacgacaggaaacttggaaacccttgttcctcgcatgtacgttagtgtgggcaacaaggtcttccattctttcaaccacactgtactgctcaataggaaacggggcatttggccgatatatgaatcacaattcacacatcataacaagaaaggaaggagaacatggctatcatcaatcattttcctatgcatccatctttcagatgttgctgggcgaacttgatcagttcggtgatttcatcaaatggcacatcggcgtcgagtgatagtctgccaaagaaacccgatgctattccgatgtaagatagatccttctggctatttccctttctgatgaggatgatgaacaacacacaagtggcgatggatgggaaataatacagcgacctaccatgtcaggatattaggttcagatcttcttggcacttatgttattgacttaccagtcatactgcacgtcggacagactgatacagtaacaggcacttagaatagttcgagctgactgacaacatatttcctcatcccactgagtgttgctctgacatgactgcaggatttggattgcaatcaccgcaccgtggtacctatacagattgctgagtctgagccggcgatctgtacaggtcagggtcgagtaattcatcattctgttactcggaggagtatcgcaagggaatgggagctcttttccccaagctttcagggccctttcaaggatctcaatggagtcgacggtgtcactgcactcgccttcgcaacaacaagagcccccaccgtatagccgtctgagtatacgagagcacaaaccagcgtaccggctgttgatcaagagccagtccgatttaccgaatgaattaaggagccttggtggggtatggtcaatgaaagcctcgttgaccaactgcatatttctctgtcaaagttgcagccttataatgcagagacgtgcgatcttactggaaaggtaccttctctgagacagtgcggcttctcaaggcagtatagaaaccaaaaagcgcgcctcgcagtctcttgctcgataggaccagcatgtgtccgttggatcgcgggggtactgttgagacgaagaccctgagcacaacaggtcgcctccgctatcagcgaagatgccaaaatggaccctgttctactggcaaaataggactaataagacacatcagtatctgaaatttcatatacacgcgggtcagtatagctagtgtaccatcacaagaagagactgcattgcccgattagcacttcttctccctaagggacttttggactcacctgaagcttttctagggatgcttcagcgggtatttgatgtctaaacttcaatgccttgtcaaagaactgggacactggataattagcccttgatgctgaactcgtagagtcttttaaattgaggcaatgggacccaatggcgagaatagcattgagaagtgttagaccagcagggaaaacggctgctttatccattacacggtcgatcagtctttctaagtcttctctatcgaggagcgttggtacactgctgacggtcagctacaccttgtgcttgtgtttagtccaagctcccttacccttgggggtcgacataggaagctgtttgactgtatcagtttgtcacagctgaagcatagtcagacaagctatcagggtaccagcataccgtctatacatttgtaggcgaattctcggctataattctctgttccttcttcagacttttctgacgaagtgtttccatggctttctccatgtagcagccggaatcgaccagctgccagcctatcaaggacctgtataagcttcgctcgctgtggtctgctcatgtcaatgtcctcctcgagcacaagtgaatgaagctttcctgtgatcgaatggccttgtgttacttggtcagaagcctgtcagatattgcaatacccaaactcatgccacgaaggctgccataccaagagagcgtgattgaagtgcctggactaaagttcagtggacataaccgtaaaggttactcgaggcattttactgaccactaaatctgcggtaaaccctgtcggtttatcttcacggtaccgtgtaccgtcgaatgacaatgatggaccagcatcacttcgaacccccgcaggttcgaaaggggcgaaggcggtctcagcggttgaacccatagggctgctagtcacatgtgcatcctcttcttggttgctatacatgagtaggctttcccagtcccagtctccttcaaattcggccattgttgtgaactgattatggcttgcctcaggcggcaactgatgcgaattatctatgacttcaagcgcaggttccgaatttgatggatgtatcgggcgcatgttcctggtagaagctggggctgggatagattcagggtgtactggtggaccctccatcactgtgggatcagaacaggctgcggatgagagccgtcgttgtcgacccaaacttcgataatgacatccaagggagcaccgctacgaagggtcaaaaactttcccagacaggcttttgccaggaaggacacctacttggcattgattgcacggttgatcgccgttgcctacataagaccgcatattaagaaggctctattgggacaaatgccgaaggaagggatacccgtaacatacatcgaactttcctttgtctgcaagaatcacaagccccacggcgacgcttcaactttggcttctgcctgcgatctgtctgaccgctttggcccatgtcggttacgaatatgaacgaatccatcatctttagtggtggctagtaacggggatctcggctgaagaaaagatgaagtactaagttgtagggtaacaacagcaatcaggtcacgtaccctcaaccatcaactaatgcgggttccattctactcagggagaaaaaaaattatataactactcactaccagctggagcacactacacttagtaagacgcacgttcccctcttttacttctttacttaaccttggcaaggctgaggtcccatgaaatgaccttggttgactccctcggagccgatacttacgagtacccataagcattcatctcggacaagcccttgtttccggtctgagatacggcatcctccctattcgagcggtaagttcgcattcagctccaaatcctagtgttttcttagatggcatcaatatccagatcagggtgccatccgcgctctccgctctcggactattgtctactgtttgtcagggttcacgccgcccggcttcactagcgctctgattctccacttcttgctcttcttacttgcaggtcttatcgccggtacactatccctacccatacttgaacctgtctagaactaatcgcgttgattgaccccataatgcaaaaggaaaagagtacaaccgcggcgccccccacccaacaccaccccacttggcaggaaaacacttccttgcccgagccagttggcactttttcttctcctaggaccgacattagcagccagaaactgctcgggtggtattgagttgaggacctgactcaacattctgtcactaaatcgcctcagagatatagttctgcggggctaagtagttggtatgcagtatgtagccaccagaggatgccttccaattccactcaacggcttgcaattgatctatacttgttggagaagccccagcgatgcgcgtatcattgtatgcaatgcaggcaactccatcacagcgtggctggccttgctgataagcttaccactactaagtattcacagcgcctggcatccctgaagcctagtggaatacaaacttattgtacgaagttcttagtcttacaggctaatttcatagccaacaaacgtcggtccccatgcatgtcgtatcatcagtacccaagttgttattatttcaacactgaatgcagatgtctgtatgttgacagcgtgctccatctatcctggctataatgacctggtcggggtactactggctggtagtatcccatattatcctaaaattgatgattggccctgggcactgcatgtttaacagctttaactaactctgctcatgataaaataagccaacccatcctgttgcaatcccggcgcgcatagagagtagaagtactaccacttgtagtactagcgatgcaagcgacggagggatcggcgctacggagcgggaatacctccgtcctctccaaggcacttttgtaccgaggacacacaacaccgaacgacgcgtcgtttctctctcattgtccaaccgcccgatagaaggatatctctcttcgtgagttagtgtggtcacccaaacagaccatgtccggaatcgtatcgggaggagctacgcttcttacagccatcctttcatatgactccccgaaaatctccttaggcactatatggttccaaattccgctgctcttgctgcttacctgggtgacatggaggcggcttgtgtggcccaatttcttttctccgctacgacatctaccatcgcctcacaacaggggctggggaatgaaccaacgtctccgagtttataccgagccccgcggaatgcctcaatgtgattggtaatataactccttcctcctcttcccaccccgcactttctagctgcatcctgggatgtgctaatatctaacaagtcgtgcagggtcaatagcattccgaacaatggtttgatacggtacaggaccttactcaactccgaccggctgttggtgacttcgcctgaggccctagcggaggttctgacgaccaaatgctacgacttcaagaagcccaaatggcttgctaacgaactgaaaaaggtactcggtgtggggctcttgttggcggaaggagacgagcatcgagcccaaaggaagatccttgcgcccgctttctcttttcgtcacatcaaaaacttgtatggggtgttctgggataaatcatgcgaggtggtcactgccatgaccgaccagctgtcttgcaaagaagggccgaaaacctacggtccgcgtgagagctccattgtgaatactggcgttcttgatattgcggagtggtcccatcgagcaactcttgacatgattgggatcgcaggtatgggccgagatttcggagcagttcacaaccccaacgcggacctggtccgggcttatgcattagtctttcagccttccaagcaagatattatgctggctgtgttacggctccttctacccaattggatggtggattggctaccactgaggcgcaacgaggagatccgttgtgcggtccagagaatccgcggagagtgcgccgacctgatccgccaaaaatccaagcatcaacgcaaatatcacacctcacagcatcgagatatactcgacgttgcactctcgtatggagggtttagcgacactcttctcattgatcagctgatgaccttcttggctgcggggcacgaaaccactgcgacggccataacctgggctgtgtacttgctttgtgtccaccccgaggtgcagacagccctccggagcgaaatacgcgagaaactccctagccccgaggactctgggagcaacctcaccagcgacaatattgatacaatgacctacttgaatgctgtgtgtgatgaagtccttcgctacgctgctccggtgcctcttacgtttcgcgaagcggtcattgatacgaatatcctaggccagccagtcccaaagggaaccaaaattatactggttcctcgggctaccaatcgggatgccaatctctggggcccagacgcgcagcagttcaaacccgaccgatggttagaaggtggtatcagaagcaattacgctacattaacctttctccatggtcctcgaagctgtatcgggcgatctttcgcaaaggctgagttttccatcttgctggctgccttagtgggacggtttaaattccaattggaggatgaccagcttctggacgagaaacgcatgaaggtcacccgcacagtaactgccaggccggccaatgggctccttgtcaaagtcacctctctggcaggctggtagtagcgacatggctaatggacgattgcggtaaatgcattgtcgggatgggttaagtgcttacgcacgcacaacacccttcttggactggccacccctgcttgtctcatactagtgcttacagaagtgtggatagcgctgccgttcagaaacagatagccttgtacaattacccttattggtgggtggcatgctagctgcggatcaggaaggctcgacccgacgcacgcggtattactactaatggtgctttgtactaatttctcctttctaccttgccatgataggtggttcctggctcctcctttgatccgaatgctggccccactccttctggactggtctttccccaaaaacagaacgggggtgtctgttcaagatcagcctgtcaaatgaccgaccgatcacaaccggtatctacggaatagccaagtaccccagtagttattccttactagttggttgacgatgcggcttacactcatcactggttgacaccactggctgactacgtaagtacatgcttgttagctacttagtgcgtgtttgcgaggtacaacggaaaaagcggcatccggcccatccatcgtcggttgttctccctggtcgcagcaacaactgctgcctatgatgccatgccacgctttgagtgtcatggtgaccgtctcgcatgttgagctagtagggagtacaacctctcccactccatcgcctcaggttgggtagtactgcaccgcagaagcgactgtagagaccaggcagggtctgtgatctgaagcatacctctcgattttcttcctgtcccattgccttggccattgcagggcaatcagcctctcagtgtcatggaattctcgcggtgtgttgacgactcctctttcgggccggtagttaatcgatgtcgagataattttgatttcacgctgaagtttgaactgctgttcttctccatcattcctgcgtcgattttcataggtctctcaatcccacgacttgcttacctggccccgaagcgtgttctggtaacaggaagctggtttcttgccatcaagctggtcagtgcccaatctaccggcttgccgtattctctgatgttcacaaatctcatgtgcacaggctgtcattgtctcatacgtcgctcttcatgtttcccttctgattttcagcatcgacttgggtcgttctcggctgtcaagtctcttcatctcgtcagaggccctcaccctgggtgccgctgcctgcatcgccaccctttcctatctcgagcactaccgatcgccgcgcccttccatcctactgaacgcgtatctctgcatttgcattctcctgcacatcgcacaatgtcgaacattgtggctctctgcttcatcgaagcaagatgccatcttcaccaagatattcactgtggcggtctcgatagaagctgccatgtttgtcctagaatcccgtcagaagacctgctggctagcaaaagacaccaaaggatgcggacctgaggagaccagtggactctacagtctcagcacgtttacgtggctcaaccaattgttctgggctggctacaagaaagtgcttggtcttgacgatctcttaccactagataaggaaatggatgtgagacgtctgcacgcgcggtttatgaagcacgcaggagaaacgttgcacggtcaaaagcatggcctggtaatcgtcttaacaaagaccttactagttcccctcctcctcccgattgggcccagacttgcagtgacggggtttaccttttgccaggccttccttatccagtcagttctccactttctcgaggacaagccagaagaatcccaaaacctagggtatggactcatcggtgctacaatcttaatatattctgggatagcgatagccacatcctggtattggtactgccacgagcgatgtctctacatggcgcgcgcctgtctcggctcggctatctttcagaagacgacagaatctcggttagaagtggctggaaagtcgagtgcaatcactctcatgagtacagacattgaacggattctcaagggtttcctaaacctccatgagttttgggccaacctggttgaagtggcactcgccagctggttgcttgagcgagaattaggagttgcattcgtcgccccaatctgtcttgttgttgtctcggtcgtatctattaccttacttggacggttcataggaggtcgtcaaagagcatggatggagcaaattcaaaagcgcgtggcgctcacagcaacggtaatcgcatctatgaagcacctaaagatcgccgggctcgtcgatcctgtagaagctgcggtccaaaaactgcgccttcacgaactacacgttggcaggggatttaggcgacttcaaatcggggcgttattcctcgctttcttgcccaaccttcttgctcctcccataactctagctgctaccgggcttaatctaagcactcttacgattttcacgtccatcgcctatctcacgcttttgacaatcccgttaagtgatgtcttccgatcggtggcaccgctcatgtcggcactgacctgccttgggcgtattcaggccttcctagaagacaaatcacacctcgactttcggatattgactaagaggcctgatcttacaaagcctgctaggccggcatcgccaagtggccccattcttgaaatcatagatggcgagttcgggtggcaggaggaccaggaaagcacggttaagaatatcaacatgagggtccatcgagccagtctcaccgtggttgtcggaccggtcgcctccggaaagtcaacgctgtgtaaaggtctgttgggggaaactcctgtagctcggggtcaggtactgatagatactcttgagggtggcatcggatactgtgaccagaccccctttctgttcaataaaaccgtcagagaaaatattgtgggcttctcgccatatgaccccacacggtatgcagaagttattgaagtctgtcttctggctcacgatatgtccttgttgcccagtggtgatgatacggtggtgggtagccagggcatcagcatgagcggtgggcagaagttacgggtgtctcttgcccgagctctgtatgcgccgagcagcttattgatacttgacgacatcttcagtggcctcgacgctgataccgaagagcagatattttatcgagtgtttggctctcatgggctcttgagacgcagagggacagcagcaatcttgtgcactcactctgttcgaccacttccctcggcggatcagatcatcgctctggatgaaaatggcagaccggtcaatggcaaaagcttacaatcactcgataccaatgatttggaccggatccgagagcttgtagcgcgggactccgcgaagattaactcgaagtcgataccacatgccaatatggcaatccccaaaccgcttcagagtcttcggacccaggtcgctgctcagaagagtgttggcgacctggcgcggaaaaatggcgacatcaaagtgtacagtcattatttcagaaacgttcccgtaatccccttatttgccttccttctagcgagtgtggcatatggagggttttacaattttcccacaatttggcttcagtactggtccgacgacatcgctttagcgcaccccaggcattccaagggtttctgggtaggactgtacgctatgtttgaggtgttagctctgttcggttcaacaaccgccacgctgttgggactgaactatatggctattcgatcgggggctgctttgcatctgtcgacgctgcgcgtggtgaccagagcccccttggcatttttcgcgaagactgatctaggcatgatcacaaatcatttctcacaagatatgactttgatagatggtgagctgccaggctccattattaatttcttcaccgatgttgctgtggtcatcggtatggcatgtatcctggcggttacatcgccatacataataatttcataccccttcgtcgccatggtactctatatggtgcaacgtttctatttgagcacctcacgccaaattcgtctactggacctcgaggctaagagtccactttagtacgtattctctcccatccccgttcagattaagggatactgatcatctgccgatttcttcgctatcagtgcgcatttccttgacaccggtaggggtattgcaaccatacgcgcatttgggtggacggatgagcagatccgaatcaaccaggagctattgaacacttcgcaacgccctacctatcttcttgcgatgatacagcgctggttgttgtttatccttaacatttttgttctagtattcgcagttctcgccgttgcactctcaacccaattgcatgataacacaggattcacagggtcgggcttgctcacactcatgcagctcgggcagttcatgacttcgatggttcaatgctatgcgaagttggagacgtccatgggggctgtgagtcggctcaaggcatttcgcgacaatacaccgtccgagatcacggacactgacaacattacaccatcaccatcctggccctctaagggtcgagttgaggtgcatggagtatctgcttcttaccagtaggtccttggtcaataatgaaaaataatttagtactcttgaaacaaattgacttctaacgatgcgatctacgctttgcgcaggacttctgagagcgcgccccataacctagccttgcatgagcttaaccttgctattgagccgggagaaagagtggctatatgtggccgtactggaaggtgtgcaccgagacgattgaacttcagataattgtacgctaacaaaggatgaatatagcggcaagtcatcaatccttcttcttcttctccgcttgctggacccccttccatcttcggcgcagaacatcaccatcgacggcgtaccgttgcaccaggtcgatcgctcaattctccgccagcgtatcattgccatacctcaggacgtgatattccttcccgacggtacctctttcaaagaaaatctcgatcccttcggcctgtgctcggaggtcgaatgccagtccatcctacaggatcttgacttgtggtccttggttgaaaaacagggcggcctgcaggcgggactaactcccactaatctcagccagggtcagaagcaactgttcagcattgctcgtgcggtcttgaggaggcgggcgcgctcacggcagcaggctgaaacgggtctgcacacaaccgtgcgcaaatcaggagttcgagagtcaggaggggggatactgctgctagatgaagtgagctctagtgttgatatggagacggaccgggcattgcggaaggttattgatagggaatttgccggatataccattatcatgatctcacatcgtctggaggtcgtcttggactttgaccgcgtccttgtgctggactcgggccatctagttgaggaggggaagccgaaagacctggctcgaaaggaaaacagccgctttcgcgagctgttggtggcagcgagtcaggatggcgtgtgatatattttcaacctgggccttgaaagtggcttcatgcatggtaggtatccaagtagcttcagactatgtagtgggaagcaagctagctagttgtatggttagaccaaagccgtggtcaactcacggaggacacttccataccggtccgccttacgtagcatttatttagctgaggggcacccctcattctacaatatctcttcttccgtcatattgaactactccttaatattatgttatgttttagtgtaagtattatcccgttctaatattccattgtataactcttcccgtcactcgtatggtactgcatatgtgatactccatgttaggactatttctggtagtaaccctgcagattctcaataagtacaaagtgcaggacttgagtaaacggaaggcgcggaataacagtcacgatcttcatggctgcgactctcacggggccttcatttccagataagcatccccttctgccatcgtaatctgagagataaatttcttcttcaacgcctcaatcaccaatcttcctaaactagcaatggaccccgcattcaagatttccaatgtgctgatctcaatgccgcctaaacttctcttcatccagttccggatctcaattgtaaccagggaatcgacacccaaagcggttagcgatacattcacgtccaggtcatccaatggctgtagcatgaaggtgtatattttgacagccatttcccgcgtcaccacttccagtgacgcagggtcctttagcacaacctccggatcagcttccacggatgccataaatgccttgagcgcatccgcttgactaccgttactaccattgctgctgctggatgactcggtgtctcggttgtggtatagtcccatgcgagcatcctttctccatatgacccggttcgttgggtcagagagtcgcttgtcgcaccggagcccgatggtcaattgggtctcgtcgctgtctgcagtcgcactgcttatggtggcctttacaatagcccactgaagagaatccaagaggtccttttctcggagaaagtacccgcctgcagcgcgaagggcctcggcctttcccacattctgagtcagataccccacgtcgtccatgaggccgatgtgcaagattgaggtgggcaggcccagacttctccggtattgtgtgaaggcgttgaggaatgtgttgcctgcagcgtagttggcttgaccgggagttccaaaggacccgctgatggatccggttgcgaagaagaagtctaggtcgcttggcatcgcgtggtgtaggttccacgttccttgcactttgggcccgactgcggtggtccagtcttggaggtccatttccatgaatggcttgtctcggagtaccattgacatttggaagacccccttgattggtttttctgcagcttgggtgatgcgagccacgtccttttcattcaagacgctcccttgaatagctctcacactgcatccttgcgattctagttcctggatgaaccgtcggtcctgttccgagtttccggctgatcgggagaagaagacaaggtgcctagctcctttctcgactaaccacgttgctactgctcggcccagaccgcccattcctcccacgagtaggtatgatgcgttggccttcatggttaaatctgggataattggagcgattggcagttcccggcctccttcaggaatagtcacgacgatctttcccatgtgtgtccctttctgcatgtaacggaaactgtcttcaatatgaccagcagagaaggttgtcctaggtgcgatgggtttgatatgtccggcctcgagcatttgcaccgtacgagtgagtagactgggatcattaggtcgggtcaggacagtggttcctaaaacacaaaagaccttggggtacacgaaagaataggacttacgggtgacatctcgcagcgtcgaatctggcgagatcgataccgataaagcttctgttcgcttcaaagatgtccatgctcaacttagcttttccaataaagtctcttttgccgatctcgagcatcttgccgtacggagctacacattcccaggatgcatgaagaagctcacccgacaagctgttgagcacgagatcgacgccgcgtccattagtgtgggcaagcacgtcctctcggaaggaggtgtcacgggaattaaagatgctggcacgcggaatgttgaaggtctccatgagatatcgaactttatcctgatttccgactgttacatatacctgcacaaaatggtcaggcattagttcgccacgtgagtccagccatgtcattgaaaacaaatgcttacctgaaccccaccaatactttggcagacattgatggctgcaattccaatacctccacatgctgagtgtatcaaaaccgactggccgctctgcaagccaccgatgtccacaagcgaatgaatgacagtagcgtaaacacatggcatcgtggccgcttcttcgtatgagaggaacgatgggatcttcgcacatctcatagccgacatggtgatccgagtagagaagcagttatcatcgaggtaaaagactcgatcgcccacctggagatcagtcactccggcacctacgtctgtgatcacgcccgatccctcgagtccaatgccaaggttgttagcttccacaatccccatagcgagaagcacatcctagaatcccaagatttgtcagtaattacgagaaattgaaatcacgggaagagcggtggcgcttactctaaaatttaggcctgcacaacgaggctcaacgacaacttccccatggcgaggttcggttgtggggaaaggaatccactgcagtgactgtagcagacctggacgaccaatcgccagtctgacagcgccaggctttgacgccataagttccaggtcctgtgccaccgaggctggctgatatcggccaacatggaccactccgttacggaggatgaactcggaatctgcatccactgatgccgtcgagtcatgcgattggattttgcccaatacacgcacgatagccggataaacctggtcatcgacgcggtcgacttccagggtcataaaagagaggaactgttccgatcgcaatgttcgagcgagccctagggtcagaccgaaccccggagtagaactcacatccttttgggccggccgagtgacccatagtattttgctatctcctcgactggcaataagatcctgaaaggccaataggacttcatgagatacgctttcaaagaggggactttcgagctccagcactgagacaatgtcttgatcggctggtgctccctcttgaagggttctcaagtcgacctgataaccattatcgataagagacttctggaggcggtcaacgttagttgtaggtacgttgccaacactgtgaagaagagtaacacgacgaggtcccagaatggactcccgtacaggtcgggagataatattggcgttgatgtggtatgggcgagggccatcatagatcgccgcctcaaccccagagaaaccggccattttcaatgccttgttccattcttctggtgtcaaaaacggctcattgactctaccgtcagtttcgcccagccaccatcccggaagaatccccataatcctattttcgctgaattagctttcactgggataggagtagctgggaacatagcacacttacaggttcaccatttgcagctggggcgataattcctggagaaacagatagccctcaggtgccagcagcttacgcacgttcgccagagttgcattaatactgggagttgcatgcaagacgttgcctgcgatgatcaaatcgtacgattctgcctggaacccttgctcgatcgggtcctttgtaatgtcgagtaccttatactcgatcccttcgtattccttaaacctctcctgcgctgggacaaagaacccagcagagatatcagtaaaagcgtacttcgagtacatacgctcacgtcttggggtggacgaggtggttaggccccgcaggacaactgctgtgccccctccagtgccagccccgatttccaacactctcaacgtgggcttggtatgacctgcaacagcgaagaaatcaacagagtcagttcgtgactcgacaaaattgtagtagttggtcagtccatcgcgagcttgcagtacttcgattccctccacctttccctgcataatagcagagcagttatccactatcctggatataagctcagctgcgcttgcggcatcagtgtgcgataacaactgtttcagcttgaatatcaacgcaagcctaatatcagaatccagggatagcaaatccttagcattcggaaccaagtcgtagctattgctcgaggctcgacttgtttgccgatgcatccacgagcgatatttttcaagatgctcaatatcacagactagatgagatgtctgaacgttcacttcaatgagactgagtagggccatcttctcgacgagctcgagctcaagagaatcaatatgcgagctatcgctggcctttatcaaagtcctcatgtcggctaggtcgagatctggtttccagtgtaactttgctgcgccaatagggtcaagatcatcggctgtatccacctcgaggggagaaaacttccctccgactagggacaagaaaactcccttatcggacttggctactactcttccggaaagaacgccagcagaactgatggtggcaacggcctccgcgactgcatcattgtcactcctgccgccgcagaggtagagctgttcgatttttgtcggaacacacaaacgggttacacgccggtaaatcccatcacagctagctgggaacaacagctgcaggcagtgatcaatggtcgtagggtgaacagcgtaggtggactcggaaaccgcggttggcagcaacctggcagaggctgtggttcttgttcggcagacaagagacgtgggataatccgcggaagcatggcccatagttgagaccaactttcgtcagtatgggatataaattctcggttgaacggggatggctgggacacggcaagggagacgaagaatgtgtagcccccgtcctgatctgtcccacgcaatgtttaacccaggcagtcttattgtatgagaatatactaaactcccaccagacagagtccagggtagttgtcaacctgaccggacgaagactagtgatcatctcaatcgcctttgactcggtcaataccaatgctgtgtgcaccacgacatcccggaaggtagattcatgggcagatgatatctgtcggatggcctcgcctgccattccaaggtaccctgcgcaggggaatatgatatcgttgatgacttgatgatcccgaagccatggtacatcttctaggcgaaggacgtttcgccattcgggctgcagatcattcccctccagtattctagatcccaatagttcatgatgagggaactcgcggaacctccagtttttgctcaatctgctttcggcccagtactcatgaacgtgctgccatttgtatgatggaagattggtcagcaggcacccactcgggcaaatatgtccgaaatccactggtgtattgttcaagtaaagctccccagccatatgcaggatggattcggtgcagtccttgccacggatcatggctgtgatgtagctgtcgttggaccgattagcagcctgcaatatttgacggagcggtcctcttaaggcaccatgtgggccgacttcgagaaaggtgtgctcagaacatgcttcactctctaccaaatgacttacggcaccgtaaaagagtacggggctttcgagattttctcgccaatagcttgcgttcagacaccccgcgccatttatcctcgttgcgcggacgctcgagaagaagggcactacgggagctttgctgtcaatgcgatcacgtagtaggtcctcgaggaagtcgccaatgtcaagcatatggtctgtgggtgaaaagtcagtataccataatctcaaacaaacttagtgaactggactgaggtcacatacgagaatggtaggccatctcgacctttagccttcgaaccaagcaccccggttcctcagtccgaatgatttcacaggtcttctcgagagcttcgagatctcctgacaatgttacactatgcggactgttctcgcaggctatcaatgtcccctgtctcaaatatcgtgtcacttgctcacggcctaggccgatggcagccattccaccaggccgttgatatcctttcgtcacgtacccgcggtagtaagcaattgtgattgcttcctcggccgtgattgcttttgcagcatatgccgctgcaatctctccgcttgagtgacccacaaccgcgttcggccggatgccccattgaccgaggaggttcaccaaagccacctgaacagccgccactaagggttgagaatactctgctttgggcaggttgctatcttcttccggtttgcgcagttcatctctgagatcccacgagggggcatgctctagcttcgctagcacggcgcctaggtaaattatgtccttgtcaaaggaagggtagtcatccatcagctccttggccattcctgcccattgtgccccttgtccagtgaataccatcgttattggtgatgttctcttcgccttcgttacaggcgagaacgtgaggggtccatctgaggaactggtaacacaataagcccggttcgccaagtgctctcgtcgattgcacaaagtgtaggatatatcagccatcaaagaaggattttctctgatgtatcgttcatgctcgactaagctttcttttagggatgccgggtgtgctgctgagaatacatggatgaatcttctagaactaggaggacgcaccagtctgcaggggtcgtccgtgtccttgggatgagttgtgtgatcgtttgtatgaccgtttgtataacgatcattcaaggcgccggccacatactcgctactagcggtggcagctacagtcgcttgcagagacatcagagcaacactctcgaggatggcgtgtgcatttgcgccgccaatgccgaatgaatttacactcactcttagcggtttaccggatggccacgtcattgggtcaattggaacctccatgcttgcctcctggaatgggatctttgggttcggagtcgagaagtttatattcggagggatggtcatgttctccaatgccaacacggccttaatgacggaggagactccggaagcgccctcgctatgacccaggttcggcttgacacttccaatatataccgggtcattattccctccaaatactcgtgcaattgccgtagcctcgagggggtcaccgacgggcgtgcctgtgccgtgtgcttcgacaaacacggtctccctggggtcaagcgacgcctctcgatatgctcgacggatcaatgcttcatggccttcagagctgggcattgacatacccggcgtctttccatcacaattagtcgcagtagctctgatcacggcgcggattttgtcgttgtcttttattgcctcagaaagggacttaatgtagatggcgttaatggcttcgcccctggcgtaaccgtttgctgccgcgtcaaatgtcttgcaagaaccttccggagatagcaccccttgctctgtcatagcgatggacattgtaggtgagaaaatgagatttgtgcctgcaacaagtgctcctgaacagtcacctgcacgaatggctcgaacagcgtcatgcaaggcgatcaaagacgatgagcacccggcctttatggtgaaggaggggcctctcaagtcgtattcgtagctaatgcggttcgagatggcaaagtcatgtccaccagggatccgatacatgcctgcatcctgagtatctttcgcatggaggtccaaccaatcctgacagcggataggtttcagcgtcagctcttgatcttcataaccttgtccttatcaacttacttcaccccagactccaacgtagcagccgatcttgctgccgcgccagcccacttgacctgaagattgcatgcattcgtatacgacttcaagtaacatacgttgctgtggatcgatgtcatctacctccttccggcccatcgagaagaaagatgtatccagatgtctgaaattatctgtctctgtcagaaaatggccatgtttcattgctatcgatccagcccggcctgtgggactgtagaacccgtccacgttgaaccgactcttggggatctcgccccgcgtggatcgcttctccgtaatgagttcccagagctgctgttctgtgtggatattccccggcagcctcacgcccatgccaacaatcgctatgggctccaaagaatcaacttcctcgggggttcccggctgactcgagcgctccacagaggagatctcccagggagacgagtcttgactatccatggtgagcaggcgagcgatagagacgtgtaacgcgataattgattaatatgtgaaaagtgccgacgacaatgagcagcgcaacaagatattttgtcatggtcatgaggtataatggcgatatatgatatgtggcacggacggtacgttagagccagacgcatcagtcggtcacctgtgcaggtcggtactaccgatgtggtccatgtacacaggtcaaccgattagccgccagatccgccagagaacggaagcccatgccttcgaaggtgtcatggtttcgctgccaggtttcgatggggtttcggttgcccttcttggattgccgatccggaatgcaaatccgaaaagtccatgtcggcttccgttccacttggggcgaacgcacactatcccacttccgatagcctgggagaagtcgtctgcggggtatcatccttgtttaaacttgctgggttacccgtgtgaattatagtttgatttccagcagtatggtattgtagggtttagccggttttggtgttggcttccattggggatgtaggacgattggtttatccacgccgtggcacattagcggcccacatttcgctcactgttcccaaccctagtggagacgagtatctattccgtgccagctagtctgatagcaaagagtcctctttatcgatcatttgccattcaaactcatcattcattagagccaacttatccatcccgagcaccttctccatttctgagcaattagcggctttattgaattcagcggccgccctggaagttgttatgggactgagataggggaagaacacatggcgcgccatcgtcgagcagagtgtaaatatcccatctgcatgtattaacagctacccaacccagtttcagctttctggagccattccctcagtgccagatagtctgttttagacctcgcttcctaatgttatttgtgatcattactgccaattctttctgttagtatctcagcgtatgcatatgccatcttcatccttgcaagctaattggacttttccacgccgtcgccgaggattaaaccggtctcaattgaattcacttcgtagagttagaagcgcaactgtttgagctggagaatttttgactcctgattgtccttgatttgctgcagactagatccatgggtcatgcatatttactcctgacagagcttgcatggtagtttgtgatctagctggtaagacggggctaacaatcgttctggttcgattgaagatagtttcccttctatgtgattttatcaggattgaatttattggtgtacgagtactgaccgtcacccagctgaggagttcgggccggccgaaaagagcgatgaggttgcctatatccttagtggtgccgctacgagataaaatggaaggacccattataaatcaattgatcactttcatttattcactttcattatttatatgataatcggtggagggcgcactccatatagagaatagttagggcaaatgagtcagggcgggtccagtgcggggactccgcaatgggttccaaaattatatgcttctcggcgtcgccatctccaaatttttcgcacactaccgccatgtcgacgaccaccactgctgtcaccagtgaggtcagctcactacgcctctccgccgaggaagtccgacttccagctcctcgcgatgaccgaaagtcgcgcttgcaacaagtcgtcgtgatcacccagctgtttgccgtcactctcacagccagcgtaatcaatggcttggtggtagtcggactccccaccatcactgcagacctccagctgcctccttcgctttccctctggccctcctcggtatgcagtctcgccacggcctctacacttcttctatccggctcaattgccgacaccatcggccctcgatgggtggaactggtgggatctctcgccagcggtgcattgatgctcggacagggcctatcgcaaactggcattgagctggtcatcatgcgagccttccaaggtgtgggcctctcaatgcaccttgcatcatcggtgtccatcgtcacccagcttttacctcctggaaaaggccgtaacctggcattctcctgcataggcctgagccagccattgggcttctcactgggtctagtagtaggcggcatcctgatcgacactatcggctggcgcgcaggctggtacatcgccggaggaatcactctcttcttcaccgtcatcggactgtggtcattaccaaagagccctgtccagcgagatggacacatcctccgcaatgtgcggaccaagatcgactgggtgggagctggactagcttcagcattcatggccttgctctgctacttgctcgcgtgagtatgccctaaaaacctcaaaacacaacactataccccaatctaacccatataccccaacacagtatcctcagcgcaaacccctcccgcatccgctccgcagaaagcatcatcatcctctgcgtcgccgccatcgccctccccaccttcatcacctgggtgcacttccaagtaaagcgcggcaaaccagcattgatccccaacgcactatggaagaacacctctttctcgagcatctgcgccacagtggccctctccaacgcagtaatcaactccatggaactcttcgccagtctattgtacgtcccccaacccccaaccccctaccccacacacccattcccgaaaacccactaacaaatccaccctcaaaccagcttccaagaaatccaatccctcagcgccctcggcgcctccatccgcatcctccccagcctaatcgtcggagtcctaatcaacctcgtaatcggcttcttcgtgcaccgcatccccgcctactggatcgtaaccatcacctccttcttctgcgccctctccccgctcctcatggccgtcatcgacccaacccagacatactgggcgaatgccttcgtcgcgcagctcctgcagcccatcagcgcggacgcgctcttcacggtggggttgatcgtcatcacgaatgtgtttccggatgatacgcaggcgttggcgggagcggtgtttaatacctcggcgcagtttgggagtgcattgggcatggcggtgttgcaggtgatttcgacggtggtgagtgaagagagggaaaagggtggggagggagagaagaaggcgttgatggagggatatcgggcgagtttttggaccatgtttgggttgatggtggtttgtacggcggttgggttttgggggttgaggaggtctgggagggtggggttgaagagggattagtttattggtgcagtttctaggtatgttgtttgttatctgggtgtaaattatagattgtggactttgctttggggtgttggattgggaaaagtgtctttattgcttcttctttagactgggatgttcttgttcttagggttactgtggatctgcaggaaatggcttgcagagatgaaaatgatagactatgacagttatgattaagcgattggaaaacatactcacactaatattacgcgaagtctttctatcttacaaaagttgaattacttgtgattaaaactctgacattcttgtctcacatgagaaaatgttcatcagaattcctttacccccttcgatccctcaaactttccacaacagtctttggaacctccatatcactcagcaccacccaccccaagcgactcaaccgcctgcctcgtcaacccctcaaacgtcatctctggcgcagtgaatgcatgaaaactcaacgtcagcccaaactctccgaaaagccactgctgcaactccgacccaatcatactatccagtccatacgaggcaacagtccctttactaaatttgatctcgtcagtgtccctacccagcatactggcacattttttcacaatccggtcaccaacgcgggccatcaacgtctcatgatcaagctcttcaccgtcaccaagaacatccccatctggtttcgaagctctcaaggagtcctgcaaaaggtccaagtctcgctgcacgccgcggagacgagcatcaccgtgccagaatagacggttcgtgccagcggaacggtgcagcagggaagggtcaagccctagcacgagatgggtgggactgttcggggacatggcgatttcgagaccctcgagcatctctatctcgtcaattccgtaaaagcctagtcgctggagggagtcctcgacgttttggttttctgccactactccgacgtcgagcagcatgggtagcgctatggagcaggcgggtagaccgagggactgacggtatactgcgaatgcgtcaaggaagctgttgccagcactgtagttcgtctggccaggtgtgcctattgtacccgagatcgaactggtcatgacgaaaaagtctagcggggcgttgattaggacggaatggagaatttgtgctatgcggatcttgggagtaacggcagcttggtattgtgctgctgtcatgccctgtagcaggccgtcctaatagcggattagctcacgttgtatattgaagttgataactactgggcttgttttacctgcagcaccattgcagcatgcaccacaccacgaatcagtcgttctttcattactcgcgcgataatagctctcatatcggactcattgccagcatcagcccgaaatacatgcaccgatgcgccagcctttttggcaagttcaacggtctgggctgcctttggccgcgttgcgcctgagcgtgacacgaagacaaaatgtcgacatccttgctcggccatccagcggaccagactgcttccaaggccgccgagccctccaatgagtaggtatgctgcatcggagtagaattgaacccgccggttcgaaggtagtatctgctgttattagagcttttgtcacgcgcggctgaggaaagttgtcacataccttcacagaactttcaccgtatctgaattgcactgccgcatttaccttttcgtttgaatctgaggatcgattcgactggtggttaataggctgcgcgggcaattgatctatgctgtacactggcacatgggacgtccagatgtccttgttcctcttcaaaaactccagcccatcctgtaggatttcagccgccatctctggtcgtgtacagagggattcatagcccataggcagaaaagaagcacccttgctgaaaggtcgtgggtccagtgtcccttctatctccccattgcataagagaaaccgaccggccgctgatatgtgtctccatgcctcttggccagctgccgagaaccgattgcttatcaccagtgaaatttctccagacgtagcttcgaggactggcaacatatgagatgtatacaattcctcaacaacaacagtcggaataccagacgatgaggcttcatataattcgtcactctcttcttgtgtttctacaacgacagtgatccgggcattcaattccttactgaagttgattgccaactgcacaaataataagggcatatgtaaaagcagaatatgatcgttctcatgggctcttcctagccagctcatgcagagaaggactttgcatacggttggaagggtagcacaaaggaacgctgggtcgagaccctcacattcgaaacaagcacctttctttgcctttacaatggcttgatagccattctgtgcggcgagcgtgaccatctggccaactgtatcttcacaatggttggggattgcgtggccgacaacgatgaccggttgcttcgtgcgttggttaggactccaactctggtattctgtcatctccacttggagacatatttcgtccccctcggcgtcaatcatgtattcctcattttccctgaagaccaattcgctattcacaaactcgctctgtagcggtatgttcggtggtagtttcaccgtctcattatctttcggagatgtactggggcatgcccagggcatcaaccgattggtatgtagaattccttcatgaagccagaactctgtctcgtggccagagctccgaggtgctgcagctcccaggactgtcagcatagcctgtgcgatgctatgaggaggctcttcctgatcgatatccaatgataggatcttagccccaggattctcggatctgacaacccgcaagaatcctagactcagcccgccttcggccgtacggccttggttggtccccaaagtgagccagagaagcacattctcctcggagagaactagcttcttgagcaaatcaaattgtgtctccgagggatttgacagaatgcaaccatcaacgtcaagaataaccgtatgttggtttgattgatgattcgtctcgtgcagttttactacatcgacagatattttcaagacctgtagtgctttcatacactcgttcacgagatgttggttcgaactttctttgaccaccaaggtgaccgctgtcggctctgtttctcgattaatacaatgttctaactcctgggagagtagcagactagtctgtgagacagatagccctaaagctggcctggagatcatgggaggacagtccagacagctgctaattctcgatgtgttttcgtcctgcattaggagcattctaccggtgggcgtcaggatagactgtagttcttggataacgtccgaatttggctgacccttgaaaacgacaaggtcatgttcgccctccagagttgaagatagctgggataggtttggtgagagctggattaccgatatattctctggtagagtgaacactactttctttttcacatccccgtcggacatctcagcaatcgttaagttcgcaataacgggaacatggcgcgccacggcctctatcaaactataatcgtctcctgcagagacgaacgctctttgtatgggccgcttgtggttaaccaggccaattaattcgacgacagcctctccgagcgacttgtagggcaattttcccagagacttagatgcatagtcaatgtcaggttgccaccggtattgcatgtacttctggtccggaatgaccgccgtcgagcgagccgaccagctcatctcgtgctctttgaaccaaacccccttacattccaaattcgggagcccgttcgagctaaccagttgtatgtgtgaccggagaagggggctctggcactcgtccgtccacgcaaatccatttccttcagcctcttctggagaggcaatggttatctcttcgacccgcatcgggattgtgctgtacggcatgacattatatcgtcccttctcgaaggagataatggccagctggaaacaggcatcaatagtccctggatgcagaacatatcttgattcgccgtcgattgatccgctctcttgatccaaaccgatggtacttgctgctgtataatcccggccattggaactgacctctcctaagcgctgaaaagcgtgtccataaaagactccaacccgatcgaatgtcttataccatctgtcggggtgagtacgttgatgaagtttcttaatcacctgttgatggcactgtctggatacattgagctttgtcttgcgaggcgttatatggccactgcaatgggtggtccagttattgtccagaagagattcgacagtgaatgtaaaccagtcggatcccttattactttggcgcgacaatcgggtcaccacttcaattccattgtcggtatctggtatcacaagcccttgctggaattcaatgttcttcaagcacgtgccattgctcggactgaacagtgtatcactgatctgccttaaggcttcgattgctatagcaatgtacgctgcaccgggcaacaaaacctcgcttccaacctgccacttaagttagataagaagcaagaatcttaatgccttactcacgcgatggtctctcagccacggcacatctcggagccgtaaaatattcttccagacatagatcgtgtttgaaagccctgcaactcgtctgcctaacaggtcatgccgaggttctgattgttggcgctgctcctggcttagtcgtgtctctcgccagtactccttcgtatagttccattggtaagagggcaggtcaactagtagtcgtggacctggcttcttgcacaagtcgtgcataataccatgccagcgaacactgtagccggagaggaacaaacggccggcgactcgcagcaagtcattgcaagagtcagatcctctgataatagtcggaatgtatttgattctttgcgtcaggctattagccgatattatttgtttcagtggtccagaaagtgccgaatgaggtccaatctcgacaaagtgactcaactgcttcagttcttctatactcttgagctcggttatggctgcatgaaagcggaccctattgatgagatttttcacccaatacctggagttaatatcattctcgtaaacctgtctccccgtaacagaagatatcattgggacgcgggagagccgctctgagggagctgacgatccagcttcggaatctgcctctcgaaggagttgctcataaagaggagcaatggctttcattgcaggcgagtggtagggccttcctgtttttagcaccctcacaaaaacctcagaggcctcaagctgcaatctaagtttctcagttgaactctccgagccgctgagcgtcacgctctcgggggagttctcgcatgcgataacaacgtctgtatcacgaatgtaaggctcgatcctgtccatgccgactccgacagcaagcatcgagcctgcagggccttcttgtgcaactgcttggccgcgataaaaagaggtcgcaaaagcttcctgggctgatagcatacctgctgcatatgctgcagcaatctccccagaggaatgccccacaacagcagatggagtgattccccacttccttagctgatcaactatggcaatctggaatgctgtacacaatggctgtgcaatatccggctcggcaatgtgttctgagtcgatgtttccgactaaggcctcctcaatggtccatcttaccggcggctttaatgttcgtagatactgatccagggatctgatagttatcttgaacatggatagagtgtgcatagcgtctcttcccatgccaacccactgggcaccctgtcccgtgaagacgaaggcaaccggaccagaagattctgccactccaaattccatgctttgctcgctgaagctcggtgtttctttattttcacgagcaatggtgaaggctctatgggtaaagtgtgttcgacggcaattgagtgtgtaggccacatcttggaggtgatgattgtcgacaacacaagcgtgtgcctcgatattcttctccagtgtagctcgatcgtgtgctgtgaaacataccaaagccctgctagggcttgagctctcatgccctgtttgtactcttgtctgtccatggtcggactgcgctgcctccagtatcagatggccgttggtgccaccatatccgaaggacgataccccaacccgccgggtaagggggctcttcggccacaatatcgtatccacatttactttaacattccattcttcctccttgactagtaactgttagacttgactgtgcctactcatttgtaaaggtatggtgtacgaacgagccggattgagtgtcttgagccccgctactccagggatgacaccggattctaccatcagagccgccttgatcacagcaaatataccactggcagcttcactatggccaatattcgcttttatcttttaataaaatattatagtttcagtttttccgcatgccttagaaggatttgcaggagaaactcacagctcccagcagcagaggctgctcgcgactccgtctttcgttcattccgttcgaaatagctttgacttctatgggatcgccaactggtgtgccagtccctaagaaggtttcagcacctctttgcgttctgcaatccattactcgtgtttaccatggcattcaacataaactgtgtccgttggatctaagccggcccttttgtaagcagcacgaaggactctttcctgtccctctaggcttggatgggtaatcccttggttcgtcacttcgccgtttctatatcggtcagtcactcattacctgtcttggggccctgaactctctcacgtatttagcgctgagccacgaataacagcacgaatcggagtaccatcgcgaaccgcatcactgagcctgcgtagatagatggcgcctgctccttcggcacggccatatccgtctgctgcagcatcaaatgtgtgacaggtggacgttggtgataggattcccagcttagcggtattcatgtgttgatctactgaaatgattagattcacacctcccgcaattgcggcgtcgcattcgcctgtctgaagagccaggcatgcctggtggatagcagtcatagacgaagaacaagcgctattgatcacggcgctaggattgtctgtcaggtttgccacgatttagacgcatagtataatcatcactcaccttggcccacgcagatcgaagatgttacacactctcgcgctaagaagaccaggatcagttcctgtcgctgcatactcatggcgaaagtccggttcgcgatggagcatttgttggtaatctgatgtgaagcagcccacaaacaccccaatatctttcccggcaacatcttccaatctcaggccggcgttttcgagacattcatatgtaacttcgagtatgcgccgttgctgtggatccaaccacatggcctcaaccggcgtcataccgaaaaagctaggatcgaagtcatgaggactgccgtcaaggaagtaaccgccacgaacattgagactaccgggtctgttcaggtttttgtggtaaaacgcatcgatcttgaaccgactttcgggcacagttggtgtccggacggatgttttgttgaccagggcgtcccagagtctggaaggggacgtaatagatccgggaagacgacaggctatggataaatcagtatacgaaatattctgtgggggtgcatattcatacttacccatccctacaatggcaatcggctcgaaggagacatggtccccgggactgccatttgcagtcgaggagcccataactgagatatggatggaactcgctaatgtggtatggaagatgttgagataggctttcggtctgggtgtggtttcatcaagaattcttttgtgtgcagagtttctgaaaaacagggatgagaaacttatatccttcaaggcgagtcccgctctgccatcactcgcctcacacaggtactatggtgcagcgcacgactcaagctttaatgttcttcagtcaacggcccttactggggaaggtccaactctgagtttagtccacaacatccacattccgcaccttgccgtatcagtatccaccgttcctctctctcgcaggctggttggtttgatggatgacatgcgttcaatgaaagcgatagtttaacatgactcagtccaacagtaaaaaaagtttcatagttaactgccattgattaagtggtttcacaaggaaacagacgaggtacatacttttgaacgtcagcgtcctctgcagtagaaaagatggcgtagacgccggtcccttaggaatgatcatcgcgtatatgcgaaaagaaacaaggcacatccctagtttcgccactatataaggtgccataatccgactggtaggggtatcatttcccagtcacgctcatgggcttgatggattccttgagtatgtggcagggccttcgaataacgttggtgaatgaggctcacacttacttgaaatctggattcatgatactccttgcattcttcatgcacatggctactttaggcagttcagatccacgtggcagctgccctttcgaggtgcaattccacattgaggttgccaatgacaggcacttacagatctcaatggccaaataagtctttggacctcacacacagaaaggtcacagggggtgctgaaatgggacatggtccaatccgacggccaatatgctatgggttggcgggatgctcaagcatatcatcattgccgagaacataatatagagtgaatatgcaccagacccctttccgagctgtatacattttctagaggtgaccacctagttggtaggtgccattttcgttgtattgtcttgccggcgatgtccactgtgcctgataagtccctggttgttgatagcaaagaggaaatcttgaataacattttcaattcgaagcagctaagtggagattgactacatttggaggttcaacttcgattcttggcttctttcttgacatgctggtcacctgacactctgtctttttgcattgctttccttcttggccgcactttccatcttccgtactcatcttccggctgaaactctcagccccttgtttccatcaatagctacagacataggcacaacgatatagccaaggtgaaattcatgcggtagtcattacgttgactcgcatgaacacccagagaagcacatagaagaaagtaaactctggcagtcagtacctttgcagtcatcagcgcactaccttactaattatagttacgcctatcaccttgtccatccgtgtatttggtacatctatgtgacacaaaaaagaacgctgatatgcagcaagacgcacgattctctccaggaaccttgttaaatctggttgttgtagagcctcgtcagggaagcaccagaacggtgtttacattcgccaccttaacctgttatctagctgatattgttacacatgatacaccagacatggattcgcgtcccgcttagcagatgcagaagcttaaacagatctccacaattagtctcacgtgggaggacaatccctactacaggcatgctggttcaaggattaaccgtgtgacatcacatagaagccagtccgattggagaaccagaggtaaatgatgacgagcagaagacgactggttgtaagtatgctatcattatcatccaagcggacacgagatgagtgctgcaattgaacctaaacattaagtaccacgatcaatcggatcaaaccctagcaacatgacttcattcgatccttccaccaaaagtaccagccctatacgaacaatccatgcataaccggacgtcagcccacttcgtagtcacagtactataggatctgtggatatctacaatctcctaccgttatacacattagcatcctaacaatgtcaacgttctcgccaactgagataaccattaatcttgcgaccggtattcacctatatcagccagaataggagtttgaaatggctctaataatgttatatgcaatgtacgtttacacgaatatgctcccacaaaattacaactgcagtgggaatctaaatgatcgataggaataacgaaccagttatacaaatgggaatactcaccttcctccttctaatccctccatctcttccacaatcccagtataccaagttagcacctgcaatagtataatgaaacaacattccctaacttttgcatctccatcatgaaaccccaaatcacaaagcacattttagaccaactttcccccacaaaacgaacccgaagaaagaggcgtcaaactacacatacacacacatactacacacacatacaaccccccctccatgaaagtcaaccattccaacaagaacaacccacaatcaggtaccatcaccgcgcacaagcacaccaaacaaaccactacttactcttaaagaaacaatccacaataaccccaccacacccctccacaagcatcaaactgaatcccccctccccctgcactacattttcccggactcggtagatgtcaaaacacccccagcccgagctcacaattctgaccccgaaccgaggtgcatcatacacaacatcccattgcatgacaaaccaattccaaatccactagtatatgcagcataaacgaataaatgaaatgaatacccctcactaatcacaaaagtcgtataacacccctaatcgagcagacccctccgaaactaattcccgagcaacagaaacccgatgctactccgtactttccaagtgaggtgaatgacacccgggacgttccgagtagccaagccccaacccagcccgcttcgggaaccggaacggaaatgtaataaggattgtgtctaattgctcggctcgaaagcaagccactaccaccaccagttaattatccaacgctcggggatctcgtacacacgggatggatgggagttggatcggaaggttccgctgagatactcgggtggttttattggacgaggacccgagattacttagtactttgtactacaattactttacttacttacttaccctttttctgctcatttgtgaaggttcgttcggatgggaataatgacaaaggaaaattgagtttctcgagtccgaccgcacgcggcgacaatgtcgtcacgactcgctaccaaagtttttcgagaatggtacataattaggaaatgcttcgacggttaagtttttactactactcgtgacgaagtttattgggttactgggaacgatcattgggtgggtgggaaagaaaccggctgcaacattgcagggtcgtagtagattccatgtaaccaaaatcaaaatcagactcaaagcaaaagtctaaagtaacccgaacctatccaatccatctaaccagcccagtggaagagacatcattggtatgtgaaatgtgtatgtgaacatgagagggagagaaaaaaagaaagtgacgctgcatggccttgcattgcctagcatgcatgtgcacgttcgtcccatgggtaagaaagcaaaaaacccagtctaaaagagtctccaaaaaaaaaaaattccaaaacaaaatcagtcgactcgctgatggcgattttttgtggcccaggagcgacgatggatatcaatagtccaaacccgtaagccgtaacatgcaaagaaaatgtctaacatcgatcaagatgtgaacaaaatgggtgaaaaagaggtgtggggagaaaggaataagcaagcgccgatttttaatgcgtttactcgacagcagaggcaccgtcgccgtggaggacggggttgaccttggggttccacttgaacttgaagtcctggccgagctccttgcggacggcggccttgacagcctccaggacgttggggaagacaccgaagttggccgggttgttgtcgtcgttgtccttgccctggaagacaccggtgcgcaccagacaggtgttccagccgtgcatgttaccaccgcagatgtcggaggccgggttgtcaccgaccatgtagatgttctcgggcaggcggttctcgttgtggatctgctccatccaggccttcatgacctcatcggcgtaggtgtaagtggcgcgctcgggcttgccgtagacgacacgctccaggtcgacaccggtgagggccttgtactgagcctcaatggagatacggaagagaccctgggtcagacgggggggacccttgtggtcggtagggaagaccaggtcaccctgggagaagtagaccgggatgcgggaggcaacggggtccttggcgcgggtcagcaactttccgtcctcagccaggaggagatccatgatgagctgcatgtcagtggcgtagtcgcgggagtcggcgaacaccaggatagcatcgaacttgatcttagagaagtcgcggggcttggcctggagacggtcctcctcgtggaagcagccccagggggagatggtttggtcccaggcgaggatatccttgggatggatgacgttcttgaagccgtagttctcagcgaccttgcggatcttctggccctcaccaccgcagaccaggacggtttcgtagtactcggccaacgcctgcattggggtgtgagactggatgaactggtcggtggagatggggcagccaaggacctcggtgagctgggcgcagcgctcatcctcagtcttaccaccaccgttggtcaggagaatgtaagggatcttgatgcccagctcgttgtcaccgttgagcatggcgagggcctccttggcctcgggaatggcctcgttaccgtgggccaagacaccatcgatatcgaaagcgaaggccatgttcttggcagcagcaaccttctccttggacatgtcctggacctgagaggccaggatgtcgcgggaaacatccgcagtgaccaccgaggaaagacgggagacacggggagatctggggatgggcagggaagtgccgaaggagttgcgggaaccacgacggtcccgggaggagggagcaaagctcaggttgtgcatgtactgagcagcatcgctgatggagctgcgagtagcggggatctcaacggtgttgccagcatcgttagggatgggcagagagccagcagcgctaccacgagcatcccggggggagcgggcacccggggcaggggcagcgtccacggcaaagtcggcgtcgtcaaagcgaggcatgatgaatttctgggaagggattgaggttgtggaggttgttcaattaagagaaacaaaggtgggtgaggatataagaggagggagagggaggaagactaagataagataggataggatgatatcactcggagacgaaaacaggaagacaaccaacgggcgtcacctgcaggcaattgtcaccggaggaagatggaagaggaagatgatgtgaaagagaaggatgaagatggaaaagaaagagaagggaggcgaagaggaccatatataacaagctttcttcagcagagtacagtggcggtaaggtccagcggacgagggggagaaggcgtaccaccgacaaggaggtgtttatcctgggttgcagccatacggagacagcgcttcggccaaatcagccatctggatccaccgactgggttgggaggggcgtatcatcatccctaggaattctcgtcgtcattattttacggggaggtgattagctgcgacatttcgcagtttgctgaagggagcggagccaacaatggcagctcgatggatgcagtttagctgctcgtagcaagtaagaataactggactttacaaaaatgaagtccactacttttctaggcaaggttgtgggtggagctgtgtggtaatctttcaagactgtgaccgctggaccctggctggtggtaatttatgacatgctcaatactacgacatacgcagacacacacacacacacatataccaagacacataagacacacacgcacaaatgctcaatgccattcctgtgcaggtatccaagttactactttcgggacagattcgggggttttctgaggcattaaacatccatcccacaccaagtgtcccactcttcacaccacttttactgccggcgcagcatcgtggctgcagatggcagcctgaactgcccaccgcggcggggcgggagggcaactggggagtggcatcaccggattcttcgaaaggtgattggacaggctggaaatttgttcgcaggacgaaccacccaagaaggaagaagctgctgcaagttgagtggacaggagggggtgccagcgggactcttgatggggagtgattcgtcgctacgggcattccactcacgaacgagccacagatcgctggagccgatgacgatcgagcgggcggcggcgggtcaaacgctcgcgccgtttcgaaaccaatacacccagtgatgtcatgggctccatgttctcgtttttttggtaattgcaatttccccgtctggatggggaatcggaatgaattcaatggatccagaaaaaaaaaaaagtgggtttggtgtctcttcaggccaaaccaaaaacgtgcccatgccgtcatggatggaagcttcactgagtaaaaaaaaaatatgccaccaggagctcccccaagctcgagcttggaaataaaccaaaacaccaaggtcaagtgtggatgttcatccacaagatggctggttaaagtcaaaaaaaaaaaaaaaaaaagtacaagtgtacattcagcagcaaaccgaaagtcaaagaaatgaccctgcataatagaattagtagcaacagcatcatacccctcatcaacacaaccccctccaccccacttgctgttcttgcctgtaaagttgccttctcaacgagagcccctcctcgccgataccaccaagtgacttcttcccctcccacccgctatttgtactcatccctcggcttccttagctattcttcttcctcctcagttatacccaatcccttctatactccatcacatcgatacccctatacaaccatgtcttccggacagaccttcactctcagcaacggcgtcaagatccccggcgtcggcttcggtaccttcgccaacgagggtgccacgggtgagacctacaaggccgtcacctgcgctcttaacaccggataccgtcacctcgactgtgcctggtactacctgaacgagggtgaggttggtgacgccgtcaaggacttcctcgctgccaacccctccgtcaagcgtgaggacatcttcatctgcaccaaggtctggaaccacctccaccgccccgaggatgtgcagtggtccatcgagagctccctcaagaagctcaaggtcgactacatcgacctcttccttgttcactggcccattgctgccgagaaggagactcaggagaagcccaagattggccctgatggaaaggtaaatcttcactcaattctgtcgggtactaccggtcggagcacagctgactcgatactccgatagtacgtgatcctcaaggatctcactgagaacccggagcccacctggagggcaatggagaagatctacaaggagaaaaaggccaaggcgattggtgtctccaactggaccatcgagggtctggagaagcttctcaagtacgctgaggtcaagcctcacgttaaccagatcgagatccaccccttcctgcccaaccaggagctggtcgactactgcttcaagcacgacatcctgcccgaggcctactctcccctgggctcccagaaccaggtgcccacgacgggtgagaaggtcagcgagaaccagacgctgaacgagatcgccaagaagggcggctacaccctggcgcaggtgctcatcgcctggggtctgcgtcgtggctacgtggtgctccccaagagctccaacccggctcgtatcgagtccaacttcaagagcatccagctgacggatgaggagtacgaggccgtcaacaaggtggctgagggtcgtcacttccgcttcgtcaacatgaaggacacctttggctacgacgtgtggcccgaggagaccgccaagaacctttctgcttagatgatgatagagagcgatttttgatttatgcaggccataaaccagtaaaattggacaaaatgagcttatgagtggatggacctattgagatgaaatgtgtatctagcaatccaaagcaatagccagattacaccacaatacaatacgtatagaaagcaatccatgtatttcactttcattcctttaccccttagaatagacggaacaaaataaaaaaaataataataataaatagtcgaggataataagttaataataggaaaccacttctatccgccaatcccagccatcaaacatcgctcccaccaacagttcgcaaatgaaacctcaacccatccatgcatgcatgcatgtgcttgcgagccgaatcacaatcaataacctaagtggcttgatggagacgggacgggactaatcccagtaagttagttttacaaagtaggctacttactcggagggtcggaggactgtcctccatgcgttgacggggctagtgcgcaatgacgtcaccctcataatccgtacctaccacacacccttcaatccttttgaatatctaaaacaaaccacccataacatctgacaatgagcggcacacaggggctatgtggcaactttgacgagcgtctagaacgttcatcgaccacaccaagacagcatatatactaaatcctgttattatatgcaatgcttggtatagagacagatattctttcatcataacgtgcctggaatcaaacaaaacaattaaaacaaaaggaggggcgaaggaacatatggaacgggactctaaccgaaccaggctagtcatggtcgtatcggagaatctcggaatcgaggtaccgggttctcccccctcggtgggcaaatctggaagaagccctaaaacaccgagtggctggattgggaaagggggcttgcgtactgtgaatgttatgttgtcttagttggtgttagtttggctagtacggatttggttgggagtgggggggggtttactgccctagccctagtatttacttgggtgctggattgggactggttaggatagagaggggtagaaacccccatttactactgatttgttcatccagtcgggatggagaagatggatggagttatggatactaaagtacatttcattgggattgaatgtgacacggtggaagtatactcctcctagttacagtggttatctgggatactagttagtagtatctactatctacgtgtagtaagtacttagtatgtttgcgggattatttatgttggatgggatgatatggataatggtccacttggtatgtttctgaatacggaggatagtaacctatcgatagtatccataggtactacggagtagataggagtagtatcctcgctacctacttacttatccagtaggtagactagtagacaacagatatcattcgtctagaggaggagaaggagttcgtagtagtatctactaccattttacattggttatggttggttggtactggtgcctgattcccaccccggttaaacaaatcaatcagaagaacataacatatctgaaatttggatccatcaaccctgccacataccaaaatactaaactacataatatacaaagtagcttacttcaaagatagtcttagtatccgagtctacccgcgatatgcgccctgaattagggaagttcagcgaaggggaaaaaaagctaattgcatcctgggctgaactttgattttttggctttggatctgcgtggatttgcggtttgttggttcttagctttgtggtatacggagtgtaagcaaagtagactacgtacatagtagggtgggatggggatgagatgtggggtaattttttgagattgagggattaatggggagggagggagagagagcaattggggtagttcgtgtgatggtcaattggagatgagttgattgaggggagttattgtgtagtacagtactacttagtagtatgatgggtgatcgtcgacatgtgtttactgtgcaaaagtttaaaaacatgatggtggtagtcaaagctcactatagtttccccatgtggtgtgatggtatattctctccgcatctcaatgttgcaactattactactaagggaatagatattttccattaaactcggacgaaatatatcgctctgctttaccaaagccgttagatacccttgtactgtatcttcagatgagaagatcacctactcttttcaaggattgaacaccataggctcagcttgacgcaaatatacatttgcaactattaaatgagttagtactacagatagtaattactccctcttcactccagcccagctactagagccacgaccacgaccgataactactactctaccttttactatccacaacaaaataaatatcaaatccactcaccggcacctcccactgcatcaacctgcaacccagctatactgtatatgtacaatgcagggcgggaaaccttaacccccaatgcagaggttatatcatcgtgcagagacatgcagaaatccattatgtatgagtaaatataaggtgtgtgtagagcttggatattcatccatggattaccaggttactgcacctccgcagtgcatatcctctgcaaggatgtgagtaatgtgcagatctgaatgtgatggtggaaacaacaaggctgaggtccatgtgttgcactttatgcatcgaggttgtaggttgtattagggagatgcacaggatgtcctactactactatggtatggaaatagatgatgaaatctcatattaacgtagtaagtaattgattcggcaacacccatgccttcagaccaaacgccttccctgtcaggtccccccatatgtacactatcccgaaacgccaaatgaacgagaaagcaaacgaggatatcaacaaaatatcatattcacgcgcgcggacgcatcttccgaggcactggcgtcgacccagcgttgatcttcagcaggttggtcttcgcgctactgctgcgcagtgatgtcttgatgctgtcgcttgcaggcttcgacggtgtcgccgggacccgcctcggcgacttgggggtgagctttttgcgctgctccgccgtgctcgcgctgttgtcgctgctggacgacggagagggcagggaaacgctgctgacggctgttgcagccgtcgagtcggctttgggtgctccgggacccagccggcgcacgcgccgcgtccgaggcgttgcagtagcgggtgcagtaggcgctgcatcggcgcgatcctccccaccactcttctgcgccacttgagaccgcgttgttcggctactggctgcctttcttttctcggggcttttgcccttgcttccgcggctcgcaacgtcatgctcctcgccctttgctgcctctgatccgtcgtcgaactgcaccagttcctcgtcgttccacgacacatgcttcttcgccgttttgtgcggtcgctccgagacgtctcctgtcgtctcgctatctgtgcaaggggcggtaccggccttcttcccagactctggcgacttgcgtgtgagaccctgcaaaacgaacttcggtgccagtgcattgcccttgttcagtcgcgtgtttcgccgcgtcgtgagggccagctcctgggcctcggtgcgctgcaagaagacgaattctgtgcccttggcacggcgcagtgacagggtattgcgtactgcagccgcagcggtgatggtcgtcaacaggttggaagagcgaacggtgcgaggtcgagtgctgcgtcgagggctggatggctgcgggctggcctcatctttctccttggtaggcgacagttgaggcttctgcggtgagggcgagttggtgtcaaggtcctccagcgcgcggcgcgccggtggtgtgggagatgcaacaacaaccgacacctcgggctcagtcttttcgggctcctgggcgaccatagcggcttttgcctcacgcttggctttggccttggacaagaagttgttgagcaactcagtatcctctccgtccaatgagcttcggagtgccgaccgaacgagcgttgattcctgctcggtcgtcaattcctgcacaggcgcggcgaccgtagccgctgccggttcctccagggtttctacttcgacaggcacagtcggctcttcgtccatgtgctcttcaccgatcatcgtagatactgtgttttcaacgtggccatcatgctccggggtcgcaggtttctcttcacttgcgtcggagagctgcacagtcggctgttcgacgtcttcgcgggttcttaagtctggggtgccgaccaccatgccaccaaccactagcggcgactggccatgtagcgagcggctataggctgcgtcggacgccaatttagtgggggtttccgggatcgggctggaggattcgtccatatcggcagggttctccgcgagctcttctaacgtcgacgtgggcaattcctggtcgttctttacatcgtcacacgactcttctggttgtaggctgtcgtattcaaccggctcatcggggatgtcgacaaagtcactgtagatgaggggaagtttgcctggggttgttagcccaacgaactgggtaatcctctgaagcagctggtaggagaaactcacgtcgccgcccattgacctcggactcccactgcgtctccaagaaggagcgcccgcgcacaccatcctccaagtcgtccgcttccagagcgaaacatctgcgcttgacaccgcgacggaggccgggattccgcgacgtgttgatttccagatggagatcgtcgtcgacggtatgacgctctgccgcaatcaattgctgcagagctttcatgctgttgaacgaagtgcgaaagcgcttccagaccttacgcgacttgccgcgggcgcggaatgcggttgatggtttgcgttcccaggggcggggggcggctctagtagctttgacgggggtaaatctgaatcgatcttcttgagagaaggtggtccgtagatgtggagggctgcagagagagtaagttgttagtgacgcgaaaacaagacatcgatgacggctcagcgatgttcatcggagaactggcgatagtgggagaaaaggggggccgcaacatggcggtggcgcaacagatctcccacattgagtcccaaacagacaacgggcctttaggctgtccaaagagaagggtggactcaccatgcctggaatgtgtcggaaggacagacaaagtccgccattttcatggtgaatccgcggcggaatgtgtgttcggcgctgacgtcaagcgagactcgggaaggagggacttgaagccggtagacggtgagtttgtagaatataaacaaaataagctaccgggcttcagtgagataaaaggatgatactgaatagcgatactgagtaacacgggaatattccaacgcgagcaggatggaggaggggagtgaagtggatttgctgttgtggtccggccgccgtttgttacgttgccctgccaaccatcagagttatagggacgattgccctcatctccgctacttgcagactaacaccatcttatttaaaccttcagaacaccgatgattggccaatatagtagacgccatacagttgaatctatttaataacccttagcctagctaacgatccatacgttaagatcatctagtaaacccaggggaggattctccaccggaccgcccgccggtacttctcccagtcttcgccatactttgccgcacacatagcatcgtctctgcgttcccgatgcatcaacaggattgcaaagtacagtacgtagaaataggtgaagattattccccaaccttgggcttcaccctggacgaccttgcgcccgtctgtcatctggaagctctgtgaggcagccacaagactccctgccgggtaaatcagatatcctgccattcccgtaggcaaactgaagggcaatgcttgtagccagtccccaaagtagttgatatgccgagacatcccccaccatccagctgtgagcagtctagttccgcgcttagtttgaatgtacgacaggcctgccacactcggattgttggggtgcgtgcggaacatgtgcttctggtcgtttgcggcccggaagatgtacagtcccagggcaaagacggcgctcacagctgcgacattgaaccaccccagctgcaaagggtagacagccaaataacggcattgtgttgagtatagaaagggcacccagagaagatcgccaaaggagagcataaatcccatgccatcagtggtggtatccatcataaccagaagccctaattcattgtaatggctgttgagcacgtaaaatccctggaagaaggcgatcaacagaatactgtcggaggcatagccataagtgcgatactgcttggcgacaaaggcaagatcaagcaggatccagccggtcaagccaggatacatctcgcaccaagtcttgatgtcgatctccccgaagaatggaagagtgacacgggggttcaattcccgaccaatgtagaaatcgtagataacgttgcctgtcttcccgccggctgctagttcgcgaagatctctattggggtaattggtgtccacgccgaagctgcggatgtagaggtaggtggcgagtgcaaatgatatcaataaattggccgtcaacatctgcacatagtgatctgcaatatacgtccatacagcgaagtcggcgcctttgaagtatgtgccaattgcacagagagcaaaaacgacaacgctggtcgggaacgctgtcaagtgttgtggtcagcgcagttccagtgaagcatatggcagccggggttcacagatagtataagtatatttaccattcatgcgatattcaagcggacggccatgatggaccagtttagttccatgaaccttttgtgctgggaggagcctccaaagaagcaagataaagaaatagtatgccagcactgcaccggtcactttccagtcgaagagcccccatattccaccttcaggccacccggtctccgcggtccatttctcccaagtgaaagtacgagggctcaacagcgaaggcacaggacagcctgatacatcgttacagccgaaggcaaagaagtacaggagcaaaggtaggccaatggtgatggcagcggctcctaggctaccggcaattcagtctatattgtcaaggctagatagggtccggggtaggtgcgtgcttacggtccaccaaactcgtattcaaccaccgtcgaggaagccattgcaacaactatacctccagataggcgtaattaaccgcaaaaggagctgatgtgcttgaatttcctcatgttcaattgcaggatcaaggtctctttatagtctcacagagtactgagcaggcgacaactaaattcccctttgggactagcggcacggggtcgggaaggcagagcccggcgtgatatcatcttggcgaccagcagtccatccatcttttggccgattacagaaagattcaaagcaagtggtccacagccatggcggagtattggaaatcagcggtaggcagaaacgttctctctcatctcccgtgtctcagcactgactccgacacagcccaagttttggtgcaagcaatgcaagatcttcattcgcgataccgccttcgaaaagtctcaacatgaggctacagccaagcatcagggtaatctaaagcgcttccttcgtgacatccatcggaacaatgagcagcaacagcgcgaagcacagagagcgaaaaatgaggttgagcgacttcgccagaccgtagccgggtctgcgggtggaaaagacggggatgctgcgccctggaaacgtgcgcccgccccggcgcccaaacctcaggagcgacctgtttctctggaagagagaaagcgacaaatggcacaattagcggagatgggtatcgctattccggaagaataccgcagtgagatggccctggccggagaatggcagacactgtcggagaaagtcgtacaaccttcggaggaatcaaaagccagtcaatcactaggggtacgcaaacgaaagcatgaagagcgggatgaggaggaagaagaggcgaaacaggaagccgaacggttcgttagtaagggctggggctcccggacacgagtgtatccgggtgcccaagaggacactgacctcgatgctcttttggagtcgacgaaagatattaaaaagggtaaatctgcagctcctgcggaatcggcgccggagccagagcctgagaaggcgtcggattccgtcaagggtcagttcctgccggtcaagtcggaaggggatgcagcagctccggagaccggtgagccgtctcaagtcaaacaggagagcgagactgccccctccgaggcggctcctgtgacaaaggaggaactggaagatgccccagctactggggttgtctttaaaaagcgcaaggctaaggttatgagaaagtaacggcaaacatcacgatcagcatttttcgatagtgcgtggtgctgttatgtgtcggcggttctcgttactactcgagtgcaatattatctgacgatgcattatcgtcagcgaaatacaactggttgatcaccgtctgccaggcggttgaggtccagcaaacattgccgagaaaggacgcatagaaatgcaaccacgattccgtgtctaaaccctgtccaaggctctgaagccgagcagcatacagatgactgaatctggaatctacggagttacaggtgtggaacctgaagctggatatcaagagaacggctggtccgatttaagcacagatctgagacagaagatggactgcttccatcggtgtacgtgcagtcatcaacaaggctgatatgcatttgcagaactaatattgacatcaacagcattcaaggcaaggcaatactcatcagagaattacaagtagatatgcctattcgtatgtgagaggaaacgcattagaagaccagctgaggctttgtcaaggctcctgagatgggatgataatgaagttatttgaaactttataaggtcatgtagtttgctgtcaatattatcaattagtataatctcgataatatttagaataagagattaaatgattgttgctgttaaagaaacgcgtagcagccatttatggttgtcgggttgagttgccactggctggttccctttttttttgctgccgatggaaatttggcgcaaaactggcaagcgttggcaaaagtccgggggagaaaagagactcttcaagcgggcccgaagctcttctctctttctttctcttttgcgggcgcaacaacattttttaatcgcaatcccagctccaacccccacccctaatgcggagactgtctggtgccgaattgcgtgttttggtgctatagtcattcggctcgcttcttttcgcttatctggcccagtgcatggtaagttaacgagagcttctttcccatttgcctgccccgatctgcctgcctcccgaaacgcgcccgcccaactccgctgccttcccttctccagttggggatttggccgctcgcacaaaggtcaactctcgcaggaaagacaagatggtcatggatggccgttggatgttacgagatggcaaaccccagtggtggttgcgtcgttgaagtgccacgtttgggcgacatggtgggaattccctgacggtcgcattcaacgtcacctgggttccgataccagcattgtcatcggatctgcagatttcgagaaagatcatctcgcagactactccgttgaactcctggtcatcgactcgagagtcgtggcctatgaaattcctccgatgcgcggctcaaccgtggagcatcaacagcagctcactacgtcgcgaccatgcgcaaacccagacgtcggaacccgttgaatgtcccttacattcacagccgaataacactcgggcggcagttgcggtgctttgagggtgcatggaatttctgggccgaggtctggtcactaacacgcctatcttccagactagagaaaatagcacctcgcgatcgttgcacccctgcaagttctatcagccgcagagttctacgtgtcctcgacaagtccctgtctacagtcggtttaattcttcagccacattcagtcatccagtttcctcgagtttccgagggaatatacttcaccattgagatggccgacacgacagagccgacgaacacgtcgggcgagctgcctaacccggctcctgagtcgacggaattaccatctgttgaaaccacgcagccgaccacgacagataattcccttccaccgatagacacatctctgcctcctatcgattctacaatgccggcaatggacgatcatctacccaaccttgaccatacgctgcccccgatcgatgcgacaataccctccttgccgcccattgacacttcgctgccaccactggacactacattgccggctgcagatgggcatttgccgggcggggagcctgacttctcctttcccgacaccaagtcgttgtccaacgaaggtcatgcatcggagcctacgcattcagggccaggaacgagttttgattttacggagcaatccgtacagtcgtctacacctgctcctacgtatcagtcccccgtgaatggcaccccactgcaacaaccagcccagcaacagtcgcaaccactgcagcaacagcaccagccgcagccagggcagcagcagcagcatcagacaacgccgggtcagaccccacaaccgcagccgccatatcatcaacaatatgcgcagccaccgcagcattcaccctcccatcagtctacgcctgcgccacaacatacgccgtcgcagcagtcccagcaatatacgccggggcagccacagccgcatcagtatcagcagcagcagccgccgcagcaaggatcggacatgtaccacaaccaccagagtcattccccctcaatgaatgcgccttcgatgcagcccatggatcatcatgccgtttcgggacaatcgtcgcagatccctcaggcacctattggctcaccgatgccatccaatatgcctccgatgccgtcggtgggccagtacatgacgggataccctaccaatgtcgggcagatgggcatgaacgcaaacgcgcaaatgcgctatcagttaccaggagatcccaataagctgttgtcgggcggacggcataagaaggaggtgaaacgtcggacgaagacggggtgtctcacctgtcgtaagcggagaatcaaggtacgtaccaggaaaatatggcagagagaaaaaaaaaagcatgacccctcagcaataagtgagatgggattggcgggagagaaagggggagagatgcagttggaaaggcacagagagagagagaggcggggagcgagggaatggcggaggggcgggcctttcgcttgtgcagcagcaaccccgccggtcgcttgttgttgtttgcgcccactcgcctatcgctgtgctccccgcctgtctgggctgccttttttcgctgccacccctcgacctccttcctcgtgcttatttttttgctttattatttcccaagctctagcagaccattacctgtcggctgagtcttgccactgaccgatatctttagtgtgacgaaggccatcctgtctgccgcaactgtgtcaagagcaagcgcgaatgcttaggttacgaccccgtatttaagcaacaacccacgccctcggccatccagcctgctcctaatccccatccttccttggtggtcaatcctcaggatccgtccacttcgtatcccgctgcgcctccgggttacatgccagctgcgtcccaaccgtttgctccgtctgagtcgcctgctccgccaagtgaacgctacgattacggcactgcaattgacccatcgctggacgtgaacaactctaacaacatggctagcattcagcacgccgtggagggaggcctgcagccgacggtcaaccccgccatgaccagcaccagcgctaccccatcagagccgaccaacgtcagatgtaagtgtcatccaagggtgtgttagggtacatctgctaaccgtgagcagtaaaacaagttcagatcagcgaccttctcgcgctacgcggcattccgcctcctccccctcatccgatcacctccctcccgccaaaccgtctggaagaaattcaggcggtcttcctggcaacgtacgctcctgccattgacaagttcttcgagactcggtggttccaggagaaggcactgacacatcttctggccaacgcgcagctcatggctgagtactcggcgttgattgatgcgttcaatgatcccaaccttggcgatcccaatgtgctcgctcggttggagagcttcgaagcgtcagtcgtctggagctccatgactctgtgtcgccatgtgatgaacgtatctacgggaactcaaccggaatacgatcttctggctgctgctaagcggttggatgtcatcgaatcgatgatcactggggaacacctggactcgaacccgcttgcgcagtttccgacgcgggagccagcggccaaccctccgttgttgcccgatcagctgacgcaacggtcgttggatttctggagctcgatcgggcatttcttgacgctgcacgacaacgaagccagctcggccaaggagattgacgacacactcgcacggtgccgtacattgctggatacctttgaaaaccgtgacgtgatctactcaattgcaattgcccggcatctgggccagcggtgggcggacttcccgcgcagcttcccgcaaccgattacgaccaacgagaaggacgcgggggcgaagctgtacgtggcgcagaagttcctcgagcaggaagcgggtggcaagggcaccacccaggtgatcaagcgcatatgcggcatggtggttcggtcctggattgtttcgcgggagtaaatccgagccggcttgcatgcactgacgatatctatttgcgacctgtaatatgaaaaagcgattggcgactacctttgacgatgtttaactagatcttttctttcttctttcctttgctttgctcattcattgttgccagcttattgttcacatttttccccagctttggcccagattggatggaaccggttggtgggccatgcttctctctctcccggactgcggaaatacggggaagccgtcgcatcacgactccggagttgattcgcttcagtttcgctgcagctggatggcagttatcatggcgttattacggctgcattgctgataaggtggtggtttacattcttgtcgattatctatctatatcatggctcaattcgcctgcttgaaggggaactgccctgacaagctgcgagttttttttttttttattccttttcgcagaagaatgaataatgaacatcttgtatatatgtatttgcgactggcaccatctatcgtagtctagacgtactaatatgtacaatatgaaattcatagatccgcctgctctgggatcggactcttcaacttgcccgtctccagcgccatgcggacattctcaatcgcccactcctccatgccagtttgtgtctatagccgtatcagtactcagcccgaccaccataatcaaaactacgtagagacactcacctcaacagtccaagtacccatatgcggcaccagcaagacattcggattgcggaccaatcccggatgcaccgtcggctcctcctcaaagacatccaatccagcggaatacacctttccactatcaagagcctgcacgagcgcctcctcatccataacagcaccgcgagcagtgttaacaaccaccactccgtccttcatcttggcgaactcggccgtgctgataatgtggcgggtatgtttctactatagtcagcatatacttccgtccaccacaacccaaacaaccatggggaatagaattactcacattcaacggcaaattcaaactaaccacatcactttccgccaacaactcatcaaaactcacatacctagccccatccgccaactcctcactcagctttctccgattatggtaaatcaccttcattccaaacgcctccgccttcttcttcagattcctacctatgcctcccatccccagaatccccagcaccttaccctgcggatcatgtcccagtcgcggcgcaggctgaccccgccacttcccctcgcggagggcgtgcatgcccgcgttaaagttcctcaacgccccgatgatcaggaacatgttgacgtcggcggtcgcgtcgtccactgctgttgggacgttggagatccggatgggagtcggggtgcgcgcgctgcatgcgtgcgggtcgatttggtcgtagccggctcctgcatatttaagccattagcattgatcaatcatcttgttttgttgtctgtggaggtttgtatggtgatgtaggggtggagcttaccgcaatgtgccaaataaactaacgacttaggcagcgcgttgacgagttcctcgtcaattagacccgtgattctcacgctgtcgaaggtgcggtatgcggcgatgacgccgtccagggcgccggattggcattcttggatgaattcggcgcggttggtggctgtcgggcggattaggtcggcgatgtcggagagggaggaccaggttgtgtgggcgctgttgttgttactcttgttagtattggtggttggaggggtagtgttgtggtgcggggaatgatgatgatgatgatgatgtgattgatgagcaatagacgtactggacgatgtctcctaggaggaggaccttgggtttggggtcgctggagcccattatgtgtatttgtgtaactgaatgattatagttttgttagagagtggaggggtgagaaaggtaagtgagaagagtactggagaaagttggatgtcgtgggggttgccgaagatagtatcctcgggcggttatataccgagtgggggtgggactccacgaggagactcctacttgtggacggaaatttggcttgcgggtgtatggagtactgggaagaacagagactggatggagtctagataggagaaagaaggcaaagaggattgaagaatcaacaatctataagagaccagagatagggaaataccctcacggccccgctcccgttatcgagtttacacttcggcttcatctccggttggtgcgatgcagagtatacagagacatcaatggttataagtgagtcatacgaagctcgcggattatacagactaactaactaatgaactccatgaagagtttagggtgcgccctccaccaacacgcgcgtccagtcgaacttcctccatcgcttttgaaagccagccacccgccgatccccaccgcgatgccagcgtccctgccgcttaatcacatccggcgccagatccagcattcctccgatgacttctcgggcgaaaagatccccccgaggccaacggttctcatcctcaaccacatggcccagtccgccgtccagctcaaaccagacatggaagtagggcatttcccgcgcaatcgaccgtcggaatgcactccgtcccatcccttgcttggatttggcaagggtatcgataagcttgcggtgctgcgaccactccgcgtctgaggagaggatggcctccttgaagaaggccggagatgtctctccgagactgtagggcagaggtactacttccatggctgcgtgtcgcttgcgatgcggctgagccgcgttctcgtagaagatcacgtcgcggccctggtcatgatacatgcgggtcagactcttcatgaagttccggatttcctcccattcgtcgtcatcgcactcgagcaggttcgtgcggtgctggatgggaacaatggtggcacagccctcgttgagctcgggctccgtgggaagagtgaggaagacccgcgttgctaatgccacgacgggtgcaatgggcggcgcatttgtgtcttcgtggtgacaaagaggacagttgtcgagaatgcggttcatcttttgtagctcgttgatggtgatgttcttgatgtcaatctctgatcggtgtacccgtttggccagcttggaggcattgtcgtccatatattccaggtcattctgcgctacattagcattgcattcagagaattaaatgcacaaagtactcacctcaaacttggagtctttggcgattcgctccgccatccgtcgtccgtcgcctccaaattgccccctggtgcgacgctcttcctgaaccatgtcctcgattgtcatttcgtcgttctcctctactttgccacgttcacggccacgccggttctcaactgccttcacttcgtttcgagtgccagccagcatccggttctccatgacgcccagaaccaccacatcagattccttccggtttgacatggccgctgcagctgcattatagcgctcctcaagctctgctgcgtctggcgcgcccttgagcttggccttcatcatttgtgccttcaatcggttgagagccgtcaggtccagatgttgtgttgtgcttgtgggtggcacagtttccattggcttgccctggccctgggcatcaagttcctttccgggactgcggagattttcatggggatcgcggtggacaccctcatctagctttctctcctggaagagttcacctgtaggcttctccttgcccacgtagccttcaccgtaccgttcgcggcggtccaattctgcttcctcctctcgtgcatcatcaaatgagcgtaggtctccaaaccggttcaaggcaacctcctcgacagatttccccgtctcttcagcctccctatagacggccttgagcctagtcattctccactgagcgcccgcatcaccaaacgtgtagtccacctcatgctgcgcaggttgttcttcaatctcttctagcactttgccctccttcaaatcgtgtaaatgagtgttgagctccctgccgtgaattttcagctcaaagtccgcctgtagcatcttcggcttcggttcctcctccaaacgcgtcgtattgcgtcgctgaacgtagtcaacatcgactccgtccggctccatccaagcatctctcttcaagcgagtaggctcctcctgcacgacttcctccactggggcaggcgcgtccgcctcgtctctgctgtcgcggtgtcggcgtttgtgtgcatggtcacgatcatctccatggtcggtcgaatggcgcgatcgcttatgacggtgtccgtcgtcctcgctacgccgcgaatcccggcgtctctcatggtcgcgctccctcgacctggacgaacggtgacggcggtggtggtgtctgcgctctcggctgcggtcacggtcacggtcacgatcacggtcacggtcacgatcacggtcacggtcgcggtgatggcgatgcctactcctgtcgctcttctcgcgtctttgttcctgctcctccgctagcgatttttcaaaatcttcgagcgtcattgtgatggttgagctgctgaggaatgcaaaatgaagaagaagcgaggaaaaggctgcggacggaatgacgtctgggcggtccagactccaccggagccgatctctccatccccgcgacgcaacattttcctttttcttcgggctccccgcttcacttgttcgccgtcaacaccatcctatcgggacgttttctgaaacttgccggattgttgacttgcacttattctatttctagtctgctagcttcatcattatcaatcttacaccatggcgcaatcacccgtggccgtcgtctgcgtcggcatggcaggtatgccgatactgctcccatctcaacttcatcttctctgacaagcgctcctacctaggctccggcaagacgaccttcatgcagagaatcaactcgcatctccactcgaagaagaaggttccctacgtgctgaacctggaccccgctgtctactccgttccgttcgagagcaacatcgacatccgcgactccatcaactacagagaagtcatgaagcagtacaacctcgggcctaacggcggtattctcacatccctcaacttgttcgctacgaaagtcgaccagatcatcgccctactggagaagcgtaccgcaccaaacccgagcaacccctccgccaagccgatcgagcacattcttgtcgacactcccggacagattgaggtgttcgtctggagcgcatctggaagcattttgcttgaaaccttggcctcttcattccctaccgtcatcgcatatgtcattgataccccccgcaccagctccacgagcaccttcatgagcaacatgctctacgcctgcagtatcctgtacaaaaccaagctgccgatgatccttgtcttcaacaagaccgacgtgcaggatgccgaattcgccaaagaatggatgtccgatttcgatgcgtttcagcaggcgctccgggaagaagaggagtcgggtgcgtttggcgctgagggcggagccggtggctttggtgctggaagtggatacatgggatcgctactgaacagcatgagcttgatgttggaggagttttatcgccatctcaacgtcgtgggtgtgagctccatgacgggtgatggtattgatgagttcttcgctgctgtggaggagaagcgccaggaatttgagcgtgactacaagcctgagctggagcgcaagaagaaggagcgtgaggagaccaaggctgcacagcgggagctggaactgggcaagctgatgaaggatatgagcgtctccagttctagtcgtcaacgcaaggacgaagccgagaccgtcagtgaggcggaagaagaggcagaagatgcggctggccagggaggtttcgacgacgatgatgattccgatgaagatggatatggcggtgctcccccagcgggtaacgatgaagggctgtcacagcggtacaaggatgccctggcagatcaggctggtccttcggatgcggatcacagtttcgccagatacttgcgcaagagcaatattaactaggattttggggatgatatcacgggagatgtgcattctgctacttcatatattggtgtacgaaggcgttgatattggctcactcatcatgaataaatgattagaatttaatttaaaagcatactgttcgactcggatgagatcttcaaatcagtagatgtaatttttggtacctggtcaataaaatgcaaactgatcgacgatttaatgacaataatctagcagttcgtcaatggacagttcgatgatgtggaaatgcataccattgcagatcaaatatcccgttggtcttggttctgggttctaccgatgtccgtgatcaatcacacgaccagcagtcaaaccaccgtcacacagccaacaccttgaattcattcagcctagcaattttccctgcgttcaattaaacccggcttgaataacaaagcaacggtgcctggattgcagcactggatgagtcagccgcagatctgccagcttggaatggatgacatcatgggcgcctgagctagcaatgacctcacgagctctgccttataagagaagaaccgctgggcagttctcagctacttcttcaattgttggttccagtacccaaaacctattccaatcttcgtatcagatttcctcacgaaccacaaccggagatatattcgatctgcaaccatggacgtaagctcaaccattccccagcaaccccaatcgcatcaatgctaataccaccgacaggtattctacgcctacacctactcaacagcgggctggctctcgctacagagtatcgccctaattattgtccctgaaatgatgaccacaatgctcgaacaagaaagcagacagccatcctgtacttcccgtcttcacctatccccaacattccccaatgacccagactgactccatacagcaatcgaaacctacctctcccgctgcctcggcatgagcctcctcacaatggccattctaaccgtaatgctgactggctccatcccactcacggcctccatcaccgaccccgtgacaaccgacgactccgatcccaaggcgccctacgctgtgccgacgatgcaagtgaccaccatcttccatttcatttcagccgggtatgcgtacgcctggtttgcggataagggccaattggcatttggagtgggaatggtggtgtcgggggcgctcgcctcgttgggtatctggtgtgcgcttttcgcgagcagtaatgggaagattagtcggaagacgggggcggataagaggactacagggttccctttcaagaataaagaggcggagaagaagcatgggaaggggctgtaggggccttccttgggttaagaagatggagaatgaatgctgatagtgactggggggtacgtttgtcggctgggcgcagtataagcggagacaagtggatagagtatcctggctacatgatgtatgcatagtactgatatgtgcacacaagaccagagaaataacgtgatttgatttatcagctatgcagctaaacaggacttatcagtaactagtagtcgtataggtagactcagccatccactgactgcatcctagacctcaataaaatagggacgcgcacataccgaaatcctctcaccaaccaagcccgagcatcagatacgtctgacaatctccgcaacctatcaatgggggcattccagctccgatataccctccagaatcataatacaaatcacgctaaacctaaagcgcatgagatttcggaatatctgattggctcactcgctaatgacatcataggggccatacgctataccctttctgagatggtgcgatatctatatctcagaatagatcgttcgatagggtctgttttcacggtgaggaatagaggatttgggtgatgggaggtataaagaggtgagcaggggagggagaatggatggaggaaagcagacttctctttcgttcctcatctattgtccttcttttcataccatatctcgagagttcagtgtacagtcgctcgttacgttcatacttttctagtatcttggtcactatttctacgtctctaagagatttatactacagctggactattttcatttttatactactaaacatctagacacaagaacagtatgtctctcacccactcacccccgacatcatctctaactaacacctctaacagttcccactatcaccctcctccacctctctccctcatccacaatccaaacaacaaaatggtctacatcgccaaagaagccatcatcttcttcgtcatcctcggctgtgtggtagtttctgtcttcggttactccatccattaccttatgaccaatgggttctacggcgaggagaggaacctcgacttcccacccgaacagcggatatacatgcgacagttacggctacgggatttgcattggatggcgagagatcatggtattaagattcagagcaatacgtcgccggtctaggttatgtcatatatgtgtgatgggatattgatggcgtttgtttggggttggggtctatacttcttgcttattggattttgtgttggtatctggttggaattgcatacttgttaggttactaggatatgatgatcggatgtattgaatttgttgctaagcactctcttcactatataattcacactggcatcgaataaagcatgtgttcgttgcaactctgcttgatatcgtgtaaatttgattatctatcactgtttgactattgtagcgtgtttcctacaagagtttccattaatcctcgcctcgttcttcctccaaatataccgtcgggctctaaacagtatatacctatctactatgataatcacgagtttcttcaaactaaacatagacacaaagcatagatatagtttactgaaagatctgatagcatgctttactacgatggtcaccacccccagatcaatgaataacgcacaggccatacggattatggaggccagttcatctggctattgctcaatgcgcacagacaacaccagcaccacgctctgagaggccatagaacaccagcctcttagacgtatagactgtcaacatatactgggaagacccgtatcctcgacataaccacttgtttgatgatcaattgcccctagcatccatatcaccatgttcctgcagcgaatcccaaaccagacttcccaaggaacatccactaaactgcttgtacaaacatacaaagaaccactatgtgatggaaaagcatatgcagctagccggaaacaatgctcgaccgtcacacccctctacatctagactccctccctgagacactatccttgtcatactatatcagagcactacatacccgccccctatctccaagcctaccaaaatgccacgaatcaaatcccatcccataataatatccggcccctccggcgtcggcaaaggcaccctaatccacaagctcatcaccacgcaccccaacaccttctccctcaccaatctcgcacacaacacgagcaccgcgcgccaacgaaatccacgagaaagactacttcttcgttgattcacccatattcaataccctcaactcgcaaggtgcgttcgtcgaaaacgccacattcagcgggtaccagtacggcaagagcaggagagccatcgcggatcaactggacaaggggctaattcctgtgctggatactgatgtgcaaggtgcgaggcacatgaaagcagagtcatcgggggtggaggcacggtatgtgtttattaggccgccgagctttgaggtgctggagaggttgaggggacggggcacggagagagaggaggatgtgaggaggaggttggagagggcaagagcggaggctgaaggggctgttgagggtggactgtatgatacgatttggagagggcgtttgggaagttggaagagtgggtgcttggaggcgagcggggtggtgagtagggatgggatgtgtcggatatgctgtcgttcggtcattggaattggtgttggttgacactgaagaccttgattgcagaaatagtcgttcctttttcatatcatggaaatgcggtgtttctggctcgacgatagatgttgctgccgctacgccttttcatgtagcaggcggtactaagtccgtatagcggttgtggtatcatttccctgattgccatccttgctacactgattagggcttaagaaagtcggggctggaggatggcagaaggattcaacagccttacagtgacgaagggccttgcaaatccttttcatcagaacatactacagacccataggcttgaacctggttcaaggcacccagtccaaatgctatcttgactatccgtctcaattatcatccctcctctagaataaccgaaaggaatagcaatccagatgcaataaactcatatctcatgctcatagctcatgcatacaccctcaatccccaaagcacagaaataaaagtaagaagaaaccaccaactccccaaacaccaccgctatacccacacaatgcaagattcaccctcaaaacagcttctcctcgacatccctctcatcaaacggatccccgaattcatctacacgcccactaattagcacatcccaacccaacccatactaaatcgaccatggaagaacatatatcaataacatacccagattgaactcctgatcaaccacatactccaacgcgcgctgatactcctcctccgcccttttattcatccatgacgcgcccggcgcatccatctgctctccctgttgttgctgctgttgtacctgctgagttgtctgcgtcgcgagcggggagtcaattaggcttgggttgaaggacatctgtccctgcgagttcagagtagcggtttgcgtttgtgagccgggcggggagagttctgagccgccgaagggaggaggacgcgggttggtgagcttgttggttggagtgcgggttcctgggtgggagtcttcggagaggccgtgggaggattcgggcgaggaggccatttgggagtcgccgtctgggtctgttatggttggttatggttaatgagtgagttgcgtgggtgttagtggtagtggggaaataggtggaggttgtttgtatgtggtgcagcggggagctgtgtggagtggttgggaagggcacaaaccggtagccatggtatatgagtttatcaaatcggtcaatcaatcaaggaatagacgaaacagaaaaacaaccaagcgagacagtctgtcgatgttgtattgagatcgatggagggatcggggataaggtgaggtcggcgatcttaactaagcacaaggcggcaaccgccattttcctccgcttttctgaactcctcttccaaactagacgattttcttcccctcgtcttacttacccctcgttcattctctcctttaaactaagccacccggctaatacattggacgtgtctttcttggtttactatctagaccctactgactctgggtcacgtcgttcactcgttcaaacactgttttacgcgctatagcgatatcccttggccatgagcgcaaagccctcaagtggccccgacgcctgggaggaggactgggagagtcaggctgatgtatgtgcaccactacgtctgcattccgccgtgcgaccacctcaattctctggctaatcgctctcctagtctttcgctgtggaatccgccccgcctccgcaggagaagaaagtctcctcgaaagttaccaaggcccagcgcagagcccaacaggccgaatttaaccgacagctatgggccgaggcgtacgtatactacaattatgactttgccgatgtttgcctgaccgtttttcgctacagagaatcacctcagacgtttcattacctagaagcgcggtcaaacgtcccgctcaagcaggaattcaagcccaccgtcactgttctcagtcgcaatccccaaatagctacgcgtcagtcgtcctccgtggacgctgcgagtgctggtatgagaagactagggctgaatgaggatgacgactctgatgaggataaaccgcctcagcctacacccgaggagcggcaggctattgcgctgcgcaatctggaagagaagcagcgcaaatatgaggaagtcagggagaggctgttcggtagcccgtctgcccctacttccggcgcgtcctcgccacgcagtgctaccccgcctaaacaacacgagggccgaggcaaagggagaagccgtgggaatgggcgagacaacaaccgtgacaagcgtgactcgtctgctgcatccgggaagtctaagcaactctacgatccggggtctcctaaaccgaactcgagctttggaccgcggagggagaaacagagcggtgtccgaagggaggatgattcgcaatctccaaggcagccaatccgcagtcctcgtggccctgatagtagcggaaggggcgggtttagaatgggcaacaggggtgcccgtggaggctagactacgaaaacgacagctatcccttcaccaaggattggcgcatcgcgcctgtctgtgttggtgggacgcgactccgggtcgctgctcagagtagtattcaaacgctaaatggtatagcagtgacctgcaacaagctagggaagaccccttccggagttgatcgcattggcaacctgggacgtgttggggcggttttctagagacgtcagcttgtgatcgcgttgtatcaacaatacacttacgagcgtatcgctcataactatccagatagagctcatcggtgctcgtggttgcctggatgtgctcattgttctcaatagcgtcgacccaggctccccagcgactgccaggctccgggtctggccacccgcgataaggcttcaaggcacggcgcaagcggatgatccaaggggcgacctggacatcaacgaacgagatttgagcgcccagaaagaacgggccctgcgcatctgcggcgccgaccaatgtgttgaatgcatctcggagctcctgcgcgttggttatttgcttatgtgtgtcttgctcttgaaggacacggtagaaatttgggacgatgtagcggttgatctgcgaatgtcagaggtgaaggggacgataatcatggggtgcatacaaaatccgtccacagtcggcaatgcgccctcagcttggcgtctccgggcggaagcaacggtgtgccgacattcagatcctccaactagggccatgttaggattggatcaagttggttcagtggggcaggggtagactcttacgtattccagcaatacggaactctcatatgagccccaatccccatgccgcaaggctgggacaagacccctggggttcacgtccagcaatgactggggcttcttatacgggtcaacctcaatatattgataggggatgcccttgatctccaggccaacccagacgcgctgtacaaaagggctagcagtggtcagcactagcgacgatgtatatatgcatataaattagagtgaacgtaccaaaagcaacttccatacaatttcagttcattgtcttgtgagcggtgcgcgactgtctgggcagccaggccggtggctttggtatggtattgtttttgaatctggttctgagtagccattactctggtctgtgtgcggtggtgattagaaggaagagcaatcaatcgtgtcctaacagcagaggacacacgcctggataaattgccaaatggcaatggtttcaacgacagaatggatcttcggagcatggtggacgggaagtgaaggtgcagttgacgagcggggaagatagtcggcgataggcacttctccgccgaatgacgtaacacgcttgtgccaggatcaatcaacaagcataaagaaacaaacttacattcagcgacctcttcttctctttcaactcctgcaataagaaccgctgcacgctattcttcttcacgcgatcactgtcctccagcgtatgacgatggcccccactcacaccatcgttcttcccgttcgccccattcccatttactcgctggatagtaaagaaccgctgcccgttgacccctggatgaccctctggtagaggtggattcaagcttggcgttagtagaccaaactgctggttttgagcttgttgttgctccctgacagcagactcctggagtactgggctaggaaccccaagcccatcaaggactccaagatctgatcccataacatcgtggcccgggaagtattctgtgatcttgatcttcacatcacagagatcccgctgacgggcagttcgtttacgtttctttttgttgggatcgttggatttcggtgttccgggaggtcgacctttcaggcgacagtcccagtaatgggaaattagtggtttgcgtttgtagtgttgagttgagcggtgggagtagacgttgtcaatgtgtgggaaatatgttaggaatctggagtatgtcaacaagggcatttcatctgcagtaaagtaaaaaaacacgcactgctcctcacttaggactatcatctcgtcgacattgaaaagccgttctcgccatgcgtcgagatccggcggatcgagaatcgtgcggatgtcgacatgctggtcaggtctttttacgagagattgaagatgcgtctgttgatgaaggtgttgattttgagactgatgagattgtcgagagtagtcgagctcttcgacggcacattgtagaccatggagcgagtcctcgtcaatgctaacttggccttgtcgatgggttggaactagttgcgggtcctggtgggcagctagcgtcgacgcatcttcggcgacagaagtaagagagggatgaaggagagtcgaggctgtagagtgtattgttgtatcaacttcggaggaaagggatggatggtccatcgtggtggacacactgttaatattaaatgctggtggtgacgctgctttaacagtgtggaggaccaaaaggcgggggttgaggcggcaacaaggttcagttcttcatcgttgagttggttgccggttggagattagcgttgatcggcgtttgctgatcaacagcgggttctggtccagtcgtaagtgggcctcgtatcatgttaactatattccagatctacttgatactgccactgtcatctttttaattggcaagagataatgtgctctttttcgcatcgttttaagcccaaatgaagtcaagcgacattccttctctactctgtactcagtcagataccctcttaacgttacccccacgcgttgatgtgcggagttcatcgttctgccggcagaactcaatgtccgcgaaacccaaagccatcgagggatgtcctgagtagacgagacaagctaagtaatatctacaatatactacatgagaaccttcccaaaagagcaaccatatgacaaagcccaatttcactctgaatataggagataagcccttttcaggtttgtgctcggcgtgaaacctagtaaaactcaaaatagcgacattcattctaatagtattagtgcatgtataatggtatctgacctatccgcatggatcctgcctgcgtgtctgctaggttcactgtgtatatctgcgtagcaaagtcgacttgcattcgcaataagtgtactcgaagtttcgctggggagaatttgcggtcaccaaggcggtagatggcctgggagagagaacgtattgactccgccttctgtacacactcgcatcgctagcagttggttccccccacccactaccgccagatgtctggatgatcagagtgtcacctttgcatacgttggttgtgcttttcggaccaagattgacaacctggtttggctctcggtcggaagtggccttcttaatcaacagattgacgccggcctcgccgtgacagcccccgtggaaaccatccgagcttgggggttgacactctgacatgaccgtcaagctgactggctttaggaactcaatcactctgttgcacccatcaccaccatagaattgaccccgtccaccactgccatgccggacactgaactcccagaccaggcaagggtactgtctttccaatagctcggcatcaatgattcgtgtcttcgttgtgcctacttccatagcgttcttcccatgccagtcaggaccagcgcaggagccccccacaattgtttcttgatgcataaagcctggtatgtacgtcccatcgggtgtgatctggcccctaacgctgaacatcaggttatgaagacgtccactggaatagatgtcaaagcactgcaacatcaactcgaggacatgatgcgaggcgacccgtctgttgctgatggtattatctgactgggggtttggcgttgatccagcttgcgatggaagaatgatgttaatcgggttgagtaaaccctggctgaaccggatttctcccttgatccaatgatgcaacaggtacattatggcagcttgggccacatgcgcaggaaaattggtcctggcttcacggagacaatcagcccaatgtcttataacacatgagagggaagcttggagcgtaccagtgcctgtgaaatcaaagtcggcttctcccttgtcataatcaattgtgattttcagacaaatggggctaccatcactcatcaaatcggtcgcgactaacggcctaccgccacgcttatcatgaacaattctcaatagctggcgaaccgcggtctcgggccttctttccatagctctgacagatgcctaccgcattctttagtcggattcggccaaccgctgatagggtgttgctgccactcaccgatactactttcatctcttgcccctccaagagcttcattagacgttccctaacttgctggtttgcatcaaccaagacacggaggttggcaagattgtcggccagatagctcgaatcactgcagtcagaatgctgtttgcgatctgacaggatatacttttcaatactctcttcgtccatggcgccgtcccgcactacttcagctggtatgatctctccatcctcttgccaaggctccttcgagatcaaagctgacgaatcagtgaatatgccactggaggtgcagtaaaatacgatgacgccgccatggaatacaggggtgaccactgtaatatcgagaggatgagtgctcccgcacagtcctgttcctggtcaaaccacgctgcgtaagttgtgagaaaattttcgaatccgacttactgggttgtctgaacacaagaatatctccgtcttgtagcttgtgcttccaatttccacggttggactgtacggcacatttcatggtgctaatgtgcgatggaccaaagggggctaagtagtatgatgaggtcagcgattgtatctataggttgtcctcaacaaggccttcctaccacaggctatcagtctgctatttgcggagaagatgccgcacgagaacttcaagtgtttcttcatctcgctgctgatatctgtcctccgcagcattcgtttcatcttcttcatcatggatgaaaaccgataatcgaatattgcaaactgaagagggtcaatggcaatcttttgaacgactgcatgtgccgttggcgaagctatgtcgatcaccacatggctcctcagaattgttgcttgcgcgttcggggtcacgagaatggtttgggtattgtcgacgatcaaggccggtccttcaatccggtcggctgttcttaaactttcaaggcgatatactggagtacgctgccaaccgcgctccccgaaatagacatctttagtcatcaccctagcctcgcgtgatggagctcggaactcccccagacatgcaaactgctgagctggagatagatcactggggggcttcttgagcccgactgcacgcaatcgaacggtgcaggcaaccaccggccgtgctgctatgaagccatacttcttcttatgtacgtctgcaaatttcattgtgagctccaattcgttttccggtttcgagatcgcaatgatgatatcggaaccttcatagtgcataaggatctcgaccttgaactcgatatcgtctgcatctccaatccctcgttcgcgaagctctgattccgccctaattcgcaaggaggcctcaatctcccggatccgagggatggtatctctgcggaagacgcattcaagcggctcttcgagatctgagaccagactcccgaaggccatgccatacgctgatagcatagagctgtgatgatgcaggatgacccgattgatgcccagagaagatgcaatgaagcaagcatgctggcctgcagcaccaccaaatgcaacgaggtcatggccactagcctcgtaacctcgtgtttctgtctgcctgaggatagcgcgacacatattcttttctgcgatccgcaagaaattgagtgccgcttgttctggggtcaacttagttgcatctgaattagcaccattgttaatatctgagcataggtcgttgaacatccttctggtcacttctatatcaagggatttgtccccatttggtccacagaccttggggaaacactctggtaccaagcggcccaagagcagattcgcatcagtgactgttagggggccccctttctgatagcaagctgggccaggatgtgcaccgacactgtctggccctacttccgctgaccccttcgaccagtataactgagagcttccgccagttgcaatagtattgatgtttagctgaggcaactcgatggtattaccggctagtgttgtcgttacacgttcgtattcgcccgcaaaccgcgatatttctagtacatgatcagcaaagagagatcgtcaggttttggtcaggcaatcagctcactcgttgatgtaccacccatatcaaagccaatgagcggcttgccggatgatcgatcataacaggtcgaagcataccctagcaggccacccaccgaactggacagaatacccttgctccccacaatatcgtgtatatgagccattgttccatcattctgcataaactcgcacggaggaagagtgggatccctcatctgaccaacaaacaagtttctgagatgctcgacatgttttcgtatgaccggtgttacgtatgcgtgcaaggtagctgattcggcgcgtgctaccattccaatctaccacgtatcagccttattatcacagcactatggctcaaccttcaagcacattaggaagtcgacatacctttggattcagaaggcaactgactgtcacattaagaccagccttccgggccagatctgccagtctaaactcatggtttggatagactgaactgtgcatgaggcagatgcttacacttcggatgccacggtcatgcatttccacaaaatgttgctcgacaataccccaatacggttcccgcacaatccgtataacttgctgcgagacgcctgtgtcgagtactttatccggatcaacattggccgcttggcctcctggatcgtctggagagggttccagaatgactcgctcgtccacctcaagaaccttctcgtacaacgccattggcttcggaacggtgaagccaaagaggtcaagcggtgcttgatcaccaagcaagagaagatcacgaaacccctttgtgatcaccaaagcagaccgttcgccctttccttctgacagagcatttgcagctactgttgtccccatgcggatactcttcacttcacttaagttgagtggccgtccgcatggtatctggctcccactagcaatctcgagcacacgacgaataccctctgtcggtgcgtcatggtacttttgcgggtcgacggaagacagcttcaaagtgatatcttgtgatttaccaggaatcgatgcatagatatcagtgaaggtgctaccgctgtcaatggagatgctgattcccgaagcagccattttgatatgactgattctgtctgaatgtgttcaactcaactcccttccaagcttcaaggcctgggggtcctgctactttaaccatcactactactgtatactacatcgctgtctcgaaggccctgttctcatgcatccctgcgcgtacgaacaagcattacctggtgtagggctacgtctatcatgccaagacctgtatgctgcggcatacaggtaaccgatgatttgtgtgcctgagagcctgacaggggtactgcggcttgcaaacaaccgacatttcagtgtccgaacgttgctgcgcggcttacatgcatccgatgagagcatttcgcgccgatgaaaaatagccgggcgcccccctgctcttttgcggtaagcatcggctcaggacatactaccgcgacacaatctaaacgctacgcactttaatcacctgtctttcgcgcttgattagcctggcataaggttgctacgagaacgccattattggccaatacactatggcgcagccagcagcgagcatatcaggacaagcaggatcggataccatgcatattgctatcgtcggagcaggcataggaggactggctctagccattggactcactaatcggggcgtctcttacacattgtatgagtcggccgcgcaatttagtgcagtgggtgcagggatcggcctggggccaaatgcgcttcatgcgatggaattgatagacacaagattccgacaattgtacaatcaaatatcttccggaaatttgacgccgaacaaggagcacatagcgatggaagtgctgtatgccgaagaaggattcggcgccaaacggggctggcagccggccccgtttggggcggagttctacacccgaaccagcgcacatcgccgtgatctcctagaaataatgaccagcttaattccgcaagagcgtgtacagttcaacaaaagggtcaaacatatcaatcagacgggagagaacagcaaaattattatcacatttgaagacggcagtattgcggaggcagatgcggttattggatgtgacggcgtgaagggcccgacgaggcaagccgtcctagggacactatacccagacaaggtgcaacctatctttagtggcaagtatgtctacagatcgatcgttccaatggaagatgcccagcggcttctcggggaccatgctggagacgcgaaggcgtttgtcagccataaaaagaatatcatgacgtttccaatttcacgcggcaccgagctcaatgtggtagccatcaagatgatggatggaccttggacacatccacaatggaccaaggatgtcactaaggaggagatggtggccgattttgcggaggttgatcagcaccttctcaaattattggacgtgcgtgttagcccttatgatcgtctttgcctagaacagctaatgagccttaacagtgggccaaaccattacaatggtctctatggcaccatcctgacacacccacctattataacggacgaatttgtctcctgggggactcggcccacggcactacgcctcatcaagctgccggcgctggacaatgcctggaggattctcttatcatgtctcacattctgggtctcgccaagaatcgctccgaaattacccacgcattccaggtttatgacagtattcgacggccacgggcgcaagcagtcgtaaccacgagtcaagaggcggggacgctctatactttcacgcatccgcagttgggcacggacttggccgagatcgtcgcaaatcttaatcaacgctttttgtggatctgggatcacgatttgaaagcggatattgagcttgcccgtcggtggtttatagccctggtacagatgtctcagtcacgattatgaccgataataacgctgaaatctccacttctaacattgattgtaccattcttagtgtcgaagctatcgaaatgacatgtgatcgttctaaggacaaaaacaggaaaaagagacaaaagaaaaaaaaaaaaaaagaacaaagaaaaaaagcaaatggcgcctaggcatttccgtcgtcaaattccctcagcagtcgaacatccgaaagcatggctagtcgggatcgtgcggccgctggttgatagctcaggagcaaattagctttgttttgggtatatgcgtctagcgactttcgatgaaatgccaaatgtcacttacgtatcgttcacttgcaaacgcttcttctgcttccacaacaatccatcttacgcacacccccgacgtctagggcccttccagaggcgtgtcatctagaacaccactgaagagaacccggcgccaccccaatcatcacatattacagtccaaatgaccattgaatgcctctgtccccagtaacatggatccaatcgaatcccaggagaagatagcattgtcgtcgcccaagagcggcatcgacatcaactggtctatgtggccgccattagcatacaccatagtcggatccatctgagccacgctctgatccgtgagggggtccatgcccgctccataattttggaagggcatgttaattaaacccatttgagacacagcgagctcggtgctagggcctagtgccacttccataccagaataaggagcagttatctctctcatcgacgaaccaagagggaccagagcattttccgagactggttcattgttgaccggatcatcgcggactggtggcggttgagcgggggccgacctttcgttaagcagcacgtcaacgtcccgtatggcgccggtccagcgaagcatggtagcaggcatcattgggttggacgaatggcgcatgagcatactcgcacagtcgtggagcaacgaaacatccttgtcagtgacagtcttgtcgctgtcgggccgcgctcggtcgcacagaatactcaacgtcaagaccaaagtcgacgagtacacgtaatagacgtcccaccaggtcactgggttgaatttccccagttcgtccagctgcagcagtagctcacaagcctttctaccagactcgcaacaaaccttggcattcgctttgacctcttcatcgttggggttagcttctgagttctgcgatacggaggcaaggagttgcagcaatgcacagcgagtgagcaaggatacagtataatgatactggatgtgtaacaagagaacgggtctcttgaagccatctggcaaggtcctcaatacgctgagagttaggtgctggggtagggaataaagccaccggcttaaatcccggagcaacccagctgtcggggagaggagacctgtgcgaccattctcgctcgtggcagttggtaaggcacggcatactaagcctaagatagtaacaagccgtgcggaccagagtgtgtaggtcgggggccagttggaggatcccataccaaggactctctcatggggcgaggtagtagaacacatggtgctatcgatagcactgggccggtcatgggaagagacctggatctgctcgaaagcatacagtgtccaccacagtgatttcctgagctccttagccagtctaggtccctcacagatgatctcgtctcgatggagtccaatggcgattgcaatgcgggccgctgccccggtcaaggtccagcaggcatcacgatgattcgtgttatgaagatgcaaagcagccagcatcaaggcctggaccgaaaggatattgttggtgaaaataattgtgggcagaagggattccacgtgggtccaccatttttgctgctgggtctccgttgtccccagcggactaattcgccgacccagaagcaatacgcacaacagttcacatacccacgctcgatcaacggattgcggggaaagtcgccacacatcgtatatttccaagaaagaggcttcgtggaggaccgggaagtcgatgttgacgttatcgaagtaagctcgaatgagcccattgatgacggagcgatcgagcaaaggagaaggatattggacagcattagcgctgacctcgacttgttggggttctgctactgctcgaatatcggcctccgtgaggatctctctagcatatctcaaggtgtcctcggaagggttgcggccaaagaggtacatctgaaactttcctccctgggcctggcgatgaagccccaagagggcacggagcttcatctggaaaaaataggagctcgcaggcccgatatactgttcctggccctccatgtcacgaaccagctcctcgttcttgttcgggtttgcttcttcgcttgcttggatcatctcgagcaggggtggatacgtgttatccacctcttccggaagcttaatgcctaaggactgtccaagttctcgcatgctctcaatggaattgaggtctgcactgggaacaagcccctttaccagcgcctcaagcagtgcaatcttgtaacgcacgagctcggcgctgccatagagccgttgctttcggggcctggtgaccttgcagccatagttcatgcgtatgcaatgctcacagcggtcttcatttggaagccgttggcatttctgctttcttgatttgcaacggtcacagctgtgctccgtgcgcttccgttgctcgggtggaactcgtcgatctgactttttgcttgttgtggccatctttggttgcggattgatcaaccgggagatcctccgggagggctgaatggaggagaaggaggagttgcggtctgcatgtagccggtgtgttccggagggattgattatgtattctcggaggtgggtgactattttcgagcttgacaggggtataacagactataacggacggcgtgagctacaaattgctggcgatatgcagccacggccttagcgtgaacgaccggtccagatagcgcgggctcgagattaagcccacgcacaaaactggcggcaagcatgcatgccgtccagtctgcacgttcgcttttcagttctgacagcttccgaagatctcttatctattactactactacttctactcgcgacttgactccggattttgcctctggagctccgcgtcaatattctcccccgcgatagcgtctcggcgcttgccgtgacgataaatttctgaagaatgcccccctgtcttcttcttccccaattatccagcaagagcgcttgcttggtgtcaaaatggcggacgtaaaggagcttcaatctgtggaagttctccaagaaaagtccatgtcatcgggggacccggaggccaatgctagaatcaagaccaccgcacaaggcatccctctggtcccccagcccagtgatgatccagaggatcccttggttcgttcgctgtcctcacagaaactactgatcaatgatgtcctgacagtagagggatttcctatagaattggagccaattcaccaaaattgcagctcttatggtcctcgcgttcgaatcattcctggtcaaattctcggccacgttgattgtaggtctactgaactttcctactctttttatctcctctcctaatagatcccttaggctcctgatgcattggagctggctgaagaattcaatgtccccgagacaaccgcgacgtacatcggatctgtaccttccatcttaaacgcaataacctccttcttctggatcccgatgagccaccgaataggtcgacggccagtacttctcattggcaatctgatgaccttggtcagcgcgatcggggtggctcgatcccagacatatgcgcagtgtttagcttgtcgcatgctcatgaatgtaggtggcagcgttgggttgtccatcggacccgctgctatttctgatatgtttttcttgcatgagaaggggtcgcggatgggtgtaaatagcattttgctcgttattagtccgtatgtgggcggtgtcgctggtggctcgattgcatacaataagagcctcggatggcggtggtccatgtacatcgcagccatcctgtacgccacacaattcgttgcccagatcttctttggtaagtttaactctgtttatctgtggcactttggggtctagctttactaattgctttttttctctcacccttcagtgcccgaaaccatctatacacgaaacgagaaaaccagcgccgagtccaagccttccgaccggaagaagtccacgttcctgtcccgcatgaagtttcgcaaaccagtggtccccaaggaagagacttggggccaaaccttccgcaagccatacaagatgttcgcttatcccgccgttgttcttccgtctttctggtttggcgtcgcaaacatgactgaagtcggaaacacggccggatttgcgctcaacttcggtagcaagagccgctttcactttaacttggctcaagttggcttttgctacttctccggtatcattggtgccggcattggtgagatttttggtgggccactctgcgatatggtcgccaaatactccttacgacgaggtcaggagtggagaccggaacgtttgcttcatcttgcgtggtctgctctcatcaccatctcggtaagttgaggttttgaaggaaaagccaaaatacaaacaataagcctgacatacccatctaggctggtctcctcctgtacggacttgaactcgaatatggtgacagctgggctgcagccctcactggaatcggtctcttcactttcggacaggaagtcctcgtcactgtcctgttgacatacatgacggagtgttacccggaagatgcagcagaggtagctattgtcttccaattcttctttgctgtccagacattccatccccctttctatctccctcagtggatcaagcaacctggtggagccaaggtcccgtatatagttttcgcagcactaccgatagtgctgtatcccttctgcatctcgttgttcacctggaagggtccgcagatcagaaaaagaggacctttctttgttctatgagttgtatcgggcatgtcttatgaataacttgcttgcatttgcatgatacggtcgtttcggcttttgaattcgcattggatcatgtgtcatcagggaaagggttaaacataaagagaaaggaaagccggggaagaaaaaaaaggagaaagctcatgatcgcgcatttgcaggtgtcttacgactacggtgcatatttatcttcttgcaataatgaatctatggtgggaaaaatacgactcagatatcaataggattagctgcatctcaaaatgataccttctctatggtctcctagacatccaagacaatcctagcatttccaacccgattaagcacatcctacaacccctttcccgacctctagattacgagataaaagacgaactcactcacaattacggctgatgatttctccgctaggctatttattatctccgagtccttgactagtatgtgggccttatggggtcggaggagatcaaccgttacggtctcctcctcggggatacggataactcggtccggcgcgctcttagggcctcgcgtttacccacacagtctccagttgtctgccattgtggcgtccagggttcgccttggtggtagagcttaattgaaccgtctgtgtaggtagggatttcgttgtggcatgggtggttgtgatgtggatgaacgcttggtttctgccgtgtacggaacaatagtatctgatagcataccactatatatttatattacagagtttactgagttacccaccacaaataaataagtttatagtgtacctacacccatgaaaatgtttcaaaagatagccggaatactactaaacagtgtatattgtgacaactgtcgaaataatcttcattgatacttgaatggacgtagagattaagttatcgcggcatgtcgagatccgaagctgcattagcaagctgcgagatgggtaaatctcgcatcagcactggatggactattccttgattggacctcggctagggatgtcggtcgcacggttcatgtattgtctacgcagatatagggtaaggattgggtcttaaaggagacgcatgcatagtatgtaggacctagctgggaagttctggatgggacgggtgatcgaggtgttgattgctatatatattttatttatatacatgggcattatgggttagtagcggtgcattcagcgttattgttgctaccaaatttgccgctgcatatctggagacaggtatatttactggttccatatgcaatccagttggaacggatattggttctggtgtgagggggaaaagaaaaaaataaaacaagcttgtagatttccgtctgttagcataagcttctcaatttcttctttatatgttttacaatctatatacaaataatactgtctatatattgtagtgaatcatgtttcagtgtatgtgtatcagcagaaggatattacatataatagaacaaagtatactgataattgaacacgcagaatatagtgaagaattggacaataatacattattggttttattgcttacgataaaatggaaccatccactgagacagacctgtgctctggtgttcaatgtacattagaacggacataaatttgactggcttaatagaacataaagttcggccgaagggtattgatatttatcgcacagcatgttctagctttacaccgaatagattaggccaaaacttcaaccctaatcctcgcctcagcgatatccgactggaaccaaaacccgatatccttcgtagtatccacgagctcgacttcgcgtttcacgaaccccagctccccaggcaccttcccctccggctctttagcatcatcgatacctccctccccatcatcttcactatcccagccctcatcatcctccatcttctccttgcttactgggtccagctcatcggtctcccagaccaacctaaagctgtagggctgtagtccgaaaagtcgagaaacaatagccttgacttggtatgtatcgaacgaccgagggacttctttagcgttgatagaacttccctctcgggcgacaacctcagtctgagatagatgaaacaccaacttcaccagccttgcagcaacagaccgcgggttcacagcagcaccgccagtcccggactcggccctcctaatcacaggctgaccatatagatcacatagctctgagtatctaggatgcttagcaaggatgcctgcttctgcggtctccggggaagcggatagctcctttccaatgagagagagatagtacaattctccattattgcggtccttaggtgtgattttgccgtagttaagcattcgtagagacccaatgcgagatagcgtcagcatgtacgcttcatccactgtcatgggtttctcgggcacgcctgtgatgtgggatgggccgacgggctggtcgtacagcgagttggcggatattcggagggtgtctagacctgggaatagagcggggaggtggttgatgaagtcccatgtggtgatcttgtttcgggataggtcgagagagtggaggctttgggggaattggagggctgtgtctgaggtgttatttgtgtcgtagatagtggagatattgtttccgcggagggagaggtgctctagtcttgagagcgaggtgagggatttgatagaggatagggtgttgaggtcgttgttttctagggtaaggcgggtgatggtgttggatagaggagttgtgggcattgagagttggttcgctgaagcagagagtgtgctgagaacggggaattgatacgtcaatgctgatatctcctcccatgttagaagtgtctcgtcaatatgcagtgctgtgatgccctcgaacttcaacccctcctcgagaggaccaagccggtttcctctgttgccatgttagctcaacccaaatcaagaaccacagtccaagggaacctacataagcttcagcgccttaaggaagttcaaccgctcacaaatccgagctacaccaccccaagtcgtcaacaagttccggctcagatccagctcggtgatctgtgggcaagtctgctcgatttccgcatacgcggattcgatctctgtagctgatgcatcatgccccagcacacccgcaacttgcaaaccatcaagaagcacgatcttcagctcttggagcctggcaagctgcttccggattttgtcgaagccgacttcctcaacgaccttaccactgatctcgatgggtttgtgcagagggtcacccgtggtgtcattcccatgtgcttgcctagcaatttcttgctcgaggaactcggaagcgtacttctcgcgcagggcctcgatgaatcctcgaggtttatctgccgggcgagacggacgcacgaatgaccctgccgtagggtgtttgcttttgcctgcaacatgtgagtatgcaatctaactaatatacgaatctccaagacccaggagagaaagaggatacttacaagtgaaatatctcaccccgcgatgctctcccgaatgcttcccccgagtcgggtcatcccattcgactcccaaccattctccagaggtgccctcaacagtacccacgtagcgaacggtacacaaatccccagcataggaccgccgttggcctacgtgcgcagcctgcattctaaaatcgccgagaaccgtaactcataaatctacagctccgaacaaatacaacgagcgtcccagcatgtgacggatttcccactcgccccgctccaccaatcgcaacccacaccccgcttacataacttgttctgcctgaggcagaagctaatccccaaatcggcgaagcagaacttcctcgacactacgatatcatcacctcactttccactgctgtccatctccacaaccacaacccggcagcatggattaccaggtaagcacaattacattctttatatacaaaccacattactaacaaaacccccctaaacagaaccgcgccggttccaaatttggcggcggcggcgtcgcctcccactccgcaacgaacgccgaccgacgcgaacgtctccgcaaactggccctggaaacaatcgacctcgacaaagacccctacttcttcaagaaccacgtcggcagcttcgaatgcagactatgtctcacagtgcaccaaaacgacgggtcctacctagcgcacacgcaggggcggaaacaccaaacgaaccttgcgcggcgcgcggcgcgcgaacagcgcgagggcaagaaccaagacccgtcgtccattcccggggcgatgggcgtgcaggtcaagaagcagacgatcaagatcggacgaccggggtacaagatcacgaagattcgggatccgttgacgagacagctggggatgttgttccagttgcagtatcaggagattacgccgggagttacgcctaaggtgcggtttatgtcggcgtttgagcagaaggtggaggagccgccggacaagaatttccagtatttggttgtcgctgcggagccgtatcagacttgtgggtttaagttgcaggcgagggagattgatcggcgcgagggacggtattggacttggtttgatgaggatagtaaggagttttgggtccagattatgttcaagacggagagagaggagaggttctcgggtgtgccggggttggcgcctattgaaaataaggcttgatttggggccttgttgattgtgttttgaggggatgggagtggtgaatgttctcattgttgctgttgatttcctattgaaggtcggatctggcgtttcatgggcttgctttgctggcaaaatgttgtggctatcgttctttctattctactgctgtgttatgcattagggtggcttcgcatcaataccatgccctctttttacttctaatgatacgatttaccaacgattacagctctactagaggagaccaacctctaccgcaatattgtgcattggctaaatgctaaatagctacgaaacacagtccggcattcgcgggcttttctaatacatgatatgatatccactcatatgtatccccggttagatacagtcggtagctagcaatcgtcgtctcgcgacacggatgcaaaatcaagaaggtaataggaaatgaacaatgctaggtcgtgaccaactgaggcgaaatgtcaaatgcgctagatgctggatgaaactgatgcacaaggggatgcccgagaccagaacctaaatgcgccactgaaaagccatcaatgcaagcccgcccgctgtcggactcttcaatgacgtctatcgtgggttcacaaggacactcggatgtcgactgtatcttcaatttccctggaaggcgttgaacgctttgtaagtgtatccgataaatggaaggctcatctccgcctcctgctcgtccggcatggcgcgagcctgagcgcggtggatggcactcgtatcctcctgaggaatctcatcgatcgggaagtacgacacgtcaatgttcgagctcaatcttggttcgaacggcgcgcggatgctgcgcagttgctcccaaacgacgccgcggaagaaggggtggttcttgatctgcgttgcgccgccgaattggccgccatcgcttccgatacggtgttctgcgtcgcagaggaagctaatccgggattagcatgatacataagcatatgatgtgcacaaagcttaccttcggatgagaccctcggaatcgcgcgaaagggtaagttcctcggggaagtacaagcattctctccagttcacaatcttgcggtaggtgtcggtggtgtcttccgcgcagaacgggggccaacccacaaggcactcgaacatgatagcacctacagaccaccaatcgcacaggtaggtgtatccttggccgttgaagatctcgggggcgatatagtccggagttccgaccgtcgagtatgccattgcacgacgagactttctccaggtgttgatctggccacggttggagactgtcaggttgatcgcatcgttaaagtaaccagagttgcggttcttgtcctttgacgtcgagttcttcagcagattctgatagtaggagttgtcgtgggtcttctttcctcccgtggacagaccaaagtccgtcagcttgacgtgaccaccgcgatccagaaggatgttatcaggcttgatatcactatagacaaaaacaattagcacctgccgccccgtgaaacttcaactttgcatctgctggcagcatcgagcatctagtacttaccggtgaaggaagccgagcttgtgaacagcctcgatcgccatgacaatttcggccatatagaaccgagtaatatcctcggagaagatctcgtacttgatcaacatggtcatcaagtcaccaccaggcaagaagtccatcagcaaatacaagtaggcagtgtcctggaaagaagcatgcagcttcaccaaccacgggttgtccttggaatcagcaaggatatcacgttccgcgcgaacgtgagccagctggtccttcttgaacatctccgttttgatcaacgacttcagtgcgtaaatcttgccatcggtcttccgttgtaccagcttcacttcaccaaacgcgccctttccgatgatcttgatggtctggaagttctgcggggtctccttggtgcgaaggaaccggaggaaattcgattccttcttagcaagcacctctgcgtccttgcacttgttctccttgggaatactgggttcacggatcatcttgtccagctcagcagacctataaaaagcacccgggtcagcgataccaggttccctggtgagttgggaaggggggccgtggcattgtgtggaatactcaccgcatgttgcgatcgcgtgcgcgctcaatgttctcattgaagaagacgctgaccagctccttggctgccttgccacgcttgtgaacattctccgagtaacgttccgggtaccgctgcaactcttcgttctccgcgggggtgcgagggctacgaggcataggaggcgccaggtggcctggctgttgctgcccgggggcgggggagccggcagttcggggtcgctgggctggcgaggcagaacgagcaaagaaacccgagcgaggggagttcagatcctggttcgagaactgctggatcaaaccgttggtgccatcgttcgcgctgtaacccatgcgggattggtaggcgggctgaggggattgcaggttctggccataatgcggctggccgtaggctgcctgagcttggtaaggattggccatgaaataaccaccttgagcgtaggcaccgttctgggcgtccatgtaatcctggggaccctggttttggtagatcggctgggggaaggcggagggggtagtgggataggcgcggttgttggccgccgccgcattgaaaccacgatcattgtacccgaaattcaggtggagtcggttgttgttgttgggatccatgatggaaaactttcctccccgactaccgaacgaaggctaagggaaagcggggggagttgagaacgagtggatgaagaattgggacggagatgggaaaagaatccaagggggagggggaaacaagagcccgaaggagcggtggcctcaggaggcgaaggggcttcgacaggcactttcaggagcgctttctcgctgtccctgagattggcttagaagaggggggaaatgcagtggagaggcccaggcacaacaacaggctggctggctcttctgccccaatggcggcaagtcccgtaacctctctagtagtattatctgtcgggcaaccagcttgatgtttcaggttcagggccccgaattgaagtcagagacaggggatactatgatgccaaaagaaagacacgatgctactgcaaccactcaagaattgatggtccgatcagcacggggggaaggagggggaactacaaaaagggaccgatgcttaatgttccagactcgtacggcgctcggttggtgccacgaatgctgtctcacaaagagagtatttgctgcgaccatcttcatcttcactatacaagttcttcactggtttcaaaggggtccaaaaatagaggtctagtgtgtgtattccacactatgatagactaatgccataagagaatactagtgcttcagccatgatgaatgtcgactccaacagcataaaccaatcatggctcctacagaacattcgtccagcttgacaaattcagaagttgctatctagaactccaggagatcatctgagatccggtctgtttagacttattttccgtggcatgcagcactgagttcaaccggggtgcatctgctagtcagttaatctgctgctcctccagattccggcttcaactcggcatcctcgcctccggataaacctcgtcccgaccggagctgcgcagtgcatcccgaactttttcggcaatcatgcatttcccttcacgacatgccatgagggagtgcttcctgctccctgttacgtaccaaaagttttattcttctgtatctttattatataccccagattctattataccctttcccttcatccccctacactatggcggagtcttccaattccgccgcggcttcaggcccggcccagtccgcagcgtctaccagcgctcccaagccctccaacccagccttcagaatgcttggtatagatccccaatgccctcagccagtatccttatacctaatagtcttcaaggaatgccgaaccttcgcatgaaacttccctctcggaattggatgatcttcttcaccatcaccggctcgttcgccgcagctgtcatttacgaccggagagagaagcgccgcgcgcaacaaaaatggagtgatctcgtcgctcacatctccaaggagcatcttcccatcgagcaaacccgacgcaaaatcaacgtcttcctgtccgcgccaccgggtgacggtatccgcgtagctcgcgaccacttcaaagaatacgttaagccgatcctcgtggcagcggcactagactaccaaatcatcgaaggcagaagggaaggcgacatccgtgctggttacgcggagcgcattcgcaagtggagacgtaaggcaggcgaaccgagtacggtggtggaggaccccacggtcgaagatgtcgttttcgccgcgaggacgcagatgggcgttatagaggagcccggaccgaagggtgatttggtcatcggtcgccacacatggaaggagtatattcgcggtctgcatgaaggttggctgggtcctcttgatcctccccctccgcctcctgccacggaggatcccgctcctgtggaatccagcacacccgccgcagagaccgcctctgagaccaaggagggcgacgccaacgcccccgagcaggaaaagaaggaagagaagcctgctaaacccgtgggaccgacaccagcttacatctccacatccgactactcatcgcaacccctcccgcgtactatcccccagactctttcaggctccgttcccatcgccttcccccacatcctgggtttcctcaacacccccatcagactctaccgctaccttaaccagcgccacatggccgagagcgtaggccgcgacgtcgcagccattgtcctggcctcatacagccgcccttacaacaccggctccgtctcctcggatgcctcccccatctccgacgatacccttggcaacaccacctatgaacaacagaccgtcctcgaggaggaagaaagggaatggcataagtccgtccaccgcaaggacgaagccaaccctgacaaggaacgcgagtggctcgacgacatcgtcatcgatccgcgcctcgcctcccgcatgcatcgctacagcgtctcgcctgaggaagaggcccgcgctcagcgcatcctcgaaggccaggaatacatcctgggtcaggaacgccctgttcctgtgtcgttctggaagcgcatgtgggtgaagtatggatacggagaggatgaggagacgttgaggaggaagcccatcttgggcaaccttgatgaggagtaaatcacttgtcgagattgatgtacggggaggggaggatattgtcaccataaatagaaagggtttcttagatctctatccgtgtttgggttagaggtatatagacatattcttattttttgtctttggtattttggggccgatacgatcattgcatgggaaatgtgttttatcgggatgtatgggtatttgtactaacaactattgacatctccttatcaactgtatattagtcgaatctaagatgatcttcactggtcaggtatttcatgtctagtgtagatgtatcactcgaggatgcaacctccctacaagaggctcatcaggcattgaaggagcacactaatcgagtatcatctctcacgtggaaggcttcccaactaagctagccccagacataccgttttgagtgggctattctctatttcagatgtctaatacagtacgcctcgatgcatctcggaaagcattttgctgtatagttttcgtctcacaccacatgatacccgggctttttaagtacaggtgaatatgtacacccaggtaaaaaccagctacagctacagattcgtagctgatcaattctaaggatagaagaatgggtaaggataaggagaaggagaaggagaagaggaagaagctaatgagacaaggaaaaagtcctttccgccaatcatgttacagtggttcaaagtataaggcaagtttgaatatgagtagtccaagaaaagctgtcctatcactttagtcgaggcggaacaccgtcgcctcaggccacttgctgcttgccttctcgacataagcagactttgcggcttggttgcttccccactcacccaggagctctaggcctgccagggcagtgtcgatggtaatgtccttggagtcgagggtggcgatgaggtcctgctcgcattgaggcttggactcgggcttcagaagctggcggctagtaagaccggcttgttggtgggagacgctctctttgtgggtcgagaggaaggtgttgttatattcctcgaggttctggcccttggggagcaaggcctcgaactcggtgttgacgacctcagctacttggggcgcaagtggctcagaaaggctatccagggccttgcggaatcggaggatctggacgtgaagggtggggttggatgcgtcgatggcatgggccgcggtgaggcacttgagagcaagtgcgtgcttgcctggggttgcggttagtatatgtcaatgacttgtaagagggcgaacatacctctcctgaggtaaacgtcgaatccgagacactgggcctctatgttcttgggactatgctccagcaagtgtgtcaggaacttagtcgcctccttgagcggatcttgcgtctgggcaagctggttgcctagtgggtcagagtcttccttcttcacttctccgtcaatgttcttagtgcttgcggcctttctggcctcacgcttctcggcttcaagcttctccaggcgctgctgctccttcttggccttcttgactgccttcttacgttcctcgtcgttgtcagcagcggcgctgggcaggggtccgtgagccaggtcgggctggtcgtgaaggaggaggtaagacttgatggcagaggtggccatccgggtgtagaacgggtgctcgcgcaagcggtcctcccagcgaaccatgtccacatacgcacggatcatacccttgcgaagggagaagctgtggaaatcaaattgatcttcttgccaggtgtcaaagatgttgtagacagcatggaatcgcttcagcgcgagaccgagcttcttctggcgcaggtaggcctcgccatcctcggtcaggtaccagacacattgcatctcatgtagatcacccaaagctccaccaacggtttcgttacgagtgaacttgctcatattgtcaagagccttgtcgttctcgttgttgcggagttgatatttggcagccttggagttgatgtgacggtccttttcatccaacagcctggccttctccatctcttcagccgccttctcgaggtttccgtaatgcttatatatccgggccttggtcaattggtactccacagccttgggcgatagctcaagggccttgtcgacattctccatggccttggacaagtcgcggctgaggtggtagttgtagtgctgagcgaggaagtagtaggaggaagaaaggaactcagtgttgtcggcgccggactgaccttccgcggagccattcgaccggggcgtcgtcgcgacgtagccttcaaccagttcttgcactgtgtcacgcttgacggggttgctgtacagtgacttgatgttggcaaacagtgagggaacacccttcttaagcatgcgctgcaagtaggcgtcggcggcctgcttgaagtcatcgccctccaagaagtccaaggggattctgcgagccgcatcaccacgggggaacttctcaacccaggagtcatatacggctttcttggccttgtggtcatcactagggatgtccttcgcccggaccaaggcatcgtagtagagcgagttctccgggttccggtccagaagcgcaatgtacgctgcctccgcttcggcctttctgtccagtcgcagaaggtagtccgccttcatctccatcacagcaagcacatccgaaattctgtgtcccaccttctccagatgttccagtgcctgttctaccttgccggcctcagccatgatcacgttcttgtacagaacggcctcggaatgctccatatccgaagttggcggggggatctttagcgtctcctcgtaagtcgtcaaaaccttttcggcctcttccagatccccagaaaggtggtgtgcgatcgcgagagcagtccagttctggcggaatcccgggcgagcctgcagcatggctttcctgctctgaatgtagccttggtaatcgcgcatctgcatttgcagcagcgcaagatcccgctgaatgggctgtgagtccggctcaatcctcaatgcaaaccggtatgccttgattgcctcttcgtagttcttgtccgcccgatacagcaatccgtacacatgccagcagatgtgcgacttcatgtcgttcttcagggcttccttggccagcacaaaagcctcctcctgctggcccatgttgctcataataagagccttcatcgccaaggtatcaccatggttggggttcttcttcaagatctgttcggcggtcttgatacctgttcggaacatagcatagtcagctttcctgcccacttgcggagacctccagcgtgtccaatcgagatcgcaaacgcacccttcttgtgttgcttgttctcataatgacgaaccacttggcggaacaaggacgcatccttggagttcaatggttgcggcatggtgagtgtggttggccggtggtggtcagtgaaggacttgccaagtgactgtgcgaagacggaagctcgaagtgcgcgggggaggaatgacgatggacgacgattagtcgatcaggcagcgataagctatgaccaacactccgacagtatgcacgtcctaggggatgttgaaattatacttggcccctatccaatcctctggttcacccgttcgagcggcttaaatagtatgatcaaacgatcgcttttactcgaaggttcttgccgaccgccgtcctcgagggctgcccggcaccagacgaaattattatccgaagcggcctgcagatgcaacctggcagccctgatacttaccctccatatgcacccaattgtcggcaagttacatcgctaatgggtattcacagcatacggtctggtctggtctggtctgttatgttaattgtaacaaacggtagagtacgcgattcgagccaagttcatgttttgatttacacatcccgcctgggctcccaggtccaaccaagaaacgcctgttatatgcagctatcttacaacatcatatacatagcatgtccagtctcatcaaatcaggtcagtaaccagacaatatgcagctggaaacgatacctctaaggagtggaggccttcaaccataaccgatgcggtgactactactcgacccagagatcaaatcactctgtcgacggtggcgcctgctctcgttgtttattctcacgccatttgttaagtgcctcttcccagccctcggacgggccaccacacctttccgttaccagaccccatgtgcgcgcgcgtataatttcttcgaccccccgttgagtacggacaaggttggccaacgactcagtccgtgcctctcgaggcaaaaaccgggccgcatatgggtctaaacgatcatcgacaatatgctcgcgatcctccgcagattcggtctgttgcagaatgagatccgggtcttccgggtcgggacttgtggccaccccggcgcaatagttgagcacatccgaacggacttgccatgatggaaacaaaaccttatccttaaagctctggcaggcagctggttcgatttgctttccttcactggcgtctatttgtcggatagctgtggaagagggatcgaatccttgtcgagctggggtgaacaaggcattgaggttttgcgtgatggaatcatcaatggtcgatctagaaattcgtagaaaatctgtaccgcagccaggataccccgggtcagtccccgcgcagttactctccgtggacttgacggtggtcgtagctgagcatacctctaagcaacctctcgttgaaacaaaattggggagtcagctgaggagctgacgttgacgatgctcgagacattttcctgtcctccacctttccagagtcactctctgacctggaagtattcgtccagaaccactccaccttggcagctgtacaatatggaaccgcggccagcggatcgtatgactgcagagatgaagtcctgataacaactatcctgctccggtaaaggaggaacaaggcgactatcctagggctatagtgacgtccaaaagtgccagggggctaacagagaagtaatgcaatgacttcaacaagccaatgttaaagttcccacgaggttcggctggcatgccgtatttcgctcttggaatcctagtatattaccagaataggttagcattctgaaatcacgggactacgtgatggtcgacgcgcgccacgactttctgattcagcctctgctcgagccgcgttatttcattgaattgactctatacactttcttgaggctattctggagcgagtattgatttgaaggggtaagaatccacgccatcctattccattttgcgacagaaactgtcaacatcgaacaccatgccggagctagcggaagtctcgcgtatagtccatttccttcgtcaacatcttgtcggcaaaacgctttccaaggtgtcagtgcaaaacgatgacattatctacggcaaagccggtactactgctgccgagtttcagaaggcaatggaggggaagaaagttactggtgccggacagcagggcaagtacttctggattgctatgtcatcaccaccccatgcggttatgcatttcggtatggcgggctggctgaaaatccgggatgccgacacctattactaccggacagacaaacctggagataaggagtggccgccaaaatactggaaattcttgctcgaaaccgagggagatccaaagacagaagctgcttttgttgactttcgccgactgggcagaatacgcctggtagactgtcccgcggaggaaatccgtaactacagccctctgaaagagaatggcccagatcctgtcgccgataaagacattgtgtcggaggagtggctggcaaagaagctccgaagcaagaaggtacctgtgaaggcgctgctccttgatcaagcgaatatcagcggaataggcaactggatggggtatgctccttcagtctcccaccatgactgattacatctagctgactgatttctagcgatgagatcctctaccaagctaaaatacaccctgagcaatacagcaacactttggatgacgaccagattagagagctgcactcagcgatacattatatctgttccacctccgtagagcttctagcagattcggagaaatttccagctgactggctgttcaaacatcggtggagtaaaggcaagaagaacacgccatcagtgctgccaaacggagaaaagattacctttctcacggtagggggcaggaccagcgcagtggttccgagtgtgcagaaaaaaactgggccagtagccaaggacgtcagcagtgaagacgccagcaatgcgccggcaaactcgaagcgaaagcgggcttcagtgaaaaaggaggagagcgagccggaagctagcgaagaggatacgaagcccaagaagaccgggcccaaaaggcaaagcagaacttctgtcaagaaggaagacatcgatgagacagagactaagccgatagaagaacagcaaactaccaggagacgctcggaccgacttcgaaagtaggggattccgactgttgtattattgtggccatcttagcgacgtattagaagatgcgaccttccgctcattattatactgattctttatctaatattatataccacttttcctagtttacctgttcataccttcagtccgtgcagcctttcccggaagacatcaaaattgctgtcaccctgggcaactttggacatgtcatctaaaaccgcaaatacaatcttctcccaccatccctgaaattcagtttcccgcaggacctcggaccaacattgcgcaacgtcaacatttgggttcgcaaatgcaccacaacctagagctcctaaaacaattctccgatgcttcttataccctgcaatgcggaggatagatcgcatcttgtctttggtcagttctcgatcagaacgaaacttaaaagtcggtggagtcgccgtatagtccacctctggtccttccagggcagcaacgctgataacgctcacaatagggagattctcaggcttctgcaggtccatcagcccatgacctcgtgtgaaactttcacggaagataacgacggatggagaatagatggcatctcgttctcctatcggatagtatcggtgtttaagggtggagctgaggctgcttcgataacaaagagcctcctcctgagccatagctccattacgccaaccgccgcctggattcctttcattggccatattcagaacgcacacattccgtgtgtcagtctgccggaattgcctggatgagctgttaaccctaatggcgatgtcgagcgtatctccaaatatgacttcgacatgggttgatagctttgggctgaaccttgggttcaaagtagcatatttgatgcggggacagtactgtgctgtcggaggtgcccggggcaccgtacttaaaatgccagggagaagggcttgagtctcttccgcggttgctctcagtattgctctcctatcggctccggaaataggccgttgtcgcacattgaccggtcgaaagtagtccggtaatgtcttttggctcatcttcagagatgccgcctgctgtaaaacaatgtaagttcaatgtgagattgatctggctatactttgttaatgtagcgcgtcgcatgacttgacggtaagagcggacttaggcagcaaggctgaaagtaagtaccaggtgcctagtgagcggccaggcaaatggaaatccgaggggcaacacgaacgagcggcagaacacgagtatctggcgggcggtgccaaaaggcggtcaacttatcatcgccgatcgcggggctgccgataagcatccagtaacatcagagttcgtcgccactgcagatgacaaagcatttgtctttctttcgatcagtgtcactgtagcatttcttctacctgctctcttaatccatgcacacagaggtcttgcacattgctttgaacttgacgtcgaagccttcacattgctaaattaccacggtccgagttgcagcgcagacttctgagcccgctgcggagtggcgctgcaatacctgctcattcacctaggagtcttcagctgccgctacaatgagtgcaattctatctgcagacgatctgaacgacttcatttcccccggagttgcgtgtatcaagcctgtggaaactctccctgcgaaagatccctcgaaaacagacgtaagtgcttgacctctactctgcttgtaccccacttcatccaatgaatgagcactgatttataatctatcagaatccctatgaggtgaccacagaagacaaagtgcaaccagaaaatcttccaccggctcaaatctcgctaactgactgcctcgcatgctctggatgtgtcacttcggccgaggccgtgctcatctcgttgcaatcgcatgcagaagtcctcaatactttggacgcgcatcccgagttgccactgaaccgtgaagatgggacaattacacaggagctgggcacggcgagtgacgaaggccgagtgttcgtcgcaagtgtcagccctcaagtgagggcaagtctagcagcaacctatgggatcacggagaaggaagcaacatacatgatccaccagtttctcagcggtcctcacggtttaagggctggaggcaagaatggcagcggcttcacatgggtagctgacaccaatgtccttcgtgaggctgtgttggttcttacagcggacgaagttggcgagacattgacgaccagtccagattctcctagtactaacggcgcaaccaatactctccccaagcgaccgatcctctcgtccgcatgcccgggttggatatgctatgctgagaagacacatccatttgttctgccacatctgtcccgcctcaagtcaccgcaagccctggctggcacgttcttcaagactgtcctcagcaaatcacttgggataccggcctctcgcatttggcatttggccgtcatgccttgcttcgacaaaaagcttgaagccagtcgcgaggagctcactgatgcttcatggctgtctgcgaaggacgaagaccatacagccgtccgtgacgttgattgcgtgatcactacgcgcgaaatgcttagtctggcttcttccagaggcatttcccttcctaacctaccgttgaaatcacttcctcagtcttatatcccgccatttcccgatatgactctaaacgactttctattttcgaagtcttccccgggacaatcagctgccgcaggtacatccggaggctaccttcaccacgtgcttcagactttccaagcgcgtaatccaggcagtgagatcgtgactcagcgtggaagaaatgcggatgtggtcgagtacacgctcatgtcgtctgagcacacgcctattctgaaagccgctcgctattacggtttccgcaatattcagaatctcgtccgcaagctgaaaccagcacgggcttctcgacttccaggcggtaatcgacgactgccagtcggacggggcgccgcgtccggtagctctggcacagactacgcttatgtagaagtcatggcatgccctggaggctgtactaatggaggaggccagatacgcattgaagatgctcgcgaagccagctcgagcgtgcagtcctcaacgtcggctgaagtgcccgactcatcgtcgaagccgacaccacatgagcaacgcgcttggcttgcccgtgtagacgaggcatattattctgcggagtcggacaccgagtcagaagccggaagccagtcgcagccgctatctattcttgacaaagaagacaaaattcacaatgccatgcgttattggtctgactccatgggcatcccgctctcgaagcttgcctataccacatatcgcgaggttgagagtgatgtcggcaaatcccagcctgctgcgaccgatacaactcgcgttgctgagcttgctgggaagattggtggcggttggtagattcgtttgttttctttcattattcttatgacatataccctgtgatgtttggatgacatgagccatgcgtgcattttcttcatcgggacaacagtctgcgcatttggactgcacattatatagagagataccatgttgaatcttggtggcaatacaataagtcgttggagatgtacgttgtgtcttatagatgactgcgtcccaatcactgagcaatcagtcgtaccccatgccaatgacaaatgcactgtatataatctccatcctgataataatcgactgaattctcaaaaatagctatggtcccggaataccataaaatgcataaacccctgcacaacccaaaccgcttactaacatcccaccaaacccaacttatccacaaacataactcttaccacagccaaccacccagcctaacccaatcaagcaacgaacctccaacgcaaaaaagttccagaacaaaccaaaccacccaaaccttccatcatcatctatcccacgcccactctacctcccaaccgcaccgaccaaatcctctctacacaccaccttgcagaacccggccacccgataaactagttactacactacaatccaccatgtcccgcgaacaataccaagtccccaacctgggcggcggcgcccagaacgccttcggtgatgccggtggtcccatggacggccctgtcgtcgcgtacctgtgcggcgagtgcaactctcgtgtttctctgaagaggggagatcagattcgctgcaaggagtgcggtcatcgcgttttgtataaggagcggacgaagaggttggtcttttcttctctttttttcccctggggtgtatgttacggagagaaggaagggaattcgggaggagaggtgtgaggatgagtttgaatgaatgcatgctaactggtttaccttgcgatgtgcagaatggttcagttcgaggctcggtgatcgaatagaaagtctgaatttgggttgcgctgggcttgcgggcctagtttgcttgtttgactcatttatgatggggtgggtgcatttggtggcgcttggagtttgcttttgtcgtcatatattatttgtgaaaatcattgtcttgatgggggtgggaggtatgagtggagagttgggagcagatgggcgagtggattattgtcaagtgatgtaaggaaatacctctccttccttggtccggacaattatttcagctatgttcatagattcattactcgaacttcagttgtcgtaaacagtactcgtttcgatggtcacggtatcataaagtattcactactacccagaaaaaattatagccatactgttgttctttcaacaagttggcctatacttttaaccataggaaaacccgagaatcaagaaaggaatgagtggttagtgaaatgaccagctttgtgataaactaaagccggttcgtgacttcaatgaaatgctcaaaggacttgagagcagcgccgctctcaatggcccagcgagctcgccggacaccttccttccagcgcccgccaccagggccgcgctcggtgatgacctgaccgtcgtcgccaggtcccatgttgctagtatctgcctcacagatacccgacaccgtcaggagggcagccacattcaagaggacgaagctcaggatgggatcatcccgaggcaactcattccgcagaatgctcatcagcgtggctgcgttgtccttgggcatctttttgccgccaacgtcggacagcgggtgagtcggcaggccaaaatcagacgggtgcaattggaacatttccatcttgaccaaggtgcggggatgttcctcctcatcgcacgaacaatcatcctcctgggacccttggtacgcggggttaggatattccgatagtcgccagcagtttgtcttccctgcgcagctgatctcgtccaagtcttcttcaccgcaaacaacaagcgccttcttgcatccgttctgtcgcaatgcctccacaaacaccggacccaagctctggtaggccacaccaacaacacgcgcctcgatagcccagtcgactgggttggcaaggggtcccatcaagttgaaaattgtccgaagtccaagtccacgccgaacagggtcggcgtacatcatgccgaagtggaagttgggagcaaacaggaaggagtagttggtctctgcatagacctggggaaggttttcagcgttaattgcgccgatcttcgggggcacaggagtaatggcattcaggacgtcggcggatccggagaaagaggtctgtgcccggttgccatgtttggcggtcatgaggagaggggaggcaatgatcgaagaggttgtggaaatgttgaaggtagaatgcatgtctccaccggtaccaacgatatcgcactagggaagcattgcagacgtcagctgtatgatctaattgagctacaggtgaaccaaaaagcactcaccagaccacccctgtaggttccctcttgctttacccgcgacttgattgcagccttcagcgtaggccggtcgacctggcgagcggcctcacgcatgcggtgcgagcacttggcaatgacttcagcatcgcggtccaatcccgtagaatgcagaagcgtgagtaacgctgctgtctgaatatgcgaaattccgtcttcaaagatcagcgcgaatgctgaggcaatctccgaagcttcgacccggcgttccgtagcggggtaggcgagtctcttgaggaggggtgaaatggagacatgttgcggtttctggtcgtgagttgaggcggacattttgcctttggtttgaatgttagcccaaagaatggaatcgcgcacgctcctatataagcaatgagtcacaactcactcaccgagctaccacgcttagctgcatgaaacggagggaagattcggacttcggtcggatgcccgctgaccgcagaacaaagagtcatctttgctcccggcagaatccccaccgcctgccagcccggctaatctgttttgggaagtcaagatttcgtgccatattttcgtccagccggacatcctccagcacgctgctcttgtcgccggcatcgccaaattcacggtcttggaggtattcgcccggtccccaattcctcgaggtactgcttcacgtccaattggcctttatccccgaaactcctcttccaacctccacaatgccgcctcgcgtccgcatctccagcggccgcatcactcagtcggtccgccgacaaagggtcgtttaccagcatgaactcccgattgctgccagatatgccagcaccgcagccaccgcgacgactccggctgcatcaatcgagcagatgacacactcccccgctcccatcgcccactaccctcccacgcagcctccctcgcaccgcaaccccgaataccgccggtcccagctccttcggcaatacacttccatcatccgcaccacacctctcatggtcttcctgcagcacgacaacctccaatcggtcgagtgggccgctatccgccgagagctgagcgcagccatgcagaaggtggatgagaagattgcctcggagggccggaaggccccagcactggctccgcacatcaaggtccagattgtccagacgcgcattttcgaagtcgcccttcgcatcgtggaatacttccgtcccaatcagaccaccccggtccccagagccgtcgaccctgccacgcaaacatcggccgaaatccctcttgccgcttcccgggatgaccctaccctctcccatgatctctcccgcgccgctcatgatgccgtcctgtccatgaagggcaaacatgagctgtcggagcttctggttggacctgtggccgtcctcaccatcccccacgtctcccccgaacacctgaaggccgccctgcaggtcctggctcctaagtcgatcggtcttcctttgcctacgcggaaggctaacccgggctggcatgagttccctgttcagaacggtctgaacaagttgtctttgattgctgctcgtatggacggacaggtcttcgatgtcgagcagtccaagtgggtcactagcatcgagggtggtatggatggcttgcgctcacagctcgtcatggctctgcagagcatgggatccagcattacgaatgctttggagggtgctggaaagagcctttactttacgcttgagagcagaaagcaggatatggagccgaagaaggaatccgaggatgagaacaagggtgactctgcttgaactgcctaaggctgttgaactcgcctggcttgccatgtataataaaatgtcgcgtgtattttcttttccccccttttccctttttgtttcattttacccttcaagaccatgattgttttagcacatgaagtttcattagaaccggagtcatagttctaggttacaaatacatacatactccttttggctgtattgtccgcttataaacctgccatcgtggcctacgttgagtatacagctattaatttattgatgcctagcccatgtatgccttttgttgagtcagtcaccgactcacagtgcggttctatgaacgattttagaaaaaaagggactcgaagcgggattgaagcgcaaccggacagtcctctctttcatttccaaccagccctccttattggttgccattgctttgctctgcatgcattaactgtctatgcagcagccgagaattcatacccacaatgcatcgtacaagatcccagtcaccatccaagcctacccagtctgtaacaaggacaccagtggaccaatcaccatcaccctctccatgcttcctacacagatactcaacagtcgcagggttcagcttggcggcaatcttctcaggccaagtttcgaccttccagaaattgctggcgctcaggaagttgatgtagaacggatgggctcgcgtggccaagggtcctgggagtaccccgaatgggtaccgagtcttgcatgcgcgcccacactgctctgtcacatattcgatcttcttgtcgatgttcgtggtctccatgacctcgtagaaatcttggatgcaaagctgcccactggggcaggtagcactggcgcaattatcggcccagccactggcattaataccccatcctttgccgtcatggatgtctttcaggtgttcaaggatttcgaaccgacggacaaggacaacctttccacgtacttcgcctagggtgggaatctttggttccgtgtaccatctgctcccgggacgggcatagtggtcgttgacgattctactcagctgttcgtcggtgtgatttccgggaccttcacgtttgagagagatgatgagcgtttcggaggggttttgctcaaggaaatcgttcacttcgtgcatcaaatcccggaagtacttgttgccggttagtgaaatggggaagacgctgtgtacgaggataagctcctctttcgacgtatcttccggatattgaggctgcacacgaatatcaaagaatcgaaccccgttcctgagctgttccctgggactgacggcttggcagcgaactgagggtgctgcaacatggcaggttggggagttgtgcgtgcctggaattgaaagagaggagagcaaggtgtcgtccttcagctcgcccatccaggcattcaaatttgccgaggaaaagatcgtgagatgagaagcagctgtgatgtagatacccgtgagcttgaatttggggttatcacacagcgccttcatggtagcagtctcggtggtgggcactggggtctggatttgatgcctttctccttccacctcaaagaaccagcgcaatcgttccttttcagactcgatgaacgagcgaagctctgtctggaccgactcgaagggcgcgacatgaatgtcaacgtctttctcggcaaaaggcttcgtatcatcattcactgcagcaactggagtgttcgcacgggtcgtattggtcaagacccgtgtgaaattcttcgcaaaggtttgaacgccaagcgatctatcgggggcacggaagcgctcaatgcgcttcagtgtgataggtgtagatgtgagattgcgaatggtaagatgttcggccaccatcttcttcgatcttttatggtgcacacgctcagatgttgagttgttatgcgggtcttgtctcggtggacggcgtcgtgaacacggcatttaggacagatctccgacggacgggaccgacaatctagactttatatttagcaggctggcaaaggggagctgatcccaaggaaaaaggctgaagtatcagcccgtcagggttaaattatggcccgtaattggtctgtttggattgggggtgcctggttgcaatggagatactttggaacactaagaagccccccgatagggattgcgccaatgaaggccggcacccactgcccatactgccccaggatcacctgccgaggcggaacaccggggccctgcaaagtttcctacgcaagcgcgaaccaggtcaagggtctgcaaaagcaagcgcattgaatggcttggagttggcaagtcagcccgtaaggccaatgtttgctattttggggccccgccgtcgctgagggcgtgctcgaagtggttaataatgatcagccccgcgtcgtaaggctctccgtaatccagatccaccatccgcaaacacatcccgcggctgaggctgacaatcgagaaaaacaacatgaacctcagagcagtcatttatacatcttggatgtatccattggcctgtatagttagtgattatctgctaagcagcgaagatctctgaagcctagatctgactgtatgctgtggtagagcagcaataagtatattctatgaatgggatcccgctgaaggcgaagacgttctcttgtagcagccatccggttgcttagttttcacatccactgttccaatctgaatttcatggaggacacgggttgaatggaagagaatctggagccgctacccctctgtggactggtatagatcggcccgcacgtgccatgtttgatcgcggaacaattggcagtttgaaatgcgggcggaagtgggaatgtggagtaatttcacagaataacataacctgttatttatctttaagatcatatcctagtatcttagtgggctcctctacagatctacgacatatttgaacggatatgctttccccggattcatgtagtcctctttgaccttgagctggtaacccggatggccatagatattcggcactgataaagtagcttattccggtgttcttagttgtattataaactggaggtcgtactgctattggtttcgtttcaccaggtagaaagttggtagaaagttagagaaatgattgaactcagtgacgatgctaactcgaagcctcctcggttggtggacgagtaccaggttactggatgtctccgtttgctaagtaggtaagctccgcggcgtctccgaggcatcggatgcttccacggtaaatgcctatctcattgttgttgttattgctgcaccctcccttcaatgagtagtcgtggcctgtttcttcgcaaagatgccagaatcaacatcagccaaacaccaccataaaataccgtaaatctgcgtttttgcagtgtctcatctacgcgcgcgcgtatcgagtgaatagattagggtggcttccaaaacgggctgccatccgcatgtacttaaagtacttagttggcttcccacctctcaccccgcctgttccctttaatacctcccagccttgtgacctctccgtctacactttctctcactcgtgttttctccagccttcaactaagtttccctcctttcatctcctggtcgttcaagcaaccaccatgggaacccggggcctcgtttatatccgctgccgtggaagatacttcgtctattacaaccaattcgacagctaccctgagggattgggcgacgccatcgtgaatgaaatacctgaagatcctgaaaaatatcaaggcaagtcaatcactctggctacatatctgcacacggctttcgctaacaactatttagaatggctccgattcatgcgaacagcctatgctcgacttgttgagcagttcgagacacaagttctcccagttaaggttcaaagcacccgagaggaatactcgagcgtggctctgaaagagcggtacgaacacagcttctgggccgtcgatgaccgactagaactgcccccgctacagacagtggtcccggagctgatgaatgcgtggaatatcgaatgggcctacaccctcgatctagaccgggaggtattgtcggttgacaactctcttcatctctacctagccagacttccccattcaggggattggatcaggtatcttggagtagatagccgacgccgtcgggcagctggtcggtgcacccctgaaggggtagtcgccaatatttgctggaagccggaggtgaacaatgcctccagagataggtatggccacttggacatccaggtcgctccgctgggaacattctacgaccagggagacatcacggatgcacgcgagtcattactggctgccactttcacgcgcatggacaataggtatcgacctgtcctggatgcctatcttccggagtgggatcccagttgtttttcattcagagagatagctttttccatactgtccatcgctgctggtgaaatgactctcgaatgcgctcagagcttggaccagaaccataaggcagaaggctattacctggctcggcacgatgtctcccctgaattggcttcgccctgttatctgccgactgttcttccacagtttctgcacgagtgtcacctcccgggcgttcagtcgggctcagcacccggaggcaagttatactggctcagaaatgtccttgtatacttggctactagactggatatggtcgaggtcgaagaggcctccattaccgaagttgtggaagctggtctcaagcagggactaaagaacttccatgccatggtattctcaatcctagacgtggtgctgcttcgtgttcacgtgggcccagatggaaccgcacatgttagcaggtctcctcttacgacgcttatatattttgatgatcataactcaaagtttgcaaatggtcctcggacaagggtgtcgtctcacagtcctgaacagggagatacgcgcgcatcggaggagccttcgaattggtccagggatgtggaagttgccagcccatgctattcagaaaaccctacgcaagaatatattgctagccctacccacgaagatgtccctggtgcagaagacgtgacagcctctctttggggatcccgatcttcgagttctgatcatgtggagccacttctgcctgttcatgaagcccctagtactaaggatggccatggcttcagccctgcccattcgccggtcgccactgacgagatcgaagatgctgctagttctgagctacaagagggatctcagcttgaatacccagccagcggctcagaatattcgaaaaacatagtatacgaagccgactacgaggagtctgttgattatggttcccggcagaagatgcaagcggatgcttttctggcagtcttacgtttctttgattcagctacctatcaatatctgaagtatgcaaattcgcgcgtgttccccaacgagatacttggagccattatgaagttctccgatacacagacctgtcgcgcgcttggcgaagtgtcatcttactgccgaagactcggcaaccgtgagtttcgcttgaacgatgactatgctgttgtgggtttcgacattgccgaaaacagctttatcttggaagacctacactcaggaaagaagagcatttctcagatgaggcaatttaatgaagagttgtggatttctctcaccctcaaagatcatgaagtaaggttgaatcccgtgatcggaattgcagatgccactagacaaaccatactggattctgtgggcctggtattctcggaggtagttcagaggcgtcctccttatgaaaagcagatagacatgcctgaacagtaagtttcgatagcccgctgccatgcgtatctaacgtcttccgcagaatgtactatgattatattggcggcagtcgagtcccaaagcccgagtttctatttgacctggaagaatacatgtatgtcgggtcagtcgaagatggctggggcaggtatatcgcgagaaggtaccagctcagcagtgggttggataatccggaccatttgatcgttcatattcgcggcccgacatttcgttgtcttctaccccctaggtgccgtgagcttatcgtggacttcacttattgcaatgggttgtattgttttttgcgccatgtgcgtgacgaaagtcccgaggaatgggacttgacagagaagcatgctctgcgtcagcttcaacaacgagagaactcggagaatttaacttttactgtcagtgccagaggacgacctgttgttgtggccttctctacgaggaccaggctattttattatgtctaccgacatgaagaagccccagcccttggagccgatgctagttcgttttctcatgatatcgctgcacgatgcacggatccagatccccgtcgacgtcttgtcccacttcttcccggaggcaaaaccatcgacctaaagaacaaagatgatagagaggagttcgagagctggatcacgatcttctgcggtaatacaggcaagtcgactgagtgggaccctttcacagaacagcaggggccgcttattcccaacaaaaacgtgcccagaagtcctgtacatgacactgacgagccgttcctgtaacgagggactagaggcacgggccagttatgggcatatcacttcaatgatataccagccagcaatgacggtatgatctggcatgttgaaagtggcatgcggtctttctggtgattccgatgttgtctgtcttgtattcttctaccatctttgtacacttttctagcccagaatgctcaactaggaagaagagagatgttatagagagggtgctagggagctatttcatttactacccgcctagttcataagggtttatccactgttgtatttgccgagactcgtctacaataccgattgcccgcttgctttcttgtttctactttgttttgcactggcgagaaacatagcaaaatgacacacacttcactaagggcaaacaagtcaaatccatgctcttagaatgaactggtatgtattctatactatctaacaaccagtagccgcatcgacgacatctcaaaagcattcaccagctaccgccccaggcagctatcctgtaagaatccagtagtagaccaagccaccaagcggaacctacatagcgtagccaatgcagtccttcctccaaacttagtcccatacaaagtcaatccattgctgcctacaatcccatcccatatcacacgtagactagcgaacgatgccacccagtccgaacccggctcaatagaggtgtcaggaatttccatcaagaactataaccaggaattatactgaagtaaatagcaatggtaaatgtttgtgacatctctaagcaaagtcatgtatagatcagacataggtaggtaggtatcaatcaagaacaccgaacaaaaaaggagtatgcaagcaatccatagtaaactcccacatcgaaaatcaaatcaaagacagaaagatcaggcccaaaatgcatatgagaagtacccaactccatacaaaccccatgaagtaagttcatcatgcagatacacacacacctatttccaagcaagccaacccagtgtattggatctagccccagtctcatcagcgatacctcgccaacgtatccctcaccaaccccaacacctcagtctgcacttccgcctgcgaagcacgcacatccactgtgagggcatcccactcgcctttgggttcctccagatcctgcaactgcgactgcaccatactactcttcatgtaatgcgcctgtcgattcataactctctgcagcagcatggtctcgtccaacttgagatagatgaaatggatctggaccgagggggatccgtacgccgcgacgcgcatcacgtcccggtatttctgcttcagggctgaacaagcaaccactacgccggagggcgggtggaagttgttggtttcggagggggagagcgcctcgatggcggcttggcggagagagatgagccagtcccatctgtcggcgtcggtgagggggatgccgttggacattttttctttgttgttgatggtgtggaactaagggtgggtggtttgttagttgggtgtgtttgtgtttgctgggtggttatggttatggtatgtatgtaggtaggggttgtatagagtatggacgtacatcatcaccctctaagaaagggatgttaagcgcttgttgaatcgccttgcctactgtgcttttcccgcatcccgctggccccgtcactacccagatgtgttggatttgctctgcctgcggtgctataggtgtacttcttgtggtgttgttgctggtgcttccccacatggagttggccacggagttggtcaatgggcttttgctgacgggaccgcgtgtggaatctactactgcggctgcgttggtcatggcgggttgttggggccgttcgccggcggagagcatggtgatggtagtggtggtggtgatgttgttggtggagcaagtagaaagcttgtgaacggtaaggggagtgagagtggtgaacccagaacttatgtatgacgtccttgcgaaccgtgggatagatagggttgaatttctgtgcggtttatccacccggggggaataagaagtatgaatggttgtgaatagcctatagcgcgcaagtggtcacccgacgaggaatgaggagaagcttgcggtagttgaatatagtggtagtagtaggtgaggttaatggtatgaaaagtatggggtaacggatcttcggcagtaacttgggtatataagtagtataaagtaagggagggagagggagagagagagagagagagaggaagagagaaaggaaccaacaagaggaaggggaattagatcataaaaaatgatagatagatttcagggcagtttataacaaatcaataaatcaataaatctccttcaagtatgaaatgcaagtgggtcagttgtcgggcacaggtaatctcattgggactgccaatttctcataaattccttctcttgattttctttgatttttctaactcaaagatgagacccggctttgagtaatggtttaacaggttggggccggaaattgccagagctgtttccaccgcatcgtcatgggcttgtgtgaatggggaccgattcaaccagatccgccatcgaatcacaaagcagctgcagccatttgcaagacgcaaaatagtagggcattccgagtgggggggatattgagcagcgaaacgggcgagtgggggagactcactccaagtcaactttcaggagtccggcggtctggtcattagcgggagatccgatcggtagcagaacaactcctcgtattgtcgcatacacacctccatacagccagagaagaaaaaagtacgcgtgcattccctctcccccttattccctcattctctcttcagcagcaggaacaaaggaattttgcccggtagggaccattcagctcagcgaggccatcacatcctgtgtcaccacccccgacacccttcaattcccgtgtcgcaccaatgaatgttgctggctggcttgtccggcccatccgccatgatgtcactgggtctgctgcaaccggggattcggaaccgtaatttcgtacgtctgtttctggtctctgacggtaccgggacgggtaatggctcgaacccccacgctattcccaacctggtattgggtcaccgtccccaaaagggtcattttccacggtgcgactttccaggcatactattgctatttgctaaatggcaatccagagtggtcccgagtacaataacagggaactcaaatgtctaccccagtccttgcagataagataaaacaacggatagaggtcgaagttacttagtttacaggatcgtctcccgcgccaagctcaactcatcgtcctccctcatccgactggcgaacaagaaccttcaacctgccgatgttcgttcccgtggcctccacggcaatccagcctgcctagtcgggcccaacttggccagacgacaggtcaaatcgaggtcttcacctcacgggtgttactttcactggaacttgtctgcctctcttgtgttaccctgctagccatggactccagaaaacctaaaataagctgcgaaagaccgccattcctcccaggaaccagttagaacccatgcggacatatctggcacccgctgattgatcctgcatactcaccgcttgatgagtggcgtgcagatggatggccgcggctcagtctggggtaactttgattgctggcatgcgagtcaaataatgcaggttcaaattccccgacgaacttccttcctcaggaggagtcaggcagtcttgctgccagcacgacatgcagtcctacctggatactctactctgtacatgcaacagcacggaaacatgtttccagcagcgccaattaaagttacgggtccgcggctctctgcatatttctaccaattgacaagtgtttcggttcactgtgtgcccgatgactgcctggctcagactgtgatcaagcataaaaagcagtctgcatgcgcacagaggtgtaacgatactggacagatgatgcggctacccctcctgaccgacaggagttggatgaacgttcaatcaaagcccgtgggtttagcatgcgctgtcgtccggcttattctcgtagtgttgtcgtaggatcggtcatatgctgtacaaccccttgatgacggacaaatttgcctcaatcatcaatggtaaatttctccgtcagtgccatgttgattgagtcattttatggatgtgcatagctctgctacactgtaattcgacaggttcggcactcccttacctaccaggtatggcaattctgtcaccatcagacatattaggaagaaccttcagcctttgtacttatgcaaggcctctagcaacagagctttcccttctgatgagtgtctactatggattttatgtagtggtgataaaggtatagttgcggatgacatagtaccgcttacctaagcaatgatatgccaggtcgcccaccgccaggcagtcgggatgccgcctaaccagatgaagctgagtgcgacatggccattgtgtgatatcgcattccataggccgattcaccaagtgcactacgctctttccagctgatcgaacttaatatttatctctatttctcgaacgcctcgcctacgatgacctccctcttcttctccacgcccgtcgacatcgatgtggtcctcgaagacagcgatgagcgtcagacggttgatgtcaagctcgacaagggccgtcgcgagagggtccccctctacatggacggagagtctgtcaagggtgctgtgacggtcagacctaaggatggaaagcgtttggaacacacgggcatcaaagtgcaattcattggcacgatcggtatggaacaatggctctcatgagggggcgggcacacctcatcaccatccccactgcacagttgctctaaaacttcaagtctcgatgctgacacacaattgttacgattagaaatgttctatgaccgcggtaaccactacgaattcctgtcgctggtacaggagctcgcagctcccggagaactgcagcacccccagaccttcccgttcaacttcaagaatatcgagaagcaatacgaatcatacaacggtatcaatgttaagctacgatactttgtccgcgtgacagtgtccaggcgcatggcggacgtaattcgggaaaaggacctctgggtctactcctaccgcatgcccccggagaccaacagccccatcaagatggacgttggtatcgaagattgcctgcacattgagttcgaatactccaaatccaagtaccacctcaaggatgtcatcgtgggacgcatctacttcctcctcgtgcgcttgaagatcaaacacatggagctatccatcatccgtcgtgagacgactggatctccgccaaaccagtacaacgaaagtgagacgctcgtgcgcttcgaggtaagactgaatccaacttaaatcgccgtatgacgtccgaagcactaacatgctgcgcgcagatcatggatggatcaccttcccgaggtaagtcgatggctcggactcacctggctctcagacaccgcaacatgtcacacctgcggcattgtcacagccgaacacctctactgacctgtttctaggtgaaaccatccccatccgtctgttcctaggaggattcgaccttaccccgacattccgcgacgtgaacaagaagtattcgacacgctactacctcagcttggtgcttatcgacgaaggtacgtgatgctgcatccatttgcgtttcatctgcgttttagccttgttttgcgactgccgttcatgaatcccgtctggcgtgggagcaccacatcggccatcccacgcatgtgagaccaggccttgggttgcaaaggcgtggtggctagctagccggcccacttcctccataccatcatcccacggcatcccaccacccaggtcaatagccggtcggctattgaaacccttaatcgggccgaaaacctgcaatctggccagtggccacagttggggtgtttctccccgtgactaacccccacgctaaacctcaaactattctggtctcgcgtggtggccccaccggccccagttccctcccgttttcgctgccttccggaagtttcgatcgtcacattcgaacccccatcttgctaacccgggcctatacagacgctcgccgttacttcaagcaatccgaaattgtcctctaccgtcaagctcccgagatcgccaccacccctcaaatcgcccagcagcaacagatccaacaacagcagctcctccaacagcagcagcaacagcaacagctgcctgccggttcggcgacagccggccccggacggactgacacccagcctcagttcactcagcaaatctctgctcaggcggcttgattcaatctgtgcgcgtctcgtgctgtagcgaaatagatcgtcttttgttcatgggctgctactgatgctgatgctgtgctgtgctgcgctgtgtcagacttccgtttgatgttacctaactttacccattatacccttctgtgtattaacctatttctggctgtatttctctgtacgttatgatgaaatctcagcaacatgaaacttactttatgatttcgttacgtattcgattctttatattcgtttatcttgcgatggcatggaaagtagcagatataattatcactaaactacagcactggtgtaacaaaatgctggtaaggctctatctactcatctgcgacatgttcaacacaaaataaaaccgaatgttcattgaaaacctagtcgtacagctgaacctgagcagatgcagataaggaacaaaggaacagacaacaacgcttgctagatggcccgatcgtctatgtaatatgtcccaacgagctaaacatcaagagtagaaacaaacaactggcatacgacaatcctatacatcatacatgaaaaccagcactaccaccattaacctcctgcagaatcttcccgagagcatgcagaacttcaccatcatcctgttccttcccggcaacttgcacggcccgcacaacaagcgggtagatccatgcaaggtgctttttgtgatcccggtcaaagtccgaactagtctcggcggtggctgattcgttcggcgctgtcttgggtggagggattgccgacggctcgctacgcaggcctaccatgccgcggaggagatgtagaagggatctgcgcgcgggcgtgggctgcggcatcaggccgcgcaggggctggtctgcgatgtagcctttcagggatacggcacaacggaggataaggtatggggtgatggagcgtgcaaggaggacgagagcggtgtttcgatgttcgggtgtattgtcgctagtggcttgtgttgcttggtccgaaggcgatgatgctagttcgaagagtgtgtcaatcacagcgtaggccattttggtccgtattgtgggtgggggttcgaaggtccttccaggtcgtatttcgtagatgtccttaaggggttggtcttggagggagttggcgggaacgtcgaagcgctgagggaggtagatgaaggacgagtgcaacaaggcgcaggagaagtcccggcggattgagtccgggatcacggatgctccgagtgatggaatgattagtgtcttgagtcgtccaaaagcagccacgtcaaaggactcgtcatccaggatggtggcccggggagcggaagtggttcgataacctcgagcggtgacaataccacttgcaatgtcgttaacgctcttccagaaatgtgtgatttcaggatgttccgaatcgccatattgtgtctccacgtaagggattgcaacttgaagaacgttcaaggatgctgttgtggactttcgccagagactcggttcccgatccttccctgaccactcgtacctttggacaatggggttcgcgagatgctctagagccgtagctagcgaaccgttcgtgaaaatgtcttttttgataccgtgctcagcgatgtaccagctaaggagctctatcgcagctttagagaaggcaagataagtcggtctctttgagtcatttgcaggtttccactttgacaacggcgcatccgcaaaatcagcgagacaaaatagaatctctggttgagaatcgtctttgtcaaggcataatgttttcaagcactccatgatcatggtttgaaggcgcgataagcgatcaatatctggcgagtatggaggggatattgaattccaagcaagaagacgcaaatgtccgaggatgattttcacctgctctccagcaatatcatccttgtatagtcgataaatctgctggaatgactggaggtatgctattgccgcatcttgattagggtgttccagatcaagtagatcttccttatcggccgggtgtccatctacccagagtagccaagcagaacgcagggcctgtgtgctcagactacaagatgcctgcacacgacgaagaatactggacaggctggagtatacagcctcgctgaattcaagaagccgtaggcttatcaactttcggaaatattcaagcagccgttcccaagactgatcgaataggtcatcttgaacgattggctcgaagaaagtagtaataagatcagaagccccctttatcatgacaacagtggtctcagtccacgccttgagatcatcgggagtgcgactgctattctcctctcgtgtaaaggtgagctcggtctctatttcctccaccattcgaaataagacacggttcagacacaagcgccatgccttgggagacagttgttgaccataggcgtcaaagatccgcaatagtgtctgaacagcgcagttccgaatttccggccggctatccgtcgtgaggtcaacaatccgtagaaggagcaataaccacagcgcgtttcgcgacactgaaggatcctcccccttggctagccctgcaagggtgtcttcagttacagaggagtcaacgtgcgactcgatgcaaaattgctcgatctgtccctgaaggaagtccgaaacattccaaaaagatgaggtagttgtcagtgagatattaaaatcctgctgttgcagggcaaactttgagaaagaatcaacaaggctcagccgacagggtactggaagcaacgagataaaatcggaagctatgagctgcagagacttgtaagcaactcgaacaagtcgaggcgaatttgctgtcgatgatggctggcgccctttctttggtatttcggtgccgttgggttcgccaaaaacactggttataagatcaaaaacgacggaccatccatcgacgaaagtttcggcatattgttcgaggatgctcttcagtgtttccaggctctgttcatgaacttcggccacgggcgctgaaggcgaccctgccgaacaagcaccagaatcgtagagcagttgaacttggagcttgagtgtctggagatttctcaattgccgtgcattccgctcagagacatccccggtatcagattgcttcagtgtctggaaaacaatgtcattgagaacctcgttggctcgtaatcgaagcttttggatattagacctgtccgctgcacttgacatcaatcttcccgtaagaagttgccaggcgtcttggtcagcattggctagtgatgagaaccgttcgagatttgcccgagccagctcgtttgttttctcgaggacaaattttaatagttcatcttgcgttttcgattttcccatagagcgtgatacgcggtgagtgtttttgcgcatcaaatgggagcgcgactgtggtgagagaatggtacttgttacctcagctgattcttgcgtcgattcttcgggttctccagaaagatctaagagcgcagttaagatctcctggaatgatccgctgggatattcgctagtactttctatcattttagccgacgctgcctgcacagccaatatttcagaattgagattagctttaggcacatcgacaccagctgcagatgaagtttccccagaagtactggttgaggcttgtgacttcgtggaagccatgccgatcaccaaatctgtgtcttgaagggttcctagtattatcgaccaggccggctggtctagtgtaggacctaaggctatgcccagattgagcaacgcccgcaagcacaggagattccgggtactgagggacacaagcgcaacgtcagaagggccattggaagtctcagccggtattggagaactagcaagcgacgcctgtgaccctctggatttctcatcgggtttattagactgcgaagtgattgtagtagccgctgcagtgcccggaggcctcgtcccagttgcgtctgcaggcatggctgcctttcctagggttgtcaaaagagcatcgcggggcgtagatagcctgagaagaccagcaacatgagctaacttctggattgatcggacaaggttgtggtaaaagtcatcatcgagcgatgcgtataagaaagttgagcaagcagcgagaatagcaggccagcttgtctcgattattccggcacagctttgtattgcgggtagttggggatgagattctagctgcaggggattgatcggtacagaggactttttaggacctggaggctgcaatcctttggaggaattcgtccgttgaaggtcttgtgaaggccgagaagagccaccatccgggtgaggactcatgacacgacttctccgtttttgcttaaggtcgggcaccgtcaagggaagtatgaactttgcgagtccttcagcaaagctaccgatgcagttcagcacaagactgtagatatatgtatcaggaggagtaggaggatcagccttgtcaagcaactccatatacggtgtgcgaaccacactccactggctgctgattcctggtacatcagtgtcagttgatggaacggtggttccgatgacgccagcaactccaccagcctcgagcgtgatctgctcctcagtgatagatctcgcatgctcaactcggtaaggcacggtcgaccggctactgactccaattaaagagggcttttcggaagttaggcggacaagagaggccatatggtctttgagaatattctttctccggtcatccctgtcgtacagggaatagatgagcctcaccagacctggctcggcatataagcctcggaagacttccatgcagaggactcgtttccaaggggagtttccgtctggctcaaggagatgcgtcaagagaccaagggccatctcgcactccgcaggaaggagagacatatggcgtttgaggagcactaagaggatgcgactgactcgaacggtctgcgaaaagctatgccgttcagacagataccttacgatcatcggcatgagccgaacacgcaaaacttgcgttagctcggaatgaacaacgaaaagtttaccgctgttgatcaggatgctctcaataagctcaagggtaaacgctgaggagagggacttgattcgaaggaaatacaaaggttccccatcaatgagtcgacagaggtcgtccagaaccttatgagtgtgttagccatggaatcatgttagctcaagtagaaggacacttacccgcagagcatcgtatgcaaaataccctacatttacagggttcccatcgactttaacagtcgtcgttggtgtggttttatcaaaattctctggtttcccggtcagacctgtgtcagattagagcgaatagaaagtccatgatcactgactgtcttcaattgaaacacggtcaaaagttgacacgattagctgctgcaacgtggctgcggcagtactagagactgcaagcattttgtttccttgcagagtagcacatatctccaaagtgcttaccaggaggtctcctcccaggtcactggaatagtgctgcagtaaagaaggcaacgactgcaatatcttgagctggatatccaggccttcgcaacgttagtatggaatgtaatgcttgtaggcgataacctactcatgttcgttgtctccttcagtccagcaagaacatctttcagccgctcagatggcagtgatcgtgaggccactagcctttgcaggcagaccaccccaatgcctgcaagctttgcatggcggctgtggcacgcgaggatgaatggattcgcaaacttaggtttgcgcaccaagtctatagaaagttcagcgtatgccctcgacggaggagcaagccaccggcttgcaaacgctcacctgctgagatctgcgcttcagacgtagaaggcaatgccttcaattcattaagggactcttcggccgcctacaatttagtcagtactggcacttgcgtatccctttaatatggcgattaaacatacattacgcagttcagagtttcttctcttggattcctgaatcaaattcaagagctctgtctgcagaaattgagaggacatttccaccggagtgctaaatcagtacatggccgatgccactccctatcgatcaaatagtagtatcactaggcagatgtggcttcatgtggttgggtcgctggttggacaacggaatacaaagctaagcacttgaatcacgacaatttcagaccaatatgttctagagacaagccgcttcaatataaatctgcagcagctgtagcagtcaatgactggctcaataaaaacaactcagaagcaatggcatcaggagtgacatcttggggagcgccaaggcacccgcggagatagagttatcacgtgatgtatatagccgttatcatcacgtgtggtaattcttcaggaacccggcgggaccagatacgcaagcccagcttaacggccggaagtgggataaggtcacagtgcccctcctccgccccgaggatcaaacgtctcccttacaacttcctatttcgcattatctattttcgacataaccctgcctcttacccgcacgatggcagctaaagtgcccagaaacttcagactgctcgaagagctggagaagggtgagaagggtctgggagctggtaagtgctattctacttatagtcataggagactcatttcgctgacgtattcctatcgctgcaacttagagtcatgctcctatggtcttgcagatggtgaagacatgatgatgagtaactggaacggaactattctcggcccccctcacgttcgtcccacgcctccgactcgcatccgttatactatacaatagcatcactgacataatgaacgagcgcagagtgtccatgagaacagaatttacagcgtcaacatccattgcggtccggactatcccgacaacccccctaccatccaattcgtatcccgagtcaacttgccatgcgttgatggccggagcggaaaggtaaggattcgtcctatcccgaccgctactatatgaaagattccaagttgacttcaagctaggtcgatcctaccaagctgccctgcttggctcagtggaagcgcgactataccatggaaactattctagtcgagctcagaaggtaattatgtcctggccttcaggccatcggtgacttgatactaatagttcctagatatatggctctgcctcagcacaagaagcttccccagcctccggaaggctcgaacttctaaaatgacggtatcatgactgaatgtggattcgaagacggagtatatggttggtttctaagtcaggttcatctgcatttctcttcaatagcttattagagcatgtacagtctatgcataacggcgggcatggcgcggtcttctttgaagcctagttgcaattcatcgaattagaacttcgctcagtacgaaccatgtgacactttcagcagaattctacctgccgaaccaacaagaccctggtttttggcggatacccgttaatatttttgacagctttcaagagcgatcataccggcgaaagacactagatcatgatcaacacatagaggaatatccgagaatcggatctcttccttcgcctgttgtagatcggatagcagtagcccatactagctgcacggcgcgcgctgcaagcgtccggtgcaattgattccctaataatagtcacggtcgagggccaaagtgttaaaaatctatgatgatcgcacgccctgagaacgtttttctgatcaatcacagtaagggcgtatcatcccgtttacacgtgacgtatttcaggttgccggagtagtcacatgtctccaagtccggaacttaagccttcaggatcatgctgccccttcgataatgcatagaatagttgtgcccaagcagtcttccgctcatcgtttcgcaagtaagtttgataagacacatccctgaatattggacgtcgcaagagtacgactaaacaccattcacctggcagctttggcactctatcgagcacttctccgacaatgcgccaaactaccacaatgtccctccgaactcgctgcgtgcaagccatacattcagaatagattcaacagatacaaaacgcttcagagtccatctcaaacagccaactctctgaaggcaggctacgaggtgcgttgaaaatcgactctgtatcgaccattcaggatctaaattccgcggtatcgcaaacactcaggctcttgacctattgtactcagcatcacaaggcgaccagaatggtgttcaacggataaggaagctcatatcggagagcgaatcatcaaagcgacaaaaatctgaatggcacaaggaacgagctaaggttattccggtaaagcccgttagccggaaggagctgaagaaagaggcaaacaaacggtaccgattattgactgcgaaacggcatccggatgccacctctattcttgcacgtcctcggcctgtggtcaatgggaagcgtcgagttcctgtactcgtgaatgcgcgtggtttcccatttttactcatcaagaagccccagcccaagttccttagcgccgtattggactcgaaactcaaaagacgctggaagaggatggagcgcctaaagaggctcgagtctgaactgccgatggccagggatgaggatgaatgggacttattaactggtcataaagaagaagcaaggtggtctgggcctgttagagcatcactcaaagaggtacagggacaaatatcagaaggcgatcggaagaccaaggaactggcgcaagctatgtggaaagtcgtccttgaggagcgcaaattggcggaacaagaggaaaagcaacgggttgaacaagccaagcaatcagcggaagagaaagagaatccaccagcaggggagcaggataagaaacagtcgagtgacggatgaatcgaatgctggaagaaatatactgttacagccgcccaaagcttacgcttggcagtttctgaccagcactctgtccttatgggcccaaagccgtcacatcaagccaccacgctgccagtacggtgccattatgagatctctccggcatccacaatgagagctaaattcggcgtattgaccgccgtttatgaggtatgcagcttctccggcatttcacttgccccttacaacgggtcaaggctaccaacatagtgcgcttggaaatggaaggtatggtaggtacgtatgcatagtgaaacagtgggttgcacatgtgcaatcataactagaacatagtctatatcgaataaaatgcctcgcaggcatcaatatcgcttccatcttctatgcgaaatcagacaaatgctgccgtaggcttactgcacatcagcacttcttggttggctatcaactacccaacgccaacccgctagcttgccagtcatccagccaaatttgtttgcaatatagtaattctcaagagatcccagcctctaatggcttgatattcatcaagcacggaattgaattctcgtaaaagatctcatctagagaccgccaacttctaagcagctatcttcatgttctccacagcagccggcataccatcttcctcatcctcatcaaagtctgccctaccagcaagacctctctcccacagctgcttgcccgtcagcttcttctcttccttgcccgggcccttcttgttagatttcttctcctccgcctctttctcctcgcgcttcctcttctcttcctcctccatctcctttataaacttgtcgcgccactccaggaatgtctcacgattaacagcagtaccctggaacttccggttctcctcctcttctgccttctttgcctccatctctttttcggcgtgaacggcgttcacgcgctccgccatgagctcttcggcgctctccttcaaagcactaaccagtgtaaataccatagccattcccatgttctcttcaatggtcggctgcaaggtttcaagaagccggtcccggtcctcactgatatctagtcgggggtgtttcggtgcgttcgggggcgcagtcaactctaattccggcgcaacatccgggtagtcttccgggtatgtgacttgcaaaagtaagacaggctgctctgtctcttcgacgtcattttcgggcgcgtcaagagcaattgatatccgatatgaggtgtcagaaatatctggggtaaagttcggtcagcggtctattttcttgggagaattcatatgaagggtgcaatgtaattatagtgtacctgtaatttcctcggggaaaatggagtcgagcacttcgcgctcttcaatctggtcttcgcggcccatgctgcttcaattctgccgccggcggggctggaggggtattgtttggttctaggttatagggacaaggagaatggctggaaattcaagactcaggcacttgaagatctagcagtatgatatattgaagaaaccaagcaaatagtctttagtcgtaatggtctaagcgttgacaggctcgtgcttgggaaatgaattcctcggtctttaggtgtgtaagtagaatacgctgcgatcccacatgcaaacaagacaaacagataaggaatcgcccaaatttgtcccgcccgaaaaagggaatttctatgctccgccttctcgaaattcaaagcttcaagcatttacactcaatatttttgttgataaaaccattctaccctttactccgtgtcctcgagaaactccttcaagtacgtttgacttataattccgctacagcttatagatcatgggaaaatcaagacctcacaacaagaaggcctccaaatctcgctcgaagtccgttttgggcgctggcggctcggtttcgaaacagaaaatgaacgaagacccctctaagctcctcgagcaggccacgatacagctccagaccggtcaaccggatgtggcactttcgttagctcagcaagccctgaacaatgcgccggataattctccatctcaattagtggcacttaataccgttggggagatctacgttgaactgggcgagatcgatgttgcgaaacaacactttatgcgtgccatcgagctcgacccgaatggcacaatccctgaggctcaaggaggcggcgctgagaagttcctatggttagctcaattgagcgaacagggtgggaaggacagcgttcaatggttcgagaagggagtgtcgtcgctcaggcatattatccagcagctcgagcagaaacctggccctgaggaagcgcttgagctggccgagaagaagcgcaagatggcgaatgccctatgcggtgttgctgagatctacatgaccgatctctcgtgagtcgctctccttccctttgcaaggttggcttgcagatcttttggtgctgactgtcagtaggtgggaagaagatgcggaaaaccgttgcgaatcactcatcacagaagccctccttgtcgctccgaatgcgcccgaagtactacagaccctcgcatcaatccgtatctcgcagctacggacagaagaggctcaagcagcgctcacgaggagtctcgacctttggaaagacctaccgcctgaggacttgtccattcctgatttcgcgacaagaatcagtctttcacgtctcctgatggaggtcggcatggagcttgaggctttggaggtgctggaacgcctaatcttggaggacgaccaaagtgtggaggcatggtatcttggaggatggtgtctgcagctcctagccgggaagcaacaagcacccaaggatgccgctgaagaggacggcaacaccccagaggccaggcgccatgcatcactcgtggctagtcgcgaatggctcaaacaaagcttaacgctgtacgatctcgttcagtatgaggatgagagactcaaggaacacgcactggagttggtccaagagatgaacaaggagattggagaagatatggatgatgatgaggccggggagggtgaggaagattgggaggacgaggagatcgaggtggaatctgatggcgatgacgagatggctgactcataaaaagttggatgttttgatggttacgaaagttctttgtcatgataccagtatatataaagggcatgttttccaatccagcctacggctattcattcaaaggactccgatcgcgaacacaagccagcagtagtcgaactaataagtagtagctgcgatagtctctcaatcagcagacggcgccggataaagtaggatccgaccgctttccccgggcgataaccagagccaaatttattccggcaattcgacttcgagtggcaaatagctcaatgtgagtgaggagtcgttatagaggttgctgagagcgtcctatcttcccatacaggatggaccttgtttcagcgcccagcggggaggattcctcgttgaaggatccggtggtccaggtggaagccgttgatatggcctccgcagtatcaaaggccggcaccgcaacggagaatacagccgctgcgaaggaagaagtgactcagtctgagtatgagacagatagcgacggctcaggcgatgagtgggagactcagtctctatatgaagacgctatccaagtcctacgcgacgaccagctccgcgatggtggtaagcactctatgatgccttctatatgcgcgcactgaccgggtcttctccttgttttagtaccggatgcctgcacattggaagaggccgtcgcctatcgtaaacgactccatgaggttggcaaggctgcatttgttgaagaaacgctgggtcaggacaaggtgactgcgaggaagctgtgtactgcgttcggcatcttgcccccagcgtttctagccgatgcgccggacgaggcctttcatcctctcctggctatcgcgatttcgcgcgagttttccaggcgcccgaagctcccacagtataatacaatagacgatgcggtcaagctgctcaaggagagcaagaatatcgtcgtcttgactggcgctggtgtatgttgatcaagaggattggtacccgttcttgaaacgtgtgctgataggatactctcagatttctacgagtctcggaatacccgatttccgatcaaaggacactggtctctattcacagttggcgcatctaggcctaagcgatccccaggaggtgtttgacatccaggtgttccgcgaggatcccagtatcttcttctcgatcgcgaaggacatcttacctactgagaagaagttctcgccaacccacgcctttatccgtgtcctgcaggataaggggaagttgttaaccaactacactcagaatatcgacaatatcgaggcgaatgcgggtgttctcccagaaaacatcgtgcaatgtcacgggtcattcgccacggctacgtgtgtcaaatgtcagtacaaggtcaagggtgatgagatatttgatgagatcaagaagggggttatccctcagtgtgactcttgccgcaagcgcatcgcggaagattcggggatcaagaggaagcggagcagcaacggagtccacaagaaccgcaaggacaatgatggagatagcactgatgacgactacgagattcctactcctggtgtcatgaaggttcgtggacatgcacaccccgcacaatgactccctagcatatgctgattctaaatatcttcagcccgatatcacattctttggggaagatcttcctgatgaatttggccgccggctgctgcaccatgaccgcgatcaggtggacctcgttattgtcattggaacttcactgaaggtggctcctgtagcggaggttccgggcgtgctgcctcgaacaattcctcagctctatatctcacgtaccgtaagtcatatattctccttgtgtttttgcgccccgggttttactgacagggtctcagcctgtgtcgcatacggagttcgacatcgatctgctcggcgactgcgacgtggtggtgtctgagctttgtcgtcgagctggatgggagctgaagcatgaaatgattccagaagacgagaaggtggaagtgcttccagtggagggttacgagtcacgacatgtgtttaaggttgtcggcgcatagcggcggcgtttggtcctggtcatctctggctctgtggatttcaagggcggcgtaagtttgggtttttgtttgaacagtttctgtgggtcatcttgttgggaggcatagtatgtacgaaggatggttaatgggtgcatagctgtatacagcatgtagtatgcttgctgcttcgatgtatttatgttttgtttgactggcatcagcctgcttgataaaccgtcatattatttaattcatcatgctctgttacactgcagtattgtagaatttcttcctgtatctgggatactgatcaatgttgttgtcattccactcatgagttgggtgagaaatttgtagaccatcctggggtagaagatggcgggttcccggccaaatccatccaatccactggaacaaaaagaaaatttatttccgctcctgtcaacggctattgaatgacaagaacccccagcatatcagagcgatccagaaatatttcttctaaagtcaacttggctctgtaccactaactctggtcattgatctctcctccaaatacgtggcgagcgtgagtgcgacgaacaatggagtatctcattcgcttcgcccaggcccatgagtcttttcggcaatccgagatccaggcactggctgacttggcgggcgtgaaactcgaatttctacactatgataagaatgtacgttcaaattttgtctccatgttcttgagcactgatagttcctcaatcatgctttgtgcggttttttgccccgcgtgaggaacggaaaatgccacccctcattggcatcatcatcctgtccccgcaccaatgactatccagcgtctatgattctatacaggccgctaactaccaccaccagtccccattctgcataatacgagtacctgatgaagcagcagctcgtgcagtaattacccgaagcataatagccaaggatatcttcgagctttggggccaaggcaccaacttcgatgaagtctacgccgacgtccgcaggcggacggaggatcgctgggcgcagtacaaggactcatcgtttcggttcaccattgacagcttcgcaggaaagcgcagcagtgaaaagaagcgcgagatcatccagtcgttttccttcctggggttcaagggccccattcgcatgaagaacccagaccaggatttctgggtcttcgaggactacggattggaccttaactctcccggtacgcctcgtcccgagggccaagagccgaagattatttattttggacgctggattgcgaatagtagtcgggatgtcgtcaataaatatgacctcaagaagaggcgctatattagcactacctctatggatgcggagttgacgctcataacggctaatatggctcatgccgcgcccgggaagcttttctatgatccgtttgttggtacggggagcttcttggtggctatgtcgcatttcggggctgagacgttcggatcggatatcgatggacgcagtttccggggtaaagagatgatggagaggggtgggacgatgggagtattgtcaaactttcagcagtatgatatggtcggcaaatttatggatgtctttacttccgaccttaccaatacgcctttgcgctccgctcaattcttggatggcatcatctgtgatccgccttacggtatccgcgaaggactcagggttcttgggagacgcgagggcctcaaaaacgaagaggtcattatcgatggagtccctgctcactagtatgtctacgcattgtcttcgaattcaagctccacggacttgggtctcagctaacatacgcccagtcgacctggatatattgcgcctaagaagccctacggcttcgaagccatgctcaacgatattctcaactttgctgtcagaactctcgttacgaatggacgtctagccatgtggatgccaacggcaaacgatgaggaggttgaattggcggttccgatgcacccgaacctggaggtagtgaacgtatctgtccaaccgttctacacttgtaagttcatatgaagccatatcagacaacttataagaccaagtgcgtggctaacctgttgatcagggtctcgtcgactcatcacctatcgaaggctaccagaaggacaagtctcagacgtttcacaaggccggcaaaagctggatgctcagggagtgtacgcagaccaactgaatgagttcagaagaaaggtatgccctgcacacccacgatgcatcaatacagtcctgaccattccattagtacttcatgaagaacccgcccgacagttcgaaatccggaagagaaagttctgcctcatgaacagcactagaatagaatataaccaaatatcgaacaaaagcaatgactctattacgcccatcatgatgcaaacccaacaaaacaacagaaccacctcaatctatacttcttcaagtatcccatcaaagcttcccctttccaaccccaaatcccccaaactccccttccaaatccacaccctcctccctcttaaccctctgaacttccctcgccaactcctccctcaacagcctagccagactctccccctcctcatcatctagatcctccctctgcccacgcccaaacatcacgtaactcaaatgagcctttcccttcctttccgccggccgatcaggcggcctcggaataacatgaaagtgaacatgagggacctgctgcgccgccctggcgcctattcaattccgatccattagcaaccaaataccgaatcaagtaaatgattcaaacgcctcatctcaaacatcggcaataggcatgcggatatgtgaattccacaagctataagatcaacaaactaaaccgccgcccgtcgaggttacacaagcatagcatgtgtagatagacagagatagatagataaatggtagtaagtgcttagcaaccgaaaactcaccattattctgcaccacattccaattccacaacgagtcaaagtccccttgctcttcctctccgaaaagcgttcgcatcacaactcgcgagatgatggggagccattggccgatctgggatttccatccgtcaatcagtactcagagtatttcaccaagacactgcctgccataatccgacaaacccaaattataactgacacacaacatagcaactcaattcaattccaattaagcaaagtaagacacaagcccagaacaacttaaactaaagctaaaaactgttgacaacgtacctccctccccacaccgacccttacatcccccaacctctcacaatgctccctcgtcgcaaccaaaacatgtcccttcgtcaaaggcataatatccaaaaacgcaagaacatgtctagtggacaagatgaggtgtgcatcgccagagcctggattgctcagctcggcgaatgattccggggaaggaatgtcagtagtgggcgccgccgcagccgctaaatttagatgatcatcgtggctggaattcttcgggcggaagaatgtcgttggtgggaggggcgggtatttgtgagcgatggcgcagaaggggcatgattggtgatgatctgaggtcatttccaagggttgctgggtaagatggatggatatctggggtaagtgactggggttggaaagtgagggttgggattggtggttagtcgtgaagtgactgggtccgttcctaggagcaacggggactaaatatgcgtccgtgctttatagctaggagggaagagaatttgatcgtcgccgggggtattttgagtcggaattcaaggctttggttgctgtgcagatagataaggagacttggttgatggatgagacggctagctgcttgtgatcctcggtgcctcggttcccagctccatggtcactagcagtttggaaacttgccgtatcaaccacacctacttacatagaaggctgacatctatgtgatgtgcaagtagcatcaagggctggtatacaaacttcctggtagttcaaggctaactaaccatttttaacgcacattaccgctatccttcccactctatccgtgataaaccccgctaactcaacatgaaagacactaataccaaaaataagcccttttcacccttctctccaccttgggtctatgccccgatgcgtattgtcgtagctgtatggattggttcattccgcacgccttgaccaagataatgcggtggtagatatatcgtcacggtcttgcgggagctgtgtaataagtccgaagagtacccgacgccgatgaacaagaactttgatccaaaaataagaagaagcgaataaatttccgtccttgaaatgtccgacgcctggaagtcacacagggtaagacgggagaaggttatgtaaggtatcaaagcaagtgcgaaacaacccagatactaccagaaatgaagagaatcgaagaacagcagagaaaacaaaaccagatgtgcgccagacacccctggaagaagcgaagatgcaaacgtccgcaaccgaaaacaacaagatgccgttcataaacatatgcaagaggtgcctaataccatcacgaatgaaataccatcatatggaatcaacaaactcctatcctcggtcgtgctgcctgacgccgatattaagtcaccagaggccctgggttatttattcatggtctttcatataagagtagggctcagatagtgagctgttgatatacaagtggtggtatttcttcgcccattgccgggtaaggatggatgctagtcaggttagcggttggtggtccagtgtcaatactagatagaggcaacatacccttcaagaacttcttgctggcgtacttcttgaagaacgcctcatgagagacagggcggtggagataatcaatcattaggcggaagaccggatcgatctcttcttcagtataaccggcataatgagccaaggtggcatcctaagtcgtctattagcacaagatgctcgagatatgtgtgcaaggaacatacccagacaccccggtcaaggatgagtcgagccagatacatggcagcagcggccacatgactctggcggtagcccatgaacctgtggtccagaaggctgatttccatgaggtacttgccaagagtacgggtttggatatcatagttgtctgctttcgaaattcgacggaggaagttcatggggttggggtagctcatgttgtactccagggtagcgaggatgtgccgttcagcatccaagatctcacgatctgtgaaagttccgtctgcgacgtcggtgaagttggcaacgtgtggcgaaaggacttcctcatatttggaggcgatgaacatagcggcgacaccaaccaattgaagacggtccagagccaccacctcagcagagaggaagcggtcaatgatgttgacagcaaggaaaagggtctcggggaggaggcggaagcgggtatggacctcgatgagccagtcgacaaggatgccgcgcatcttccactccagatcaggttggtgttcgatgtactcggcgttgggcaaggtctctagctcaaggtccttgaggtattcgaagatatcgacgacgtattcagcaaccatcaaaggatcgtcaagatcttcggcgtcaaggtcgtcgacaaaatcatcgacaggcttttgcaaaaccttcggatcgaccggaacgttgacatcctccttcgcgttggtgatcttttcggcgacagtcttctgttcggtgaccttcttctcgacttcgaccttctttcgggggcgtggttcctcctcagctgccttctcttggatggccttttcgctggatgtccgcttggtgcccgatccacttccggggcgctttgtttctgtggtaggcttcttggggttgctgtccttgggtcccagggcagcgcgtgacgagttgttgcgagtaagtttctgaactccaccagcctgcaatgttgctttcgacgtcaggccaaccttcgtagcagctggcttcttggcctccttggtctctccattctctgctttggtaacattgctcacatcaccaagggcggcgcgtctacgggttccggtggtggtagtagcggtcgcagccttcttcgtctggagcggcttcttggcggggggagccccagcgtcattgactgacagggcagcggccttggcccgcgtcagacgcgtcgatgggccattctcgtcgttctcgttcatcgtgcctctcgtacgaagactccgagcctgttgaacagttagagatatacgcgtgcaaactggatctccaagcccatcaggctcgcgaccgaggattgcacaacgcgtagtgagaggccaaggagacttacaggtggcatgatggatagggggggaaagtagaatgaatacaaggaggggcaaggaagggaataagagtagagtgcaagagtatggttctgcaggcagttggaaagtctagtcagcattccaggagagattaccccagtggagctcaaataccggttgccggaaggtagatttgcacgtaccacgcgtgaatatgtgtccaaccccaatctattagtttgaatgcaaggttcctcaagtcgaacggtcgggtacttggaaggaatttggcaggagtgggctcagaatcgtggcatatatggctttgttgatgctattgacaggagctcgcaagacccaagacacgtaactttccacggcgttgacgaccccaaggtatgtttttatggtgatatagcaaggtagaaaagttgcttagaagtaatgacacgagaatccggcaagaaaattgggtcctataaggggtggtggtcgcctccctggagtagatgatgatggagaggagtaggaaaaggtggtaaacttgacagggcaaagaggatgtttggccctagtcttagcgtggaaactggccaggctgggaaagatgccccacagcacaatccagttggatcgcgtggattgcggattattaactgttgtacaacgtcgtgtatatgcaagcctggagacaatagtcacggtccccaggtattatggtatgtacggtgaagtccaattgagagatagtagtaggtaggagagaagtggagggaaaggaagagtgacagacgggaagaggcggcaacgaaggggggggaaagaaggcaattaaaggaagcaagtctatggttctgtatggatcgatcgcatgtatgtatctgtatgcgtatgtatgacggacgtgactttcctggcagaagtcgctgtaaaaagggcggaattggtggtgaaaaaggtggcaggcagggtggtaatcatacagtcacggtttacgggagtactccctaagggaaacaaggcggatcctcatccatggtcgatgcctgagctgacccaggcaggaagacaccctcgactctcaaaacgcccgtcgcgagcaaaaacgtgatggagcgcggccacgatcgccaaaacaatagttggttgcgcggcaaccgacccggagcttttacgcttttgcgtccccttcggacgtgttgccgtgtcgcgccgtcccgtgactcgagaactgtgccacacttagtcagtcccggaagtggcggtgcatttcaagtcatgtgccctggcatcaagccacacctcccaagccatgccagacatttttgcttcggagatcgagtagaagtgcggctattgtcaccggtgccccaacaacactccaattgagcaaggtgttgctgatagtggtgtcagggacgctggattcttgcattgcctgttttttgtctttaatttcaagcatgctcaagcagtagcttgcttggtattcctcacaccattcacggtacgacattgcggtattgctttgacatctccgatcacgaccgattgacatcgaaatccttccaacttcctacctccgccacagccattcaaactcaatatgcttcaaactcggttggccctgacgggccttcgtcttccgtttagaaccttgtcctcggccgtttcgtcccgggcctattcgactgtcgtccgcgagcaagagaatccgtccgctgacgagcctgcaagttcgacgtttgaccccagtatcgccttcgcccctccacccactcgtgatgacgccggtatccttctacgttcctatactccacgaacccccggtatcagacatttgcgccgaccgatcaatgaccacctgtggaaaggacgcccggtgcagaagctgacgttccccaaacgaggtcaagccaagggtggtcgtaacaactctggtagagtgactgtccggcatcgtggtggtggccacaagcgccgtatacgaatggttgattttgcgcgtgacgctcccggtccgcacgtggtggaacgtatcgaacatgaccctggtcggagtgctcacattgctcttgtccgtagccaggagaccaagaaactgagttatatcctggctgcggagggtatgcgggctggtgacgttgtccacagttacatgtctggtattccagaggaactctggaagagcatgggaggtactgtggaccctggtgttctcgctgccagaaccgcatggagaggaaactgcttgccgctgcacatgatgcctgtcggtactctggtcttcaacgtcggtttacgtcctggtcagggaggccagctctgccgtagtgctggtacttttgcgacagtcattgccaagggtatcgatatcaaggcgaagcgtgatcattctgacggccaagaaggagaagcgggagctgttgagcagaagcctctcacgcaacgcgagaggcaaagaaaggagcgcatctctcaacatgtcaccatccgtcttcagagtggtgaagttcgtctcattcataaggactgctgcgcgactgttggcgtcgctagcaaccctaaccaccagtaccgccagcttggtaaggctggtcgctctcgttggctcaacattcggcctaccgttcgtggtcttgccatgaacgccgccgaacatcctcacggtggtggtcgaggcaagtcgaagggtaacgttgacccgaagagtccttggggtatgccggtatgtatcctcgcctcgctattccttcctttgcttccaggcctcatccatgctaatgtcttcgtttttacaggcgaaatccggttacaagactcgtcccaagtggaagatcaacaaggctgtggttcatcccagagagcgcaaccaaggcaagcgtcgtcgtggataccactagacgccgtcgtgaacatgaaattttactttattccttggaccttcttatagctatttcacggttatatcaaatgtgattctatcaccgctcggggtaaaagctgggtaaagcagagcatgcatcttcggaatctccccatctgtcgaaggtccttcttgtgggtttagatggtgggaagtcatttcctgttcaccttgttgtactatactttattttgtcttggctaccatgggggattccagctgtctatactccagctcctttgctttttatccgggtctccttcatgtgttgtttatgctccggcgtttttcttgtatactacatgggttagagtacaatcaatcctattacacagtgcacatatatgctttgaacaactccttcactcatgaaagttatgtatccggtggagtggacagcaatcagtcctggcatggcatagggcggacgcgaagcctcattggggtgaacgagcagcgggtctagaacaggctgagaccgagagaatcaagccgaagccggtggagtaatatcatcgcgctcaactaaaacactacattcaaactcgccttcacgtccgcgggaaaaccgctgtaagcttcgctctctaatggtcccgatccacgcttcattagcatgaactctgactaacaaagtaggatccttggttccgttcgagtcctgtaccgtcctcggcctgactgacataagctcgatcgtgcacctaccatctttccctatagcctaacggctttctagcttcttctgcgttctgttaatgcatgccggtctttttcgcgtgttcgatgcctccaagtatccatgatcgaggcacagcccacctggctcggaaaagctgtgcccaccttacaggccattctcgacacacattagctccccacccgcatcgcgcgcccggccatggccgataatgccaatcgtctaacacagcagactcaagcttctccatcccaaccacagcttaatgcagcatatgaagaggcagcatcaatcgccatagagcatcacaatacaagcagcgattatattccccgccccaagcgtatcgcatgcgtactttgccgaaggaggaagttaagatgcgatggaaacaaacccagttgcgggagatgctctcggttgggtcatgaatgcatatttgatgaagtgcgcaagaaaagcggtcccaagcggggttacgtgaagcagcttgaagcacgtctgggtatgtccattgtctgtcaatacctgacactcgatttctgatcggaggcatgtgggcgccgatctcaccgtctgcttctctgacatcacacttattatgcagcccaggtcgaaacactactcaaaagtcagggagcacaagtacagcaaagccagggcaatagtcctattgccttaccctcaatcaattcgactggcgtgcccgacacctctccccaggatgatgtccatatgtcatctccggaaggagagactgatcctacttattcgactcccgcatcaaatcatgcaggaacagcaagcgccaatgaaccagaaggtagattgataggcctggggctggaagaacccctacccacgcaggaggttattgatgagctgcaagttttcctccccacaactgagatctttatccaccttctaatcctgtacaggaccacgatatacttcgagaagatacatctgcggcttcccatgatacatcgcccaaggtatctggcagcttcgagccttgctcctgcctcacgaccccctatatgcttacagtacataatgtggtgtcatgcggcgtctgtcaccaacaagtacgccagtcttcacagtattttttaccagcgggctcgtaagtacgctgaactagacgagttggaaggtcttggcgagcgtgcgttgtctaccgcacattgtcaaacctgggtgctcatcggcacatacgaattcaaaatgatgtttcttcctcgagcgtggctaagtgtcgggaaggctgtcagactagcgactatgctaggtctaaatggtatagacgaagagggtctcaacgtcaaacagacattgccgcctcccaaagactggtctgagagagaagagcgaaggagggtattttggatggcgttttgtcttgatagatacgcaagcgtcggtactggatggcctgtctcgtttgatgagagagatgtcagttgcttcagcgtctgctctatttgaaagggaacaagcttgtctgactgagctcgacagattttcacgaaccttcctgcatcagaggaatcatttatcggcaacgaaccgcaacaaaccggtcgactcgcagacgtactggtaaccgggaatattgctacgatgtcaacatttgcaggaatcgtgatattagcttgcatgttcggaaagaatgtagcacatctgcatcgacctgatccccaagacaatgatcatgatctcaatggcaggtactggcagcggcaccgtgcctttgataatcttctacttcattttgccctctccatgccaagtcatctgcgactgacagtcttaacgaccgatccaaacatcatattctgcaacatggctgtccacacagcaacgatttgtctacatcaaggggcgatattcaaagctgaaaagaatagaatgccggaacagattgccactgagagcaagcgacgatgtatattagctgccgatcaaatctccaacataatgaagatgatcagtcatctggatctaagtgttgtcagttatagcataacttctattcgacttcattgtgctaacacaaagcagatggatccatttatggctttttgtatatacgtggctgcgcgcgttttcatccaatacctgaagtttcgccccaatgactccgctgcacgttcatctctccaatttgccttttctgcactcgatgtcttgaaacaaaagaatccactggctgaatcatttatgatccaacttgaatttgacatcggtgggactgcctttggagatgttcggactccgaaaaggatgtgcttcgcgtcccatataccacatactatggtaagcatgcctgttataccagtgacggcgatctgctgaccagagaccattctaggctggcgcgagcaatccacagaatgcaaaccaaccaagagttcaggccgataatttaatcccagatcaccatcaaagcactcctggacccacacccactgcacatgcatatcaacagactaccactgagatgccaccaggccgaccaagcacaacgattcaaaacggcaccaatacatccaatcacgcagcaccgaccagaaagggcaatcctatatcaaatctggatacgcacatgcctcctacatccaacgacaatgccaacaccaatcagtcaaccaataccataccttcacagctagcttccactctgaacaacctcaacatgggaccaacgacatacccctcctcagcacaagcccctattcagccagatgtgttctaccccaatgtctttgctccgttccaatacgaagccgacacctcctttcccaatcagccaactcagcttgatccgacgagatccgaaaaccccctcactactgattctgcgtggactacctcagagaaccctatacctgacctcagcgatgaaaatctagtcaataatccgcctaatggccccgaagctctcagcgacgctcagtgggcattactcgcttcgggggcctggaagtcgtggcaagggttgaattttatgtcttgagcttcagcttgggaatggaagcagtgagctctttgcgacaaagtggctggtgatgtgatctacgatatatagatgactaatgattgatgctgaatatgctgtgggctctttttcttcgaaaatcgtattgagcgtagcacgtttacatctccttcgcaatatccgcgaaccaaacagagtatatcaaaccagcataggaatggactctatacaagacatgcaatacaatgcttaatatctaccgtagacatcataagctcaaataaacatccaacgcgccaaacgccacaagacacacatacacaaagatgcaaagtaatatcaccttttcgaaccatggataccgctgtttctacaaacttccacccgcagcccctacaattctcaaaccgcctgggcccgatccatccgcagtagtagaatatgcaagccaatacctcgaaggatgccacgcgacagccggaatccccgaattggcatttcctcccgtaggaacggtatgaacactctcacccgtttccgcatggaagatctccaacccattaccaccacagcctacctcatcacaagcgccgcagatgaatctaccgtcgaagctccagctcacgccacgcacggctccaccgttattgctcgagacagtacgcttgcagatccagtccgttgtatcccatagggagatgagggcgtcgctgcccccgacggcgaggtagcgacctgtaggtgctaaggagatggaaaggcaagcagaagtgtgggcgtgaagggtgtggagattggcaaaggacgggtaagagatgattttgacggtgccttcgccggtcgtggcgaagaggtggaggtctggggaggaaggggtggacatgtgatgtgagaaggtcgttgcgtttgtttggatgggctgagggtgtggttctagggctgtgtaggttgatggtgtgaaggtgggcttctgttgttgttgcgtcgctgcagcgttgagtggtccgtctgggtggatggttggggtggagggggattcgacggagatgggtatgagggtgtcgtcctagagatattgggcgtttggtcaattgacaagtccctgatgctgagcgcattgttttcgtgctcgtgtgtgttttgctcaccttcctgccaacgatcattacccttccatcagcagaccaggacaaggtgaatgcctcgcctccgacgtctagacgactgacgcaggtctttgaccggacatcccaaacgcgaacggttccatccgtagagcagctggccagttcggagtctcgaacggggttgaacacgactttctcaattccagcagtatggccgcgcagttcggtggagtatttcacttgcgaacgctcagggttccagatccgaagggtacggtctgcggagccggtggcaataagttgaccggtagggttccaggctattgtgcgaatcctagattttccgtcgtcctccatcatcagtatgcgttttgcttctctgctgtgatagtaatatgtcggatgggcatatacgtatgagaaccaggcccgcgagcagcgggatcatggtagttctgtgtttttagaccaccaaatgcaagaccaaaccggtctttcgggaggagattccgtcgaggaggcgccattgtcaaggtggtacttgtgtaattgttgctgctgctggcgggttcgcgattgcggcggcagcagcctgaactgatgccccgcagggctgtgaatggcggagtggggagagagttccttgcaaaatgagtggcgaagaagacttcagtaacgaaagtagtttctaggagcaattgcgaaacggcgctgccaaattgcggggagattcgaaagggctcttgcgcgcgatgttcgatcgatgcccgcagagagtgtgaggcgcgttcggtgattggctggagctcggcgatagaagatcacaatcgagatgacataatgctggcactcgccagttggctaggcgtctgacctacaggtatagtattgaaggttgtcaatttttttaaggacactgtgaggagtgtcattcttgatatacagttcggtactttgtccaattcattccataacactctctcttggtagacttgtccgaaacgtgcagtcagtatatggtcaggtgacccggcggaacattccaagcagcaattatcttgcatatcagccagtagtatacggcgtaactatacaagagctttttgcatctgtgtgcttaaatccatcagttattacttattgatgcatcacgccttctattagccgtccagtgtgagtcgagcagctattgtatagggccgaaaattctctccgagctcaaccacaaatttcatctaccggtattcaagacttgagctagactgccgacggtctaatcgacggatcgccaggctttgttataatcttctcagaagcatgctcgactttgaagatgatgcgtctaaacgcgaaaaatgctacaccaccataggccaactgcctgcttttatcgatcccaagcagccgcccacgaaacggtccccctgctcggccatccttggccatccattcgttcacacggtaagatactctgtactctttatatatttcccggactattatcactaggctcttatactgtggttgtgctgtgacagttcctcatcatatgtatgttggcacaatattagagaaacgctaactagtcgatgcgtaggttgaagtcattttgccaaaagacattttctcgcatgtgcaaccccagctgcaaaagctgcgatatgctagagtttttatgtcgctatcttctctgctcgagggtgaattcttcaatacttacatcaagaccggtaattattgcgttttccactcttcgtcgcctcctggctggggcgcaaaggccgatatagtagctaacatacatggtatagggaatattctcatgatatcagagggacgctcaggctcagacagtgtcttcactcttaaagatggtttgtagtctccggctgtggttttctagcatactcagctaacaggccccctaggcatcctaaaattggagctgagcaaagaaatcttcgaaagaacagggcttacagggaagccggttcgcagcggaggaagaaagcatgcaaaagagaggttcagtatgttctttccataccatgccccccaaaccgaggagacatgctgacaacaagtcctggtaaacagtcgtggaaatcaaccttcgacttccctccatgcttcacggcaagaagggcttcgagagaattgtatgggctttcaagaacgttttaaaccaatcagtagcctggctattcttcgatcttacaactagctcgggtggcgtttcagaaggtactataccttatcaggcgctcttctgcgggtttctcccaggaccatacactaaaacatgagcagatgacccctccctaaagggaaaccagccccaaatcatcaattgccagcctattttcaccgagcactccaatatccttgtccctcctctccctggagcagaaatcacagacgagtcccgcggagcagcagaactagaagaccactgcaacgagctctccgaatggcttgcaatggtatccctcgaatcgcctcgcgtgtcggctcatgacgatgtggatccctatctatgtcgttacagtgtacccgatttggataatgcaaagtccaccagtcttgtcagcctgaagtggcaaggacttgtcccgtctcgttggatcatcgaattattggtcgcgttattgtatgctccacatgccctgttatgacactcatctgatattgaataatttgctgacttggcttctttgcgttttcaggaaggaaactgctcccaagtctcttgccccgtacgcttggttcgcgctttctgcgagtgcgctgggaagagaagccgtggaggcacgcgatgggtacacggttatggtgcttccggcacatgtgccaaagcaagatgtgttgggggtgcaggcagatagtccgtctaagggtaatggccggcactttatatgttgggagtacgtcggtgcttcgattctatgaactgttttatagtatgccgctgtccggtgggctcaggagtgcagttacggttgttcaatataccccaaatctgaaaagtacctactacatctttgggcatccattacattatgtgcgactctaatgatcaaatgatattattcctctagctattgaagttgttctgcatgtccgttggtatccaaaatcataatccctagttgcattcaatttatcctttgtcccaaactccatacccaatacacgccaaacgatattaagaacccttcaagcaaatataaagtactgaccaagacatgaataacagttatccgatgagatcattaaccatgtcctgcagaacaggtcgattcccaaggactctaccaccgctcatcaacttagcgccccttttagcaggtttcttcaagccagtcggcgatagtcgagtctgaacgggaccgaatggactgcgggttgtcttcttggatgacacagggctcttgcccttctttggactaggtgtagacctgtccagacaagactgcgatggtaccatttcagattcgaagatatgatccgtcatggcatctctaggcagatcatagacccatcctcgctcttggactagtttcacgtattttccaaggagctcgttgccatcgcggagagtactcttgcttccgacgacgagaagcttagtccgtgctctggtgaatgcgacattgacgcgtctccagtcacgaagtagatcaccgacgttcttgtcagtgttgctccgcacgcagctcaggatgatcacttccttgtctcggccctggaacttgtctgccgtatgcatctcaagctccggtaggtagcggctgaggttttgttttaggagtgacagttggcttcgatagagggctatgacacctatgctgcgtgcggggatgccgcaggaaatgaatgcttcaacgagtcggctgcaaatagttgcctcagtagggttcacaatccgtgaaccgtttgccacatccagtgcaggtatggaaagcgtatctgtgttaacaagtcgagttttggcagacggttcgaccagatccttgagccagcaacggccttggcttgtgcccaagcaaacctgtcgctgactacgtggctgagggaaggtgctgggatgatgttgcttgagaccgccaatattgggaacagtgagtgagcgcactgcaacatctgcagtcccacatttgagacgaccagaatatatgagggtgttagatagaagcatgatgtcctcacacattcgatactggtgttccagattgacaacggaatcggggtgggagtcagacagcaatttaaaaagactgacatccaggccgccttcttgggcctccttattctgcaccaacggaggcagttgatagtggtcaccaacaaggataaacgtcctagccattcgaataggtcctaggcacactggaagcgtgatttgagaagcctcatcaactatgcaatagtcgaacatacgttgggtgaagataccatgactgaccccgaggcaggtagtcgccaccacctgcgaatcttcgtatgaggctttcagctcttccattgtgcttttaggcaccgctgccaattcagcaaactgctgaacatcaggatgtacttttgcaggagccccaattcgcaagatacggaagttatcatccttgattttcagtaggatgttatcaaccgccgtgtgagtgtaggaggtcaagaggacgctcttgccttgtgccactaaggcacgaatgatatgagcaatggtggtagtcttgccagtaccaggcattccaaggaccaaggcataatcttcagcacacatgaccttgtcgatggcttgtcgctgatcgacgtttaaggctgccttgtcagattcagacaaagtatatgcagatgcagtggttttgaaagctggcgcctcccgtttaacgatcaacctcctcagctgtctagcctgaaatagatcccgttccatcatggaaacgaggttcgttcggacaattgccatgccgttactgaattcgtccttgtctaaacggtagaccggctcttcttccgactcagccggtgacggggaggcaccgtcctcgagtatttccattatacccttgaacgactggttacgcgtggcatcaaagcccctagctctcgttctggcgttatgtaacctcctgtctaccgcgacggtaatgtgtcttcggctgacttgcacaacgtatccatttgcaagagcaaagtggcccttctcatcagagaccacgattggttctccaagtgtgagctgggattcagtaaatgaaaatgatgggtgggcttgttttttgatgaaagtatagcgatagcgattaatcttgggtccatctttctcctcgtaggaggaattagggtcgatcacgacattgccaaaacatcgacccaaagcctcgcgctcgctgctaagcatggtccaaagctcgcgcttgaaccgaatcatgcttttttcctctttggtcaacaaatcatcccattttcgaaagaagtcgcgatcatcaggagtcaggtggtccatggcgttgacaaaatcatcaccaagaccgctagtttcaccatcaccatcatctgcaagcttatggtagatgaaacaaggtgtttttgagtagcacttgttgcaaaatgaggacttcttggccatcggcggcaggtgcgttctctggcgcatgtatccgactatgcgatttcgctgctggatcatctgcaggagctcatgccggatgccacgaatccggaatattttcgttgtttcgaggtaatataacaatccaaaggtacattccacatctacagggccgcgtcagtttctatcgataatggggtttaacaccggtaggggctctcttaccgtagcgatcagaaagcagcaaagtatacagagccgtctgtgccctgtgagcctgatttgtatccctattgcctgttttgagctcaagtggtacgaccaggtttttatcgctctcgccgtcatgacaagcgacttgcacagtggcatcaacgttgcctttgagtccatacattggagaccaaatatgctcctcgacttcgaggagcttattgatacttaaactcagcttggagttgccacggtcctcaaccagcgattccgcctttggaacagtcagtatagctatcacgaatggtggctggtttaacttacacttggctttaacctgaggaaccgctctgcccaagcctgcacgcccggtatccgactcatcatatattcaacagcctccggaatagtcatgcggatcaagtatagatcctcgatgcgcttgacagtcacgccttcaatcaaagtccttagcgagttcgtatcccatttgttgagcttgattgcttcttgaaacacctcatgaaatatgttcccaaaaacttgcgctttgcctagctcggacgtgtacttgattcgatcctgcaggacggcgcggcgctggcaactaatcgagtctgccacgacagttgcagagaccaggtggtccggatggagaataaccatgttcctagaatcatccacgatgcaatgtcctgtggcatcgaaatccccgattaagtggatatatgattccttgacgcatggacactcgcaccaagactctcgaaggatgacgactttcttttccttcgacctctcatcttgtacagaaagcatcttttcttggtgtcagtgggaatgtaaacctgttaggttttatggtgacagacctgttctggctgaacgcgccctttgatggtcttatacgcagactccgcaatatcaacaataaggtagcgcttgatggcttgtcggcttctgacgttctatatatgggccttagtaagtatgtaacatataaacccactaagaatgacaaacatcgtttgttgcatctgctcctgaatgcaccatggattgttcgatggcctcaatatccaagccatcatcgtcaaattcatcaccaaaagacgcatcttgttctcccttcttctgaatgaacgcttcagacgtcgcgccaagataatccccggatttgacttctggaattgattgtctgaaagctgctggcctcgtagaaacgggctttgccatatcagtgctctgcgacttttcgcattgagcgagaagatcccccatactgtccgacaacccatcaaaatcatcgtcaaattcatcagcatcaagggtatcaacatcattagtcggtttttccacattaatttccatagtcaccgcatcagtctctgtccattcctcagtcaaagcgcgggcctctgttgaagccttgttgttcacaggttgaccactcagagccttgtcattaaggtgagaggagccggcatccacaaatggatccatcgaggcttctgcaagatcgaagaagtcctggtcaaattcatcgtccccataatctgatgaggactcttccaacggtttcctgtcttcgggggcagcatgaataatcctgggttcgtgcacttggctggttatcttcgaggcttgtacttggctctttctatcctcggtcggagattttgatctgccacgcctgtcttggttacgtgctgggacaggagacgagtcagttgtgtccggtagcggcccaggtgcctttttcaaagtcttttcgatttcctccacgagagaactgatattggggccttggtagtttccagggttgacaacattacttctcgttcttgagaaaatgcttcgtcctgcaccaaagttttccttgtcgatccttcttcgcttggtcttcgaacttggccattctgccatacagctatttgatcgtctaagacctgaagaatctcgactggtgcgcactgacgctggtgtttgcggtgaagaagagaggagatttgtgaagcgtggccgaagttgctcaccattgctattggcaagtgttttgctcacatagctgttccacaggtcagcagcgaggtcatgctgcggagtctttatgagtgtctgagaattctgcaaatcaattgatcctttgcgcctgcttttcgaagtccctgccagaggagaactagtcggggatgagctgtggcggcgctttttaccctgtgttgcaggcgtctgagacatcctatcaggatttgagcttgcaggcacatgctgccagacaacgtaatcttctggggtgaattccggcataggagcatggatgaaagcatcctctgcattgttgataaggtccgcaagagggattctatttcctggtgtgtgagggcattccttcgatgcctttggttctgctggctccgttgtttgattttgattatttgccttcgattgttcggtttccatcactccgttcaaccaagatgtctggttctccttgttcgcatggccaggtgctaaggaagtcttctgaggggtcttgtctggggttggtccattttgatggttataccgaaaagcgttcaatttcgaccgtgattgcgaagataccctgtatgttccgttgcccgtgttcatcgtgttttatagttggcgttcttcgggagctggggggcaatggggcatctcgagaagaaaggcctaggcggttagcaggagtatgtcaagtggatcctcgatcatctgaataattccgcgaacaataagtacctttattttatcgactggcattagaattccttgacaaccgagtcataagtgacaggttcaagacagagtgctaatgcagaccagaattggttcaatgcacgcaatagtagcattgccgatgcgcgatatgcgataagccaatttaattggtctcgaacgcgtcgcgcgtcgagtgctcctgcctcaggcatattactgttaatgcctgtgacatcaggccgaaaggcggcaaggaaatttgcctgatcgggcctagcggcagaatcccagcagtcatcggccttttgcggcttctgaacatcaaccgcttgaccgtcacatcacccctccacctgccgctcctgccgctccaacgaaagcagtgatatttgaaatcactcaattgggtcgactattgtcgtcgctggtcgaacggattcctaatttcggcataccaatccagcggtcgttgcctcgccatacccgacagggatcctcacccgccaccgcctgtcccttatcatccacgttgaaaactaggggtttctgaattgcaacagaccctccgcacattcacaatgtctgctcgtccgttgtcgcattgccttcgcgctcgctgtgtcccccgccgggcccagaacatccagggcttctcgacccgcagcaacctccgcggtgaccactatgaccctcctaccggctacctgtttggcctcaagcccggccagaagtatgtgaaggagggttgggagaacatgtggtactatggattcatcggcagtcttctcgttgccggtgtcgcatacgtcttcaagccagacacttcgtatgtcaatttctctccctcgtgtgacagctgaagtagattgttttaagatctttcggcgcgtcacaacaaaacatttcaccgcttcaacggagtcgaagattagatgctgacgtgaccacaggatacaaacatgggctctggaagaggctcgccggcggctggaggccgaaggcattctggaggaccctgacaaggtccagcgcaagtaaggtgcttttggtccggaaatatcttgtactttgtacatagagcggtcgggcgtggaagacaatcttcgttcgagtggtgtcaataggcacattacgtccgaccctagacagggcttttctatttcatttcactgttcgcctccaattacctgcgtgtatctgtcatcctatatcctgaattcttttcgttgacatgcttgcaatgtttcaaaaacgggagaaatagatgtttgtgccttatacatgggttgtatgatgtgtatctcggttttcggctacgttcacactggatagcaatctattatcttggtgttatacaacaagaagacggtaatgataatatatatggcgtagtatttatagatatcatatgtgctgagtcaaatgccatgactgcctatacttctgggtatatatccgttcttctgagtagcggcatctctctcctgactttagcaaggagatctagatcaatgtctgcaaccgcgatctgcggctcctggtattcatcgccgagcttggcaacaacttccccccatgggttgacgatcatggaatgtccgtagcttctcctcttctcgttgtgaggcccagcctgagctgcggcaatcacataggactgtgtttcgatagctctggcgcgtaagagggtctcccagtgtgctgttccggtaggaaccgtgaaagctgatggatatgtgattatctgagcgttctgtcttctgagagccaaactaatctcaggaaagcgcagctgtgtaagtctatacgtgagcgagacgccttgcagtttgaacggaccgcttcagcttacatcaaaacaaatggacaagccaactcgcccaacgggcgtctcgaaaggcggtagtatctccatccccttctcgacactccttcatctgaagttagccgacttcaatcgcgccacatctatacactaaacttacgcgctttctttcaatactggtccacccttgatatccacatcgaatagatggaccttctggtagcgttgtgtgatatttccctgttcattaatccagatgagggtattcttgatcctcccgttcgccgccggttcgtgtatccctacattgatgtgcagattggccaattgcgcctctttctggagacccagtacaaactcgctgtcttgtacagagcgtgcgagtgagatggtctctgcaggcgatgatgcgatatagtctgaagcctcaggaagaaacaatgcctactaagatgttagatcgatatcgatactggtataaaccaagcgtaaatgacttgtgagcacgatacaaaaacttactttagctccagctgcggctgctttacgtaccagcgtctggcattgcgccaagttggccgctagacttgcagttgagcatagttgccccacggcctgtgaggtaaatatatcatatcagtgagaactccacaaacatagtagaaggacatctactgaggcattaagcgcttactgtgagaaccatgtctatgagctactagtcacttgacttctgtaaacggagagtgaaattgtctacggacgattcagaggttgatgacggaacatagcatgcttatcacgagagagcccatggcgatgcccgtcggcactcggcagactttcccgatccggaccatcgtctcaatcccgcttcagcacgcggatccagatccgagcaaacgtcacgaagtgcaccaacggcctgaaaaaccgacttgggccgcagattaaaacgacctgccaggagtgtggtcgctatacagacaagatgaagagtttacggcgagacttctcgtcgaatccgcaggcagcaaatgtcaccagcaaagtcttcgtgagatccacgaaaagcggaaaagttcaaaagatcgttcgcgaactttacctcagacaagacattccttgctcgtctaagctctgctcgacttgcgcatctactgcaccagcagatgccaatggaaacagtgagacaagcggatcaggattttgcttcgcttgatggctaatgcgacacagtcacgcctttcgtgctctcggagcagcccgcgggcaccagcgctttcccccgcgggcactatcttgtccccgatacgaatgcattgctgaatggcatggatcttttcgaacataccggagccttctacgatgttattatcctccaaaccgtcctcgaggaactgaagaaccagtccctgcccctctacaaccgcctgctctctctgatcaagaccgacgaaaagcggttttaccttttcttcaacgagtttcgactggaaacccatgtccggagaggacccgatgagtcgataaatgacaggaatgaccgagctgtgcgaacagtggcgaagtggtatgcggaacatctcaagaccacggtgaagaaggggaagaagaacgacatcccggctatcgttgtcatcacggacgacaaggaaaacttgcgcaaagcaaaggaggagagagtaacagcattgtcactgtcagactatgtggccggcctagaggactcagacaggctacttgacatgatcaacgagtctcgggaggcaagggaagcgaagggcgcacgcggcgagcttttctaccccgaatactactcgatgtccaaactcatgacaggcattagagctggaactttgcaccagggagtcttcaatgtttcgccgtacaactatttggagggctctgtcaatgtcccggcattcgacaagcccttgctcattttgggccgcgacaacagcaacagagccatctctggggatgttgttgttattgaagtacttcccaaggaccaatggaagtcgccatctaccaagatcgtcgatgaagaggcggtgacgaagaatgacaatcctgataccgatgataccgaggcagtggtgtcggagagggaacggaaggccttgcaagaagaggtcaggaaagcccatggaaagagctcagagggaaaaccacaaccgacagccaaggtggttggagtcatgaaacgcaactggcgtcaatatgtcggacatgtcgatgccggttcggcaggtgctcaggctagcagcggtcgccgccagcagaccgtcttcgtcctccctatggacaagcgtgtacctaagatccgcgtccgtactagacaagctggtgatcttatgggtcaacgtattcttgtcaccatcgacgcctgggaccgtgattcccgataccccaccggccatttcattcgctcactaggagaactggagaccaagggtgcggagacagaggctctgctccttgagtatgacgttcagtacaagccattcccgaaggctgttctcgactgtcttcccgccgagggccatgactggagggtaccggctagcaaggataatatcggctggaagggacgaagggaccttagagatctccttatctgcagtatcgacccgccaggctgtcaagatatcgatgacgcgcttcatgcacgaccattaccgaacggcaactttgaagtcggtgtccacattgcagatgtgtctcatttcgtcaagccgaacaatgcaatggacctggaggccagtctccgtggaacaacagtctacctagtcgacaagcgtatcgatatgctgccccatcttctcggtacagacctttgttctctcaagccctacgttgagcgatacgccttctccgttttgtgggagatgacacccgacgcagaagtcgtttccgcagatttcaccaaatccgtcatccgttctcgcgaagccttcagttacgaaaaggcgcagaagcgcatcgacgatcctacgcagaaagacgaacttaccgaaagcatgcgcactctgctccgcttctctaagatcctccgacagaagcgtatggacgcaggtgcgctgaacctcgcctcgccagaagtccggattgaaaccgacaacgacgaagtcggcgaccctctcacggacgtgaagacgaaggccatgctcgagaccaacagcctcgttgaggaattcatgcttcacgccaacattaccgttgcttccaagatctacagcaccttctcccagaccgccatgctccgacgccacgccacccctcctccgcaaaacttcgaagagcttatcaaccaactcaccaagaagcgcgacatgagactggatgtgtccagctcccgtgctctcgccgactcccttgaccgttgtgtcgacgagaagaaccccttcttcaacaccttggtccgcattctcgccacccgttgcatgacttccgcggagtacttctgcgcaggggcccacgcagagtccgaattccgtcattacggtctagcctcacccatctacacacacttcacctcccccatcagacgttacgcagatctcttagtccaccgccaactcgcgtcagcaattggctacgagggcgaagatggccgcgccgtcgtagagggagtgatgacccgaaacagactcgaagatatctgccggaacatcaactaccgtcatcgcaatgcccagttcgccggccgcgccagcatcgaatattacgttggacaggcgctcaaggcacgcggagagaagatggcagccgatggcgtggacggcggcatcgaagaggagggctacgtcatgcgtgtcttcgagaacggcgtcgttgttttcgttccgcggtttggtatcgagggcgtggttcgcttggaggatttcgtccttccggatgacgctgctctccgcaccgtcgacgagcgacgggagctggtgacgcgccgacagagtgacttcgacaatgaagagtacactctccgcgtttccaacaaagggaactccgaatcgcaacccagcatgggcgtggaactgttccagaaggtcaacgtcaacgttagctctgtgaaagaagaaggtggtcgcggcgcaggaaagaggcgggttagaatcctgattctgggaagcgatgcctagactggagaaaagttactaaaataatgacatgactatctttctgggttgtaaaatctaccgcgactagaaggcgtcgatcggtgcgttatgtaggatcattgtatgtgtatgtatctttatgtacttctgtgcttgaccaatacatatctggtctagaatggcaatctagacagtcatcttatactatctagtctagtctctactgttctgttcttgcttatctagataaatcagactctcctcaaggccaccatccgacgcaacaaatggatcggcgaccagagttgagtttccttcacacctgatgtgggtatcccaggcgaaggatcatattcctcccccttctgtgcaggctcttcctcatctttcttctctatactactcggaaccatcacaccaggagacgctccttcctttttctcagattgcacaagctcccctatcttccatcctcgcacaagccacaaacacgccgcgccaccaatgtacatgaaccccgtgaagatctgcactctcaaatacaccgagtccgtggatctattatccctcagcacaagcgcaatagcctccgacacggttgtaggaggtaccaaaaccagccatgtaatgctcaacccacttggtaggtcccgcagaccgataatctccgccagcacaggggtgacggtcgcccagtaggttcctgcaacagtgccgacgagaactgcgaagaagcagaccacgcccatgctgcgagcaaagatccaaatcaccaggcagaacaagccacacaggaatgtgaggaatgtggcaatattaatccggcccaatttatcgctgaacatgcccacgatgggtcggccgactccctggccgaggttaagcagggcgctgacgacactgccttgatgggaggagagaccgacagagagggcgaagttggcgacgctgaaaagcacggcgacgtagcccagcatgctaaggataccccatcctaagaagaggaggaattcgggacgcttgagtaaggggagggaaaaggcatggtggcggcttccgatgtctttatttcggtccttgagaagattggcgcatactaggttgacgacgcaggcgataattcctaggattcggaaagcccagcttaggccgagtcggggaatcatggcgccaacagctagggagtagattagtccccctatgccagagccggctgcgttgatgcccattgctaggctgcgacggcggtggaaccattgaggggttattcctacgcttccaacaaagaggaagcccatcccccagccgaagcagacaccttggctaagaaagatgtgccatagttcggtagcgaaagatgagccgataagggagagggtttcaaaaaagaccccgaggtttagaaccaggcgggttccgcagatgtggatgaggtatgtggctagaggagctactaggagggcgcaggagatgctcaaaccgccggtgaaggcgtaggccagggcagaaccgttggcaaagacattatgcgagaggtagtaggagagaaagacgccgtagctctagatctcgggataaatgtgtgtgttagtccctgtagtgggggaaatgatttagaaaaaccaacactgttgattccccacgtgtgcgcattgatccagaagacgcaggcaacacaaacccagccatagccaccatctggaacgatattctgttcatatttggtctccgcatctttgggagccgaaccctgttggtgctgctcctgtacttgcgacagaggatctagatttggagtctcatcataatctcgcgaatggatgatgtcgattggcgtattatctcccatttcgagataccaggatcaaagataggtcaggagaatttagcacgctgctctagaccacagctgttaacttccaggtaccgcatcgaggacactatcgaacattcacatgaagcctccaagagtagccaagaaagtctagtggtagagcaaaacagaaagttgagcggggatagagatcgaagaaccgcatggcgccggttttatggcaagggtccaggaaaacagaaggcctaaaaagcgccgatgtgtcattgagagcccgaaaagaaacaagatcctcggccatacgaaccagtcagtgagccctccgccataagcggttcggtgactagtccgagaaagtcagtctgtgactggtttgttgattgggttcaaatccatccaggattgaggaagatagcgcccatgggtccagctagtgcaaccgtcgtgccgattgacccgtgcggagtctggggaacacgaggcggtccactcataataaaatttttgagctgcgagctcatataaagttgctagatatatctgtcggcgatagatcaactttgtacgcttgatgctatgagttctggttttccgtatgggtcctccttggacatccatacatgtgcatgctcctgccttaagctagtagccaaacatcggggaagtgcaacctgaggactgggaatgatcctgtgctatctcgtagagctttaagttatgacttatgacagaataatgcctcgtctagcattagcagctcccgtcagcgtcccagaaggcgcacctgcttacaattccatcacttgctatcacattagttgtacgcgccccgtggcagttggatgtattttacgctggtgatatatcaatgtctatatcagcaagtatacttcccttctatgttgggaatcctgcctgtactttaggtccatcgactgtcctctggagttgggaaggttcaaaggctccgttacttcggtagcaagtcagacgggcttgctaaatccttgattctgtgcaccagagatgtaaccttctcatgagtccgtaatgggtactaggtaaaggagcattaacatccagagaagaagcgttggtcgtaccaagacaggttacacagacgcatactgcgaggcataacccgatctgagggatccgacgaattgatcaatgtttttcaccagaggctgcgttaatgacccacagcctagctattattgtattgccatgcccacacatgcagacggacatttagtccgttcatctcagagggagcagatagaaatgtatgcacacggtggtacgtgtagtgagtgctttattagatttaatgccattatccaacgggactacccaaaaggggatagttaacttacttaactaactagttaactgtgggatgagatgagtcatcacgaccccgcgttgccttgagaaccggaacctgatgtttgcactgtttggttggttgctttgttgtccctcggcgggattgatggccatagcttctgtctgtcttccctctgtcggccacccctgccggtcagtcagtactagtatccatgagctcatggaaactaatcgttattaactactcactaattactgtctctgatgcgcgctaactcgctaaccctgtaagaataacgctttatcgccctcaagcaaggaaaacggatctagttgggcagatccgatctctctagttgattccatacctggcccactgcccagccacccatttgaatctcattggctctattcgattatattagacacttacttcatagctctgcgactgagagccaactcatcatcctacccctttctgatatccccccttggtatgatctcgcaggtgcaacttccatggccagtatgatgcataggcctcaatttcacaaggccagggacagccagcgcaaggtctcgcctcccggtccaacttacatgtccaacgatcagatcggtacgtgtttacgctgctgcgatattgagtcagagcattgtttgcgttttctaaggatgttggccgagcgaccggctgtgggttgacattgcgatattaattaattcctggcgtaacagcgacctatctgaaagatctgcggacgaatcgtcctgcccgtcccagcggatccaggccgcttccttcgagatcaactggatcgtcctctgacactcgggaggatccccctccacgggcagcatctgcaatgtcgtcgtatggacattcatatatgcactcgacaccagcagctgaggccgagcatcctcgggccaccagctcactttctaaccataggccaacttcatcgcgaggcgcactgggcagccctatcggacgaccgttggtccaggaaccaaggacagtccccatacggcagcatatctcacccacccgagccttcagtcgcgcacttcctacctcccccagcgccgcttatcgtgaaagcccgcaacggcgcatagagaaagaagaggcaaagtccttacgagatgccttgcaacagatggacctggaggatgacgtcgagctccatgcagcagcacaagatgaagctaccgagctggtgtggacgcaccagaaccccggtgttccctataagaacccatatgcaccatatcacaatcctgatttggacacgctccagaaaagcccagataggaaaagtcagtattcgcgtgacgagaggctaggctctcctactccacgacggggcagtcgtcgtcttgcctaccagggatcgactataagctacaacggtcctagcagcattcaagagtcggatgaaagggcagcacatgatgagcaggaagttgctctggaaagggatctccccagccctaagaagaatggcactctacggaagaacctcaaggtcaactttgcgttgccgcgggacgaagtttcaacgcagcataccagcagcagctatgggctaggcttggcgaatgttggtagagattcatccaaaggtatctttaggaacccgaacgaccagatatacgaagaacctcagctttctcctcagaaggatgaggacactcgaccggaattctcaaggtcggactcttcggctctaaggaataagccacgcaacgctcttcctcgcggttctcgtcccctacctagtcggttcagtagccttccttttgtggacaagctggctcgcttcgaacttcataagaaccccccaagccagtcaagaaacccagagtatagaatgaacgatccgcttccacaacctcctacggcaggctctgaggttgaggagcaagatacccctatgaaaaatggcctagaaatccgcagcgatgacatccgagcagccactagcaagaaactgagagatcggagcactcgcctacctatgccaaccgctgtgagtgatcgtgctggtcggccgattgtgagttttgatccgacttggaagccaactgaggcacaaagtccgcgcaaccgagacagcttcaaggaaagggatgcaacgccggacgtgccttctcctgagcctgctgctccgactattgaggtatccgaggcaccatcaattccggtgatcaacttgccggacgacaaagagcccactatctctgagatggcaggatcatcccagagcacaacgaccggtgcgaagtcatcgtcgagcccgcccaaaaagaacgaagctcccaagcgatccccaagaaagccaacagcagggttgcagaatcggtggctatccacctatagccgctctggtgttcccactgcaacatgtgaggcatgttctctcccaattgcagggaagatagtgaccgctgcgggatcccgattccaccctgagtgcttcgtgtgccaccattgccagactgctctggagtgtgttgcattctatgaggaacctgaagtgaagcgccaagagcgtctcgcgcaagcttccagtgatgatgaagaggcccatgcactgaggttctactgccaccttgatttccatgagctattcagtccaaggtgcaagagctgcaaaaccccgatagagggagaagtggtcgttgcttgtggagctgagtggcatgtcgggcacttcttctgtgccgagtgtggtgatgtacggtctccccctccgttttgtaatcgatgactgctaacatatctcctctagcctttcaacgccgatacaccattcgtagaaaaggatggctttgcatggtgcttgcagtgccactcccgtcgcacagctcctcggtgccttggatgcaagaagccagtgttagaggatgttgtgataagtgcggtcggagggcagtggcatgatgaatgctttgtctgccacgagtgcggggatggatttggtcccgacggtcgttacttcgtccgagaaggggaaccgagaaggacagccaagggacgcatcatcggcgggccggtccaattggctgtctgtgaaagatgtgaaggtattcgcttgaaagcgtcgccatgatgtggggtatctgttggatggtggagtccggggtctgaggctccaacaaccgatggccagcgccaatgacatgatcattgtggccatctacatagtgctgagcgcagtgcgctcaacaaggtgcatcatccgacgttatacggccattgttttctgtgtatgtctctcaatcttttctttttccttctatttgttgcgacctatgaattgcatagcatccagcgggagtctacgatagcgtatacttaggtgaattatgatagtgaatagtttacgagacatactctttcttggttcagataaagtgttgaatactttaaagccagcagcgcaacggcatctggttgttgcatggaaaacatctcactagctacaactaacgaagaaccccctggggtgagatgcgtgcataattccagagccggttcaaggctattccggaaaaggaaggcacgctcctgtcatctcggctcgaggcatcgcttcgtctcgcggcaacttccctgcgagggtgtgattcctttgaactaaccttccccttccctagatgggcaacgaggcagcttggctttggcaagtgtcgattgtcatacgagtgcctcgagtcgaggcacctgtgtaatcagttcggcaagacggagaagcttggatgtcaaccccagctttgcggggttccccgagcttttgcggggatcgtgccctccattgccgtcatcgcactaaagccagatgtacgaccatctatcgattgacacggctcttgcgcagggatcgggagattcagctgctgcaatgtccttcggatgacgtctgatccatgtcgaacgatggcagctagagcaccacatcgtttccctattcgcaatgccggcataggcatcgtgccctaagcgggcagcataaatatcctgcaaggagtcgatggtctggcgataggcatgtagacaggcctctcagactaaatattcccaaccttccttcatctcaatgacactttacctctattggtcacttcaaaatattgctcagatcagtcccttatggcagacgattcaaattacaagctcaagtgcgatgcctctctctctgaggaaatagagaatgtcattacttcacctttctctcccgaggaagagaaagccctcgtgcgcaaggtggacttgactttacttccaacaatatggatcatgtatctcctctcctacatggatcgaaccaagttggtaccccagtcctcctatacatcgctacaaatccgtaactaatctcaccatatcagtatcggcaacgcaaaaatctcaggtatgcaggcagatcttgatttgacatcgggccaatattcaattgccctggttgtcttcttcatcggatatgtcgtctttgaagttcccagcaagtacgttccgctccaataactcaggatggtcgtaagttgatactaaccgttactgaactatatagtttggtactaagccacacgcgcccttcgctgtttttaactggaattatggttatatggggagcacttacctgtgtgatgggcgtgataaaggactacaagcatcttgtggtgttgcgtgcattgattggtgagacttcttactgactcatctgtggggatagtatgttcctaactttggtaggctgcgtggaagcaggcttcgcacctggtgttctccttgtcctctcgtcttggtacaaacgaactgagcaatcgaagcgattcggtgtctacatatctgctgcaatcctttctggagcgtttggttctttgctagcagcgggtattattcaaggcctagaaggagtgcatggaataaggggttggagatggctcttcatcgttgaaggatctgcaactgtgggtgtcgcgatcatctgtgccttcatcttgcccgacttcccggccacctctaagcgcctatcagagagagagcgatatgtggctattacacggttggcgacagacaatgtcacttctttgaccgaagacagcccggagttgtcacattggcacgctgttgtcgagtcggctaaggattggcgaacctggggctttgtgatcgggtatatggtatagcaatccgttggtcatttgcataacctcacaactctgacttcaaacaggtaattgtcggctctagcacactttcatacttctaccctacactcgtggagggccttttcggagattcatccactgaaagggtaaatttcctgacagtaccgatctacgcagtcgcatttgtctgcaccgcgatcaccgcatacttcagcgacagaatcccccaatggcgaggccttgtcattgctggctggctgagtgcgtcgctagcttgttccattgcagtctgtgttgtatataattatactgcacgctatgtccttctcgttcttatggctgctggattgtgggcaaccaacggaggcacacttgcctacgcgtcatctgcatttgcgaacatgcacccgcaagtacgaggcgtcagccttgcgctggtaaatgctttggggaatctagcccagatctatggctcggtgggtctggccctggcgtattgttattgaaggttatagctaattgacaatagtacttgttcccttcctccgacggcccgaagtatatcatgggattctcggtgatttctgcaatgcttgctctcggagtgattgtctttcttgtgatacacgtctggtttcgtcggcgcgcggctgcaattggtcaggcgtgatgatccatgctgggcatggggtagtttctaattacaggcatagaggggagacagaacactaacgacgacgatgatgatcttatgactatgggcctatgacagtacgttcctgattttctcttttataggttagcgttcgaaagctttgggtgtcttacaggaatctttgaatgcttgtcctttccctgtacttattcccatgttcggagcaattggcgtccaggattactctagtgcagtattatcttctctgggccgaactcagccaatctacgacgtgctatcccagacatcgcgatttataacaaagatgatggatccacaagaccatattagtacatattataacagaaaacaattcaaaccatgtatatcagaattaacttttgtttatctcgaaacaaaatgttttacgccatagatctatacaaaacgaataaaacagaaatcaagcccactccggatcctcctttctcctgaacacagcaacgtacttatttcccttattcctcgtgaccttctttccctcctccgtcgcctccttcataaccttaacacactcatccttctccaactcctcctcagacaccctctcaaacaactccttcacagtcggtccctcattctccgcctcctcaacggcactctcatcccggaaatgtctcagaatccaatgatgatactcctccacatccgtaatagtgtacaaaagaccgccagggcgcagcgcatacgcatactcggcattcaaggtctcggagataatgcgcgccttgtgcttcctcgccttgaagtgcgggtccgggaaacagatgaagatcttcgacagctggtgtttgttgaagaagttcgggaagaacttcatcgtgttgctgcggatcgcagagatgttttggtatcctccggggacgagagccgcgctggcgttcgggtcaggaggcgccggggcatcggagggggtatcagcggcggctggggtagtaggggcaggggtggaggtcgaagaggtcggttgggactgtgattgtgtcttctgttgctgttgctgttgttggacgcggagcgcttggatacgagtgttcaggtattcgaggacggcgatgcggatttccattcctataattaatattcagttagatcatccacatccatggctctgtgagaggagaaagtagacaatgtgagatatacataccaaccatcaatgtctccggcaacaaccccgccagaccaacaagcaagccaccaaatccacatccaatatccacaacctccacatccttaagcagctttctcgtcccgatgaggttcgtctgcgtggcatcggggtttacgaaggcagggaaatgcgacgcccagtccatatgcgccgggctgaggggactgtatagaagaaaaaaaatggttagcccgacaacttcccgaccaacccattgacctcatttgcaatgtacaataagaatagaatagcaacatactagttcaactggtggtccgagaacggattcgcatgcgcccgctgacgatagaacttcttcttagggagcttaacatgggccacgggggcggactcgtccggttgcgcaacgaccgcttcggcggcttgtttgcgatactcggcgcgcttttggcgcttagcaggaggttgagacattgtgattctgaggtttaattgaacgtgatgaaaaagtgggaaagattggagagcctggtaagaaggtgggggtgcgcggtgcggtgctgcggaggttgcggaaatttctaaggcggagaagttagttccattaaggttgttggctggcggtatctactgacgtccttatcgatcactaccaccaaccactatcatcactacatttaccatcgtgacaattagcccaaccacatcactcttggagactactccacagcagcgcaatatacctcgcatcgacattcagtctactcacagacataatcaccccaccaccaaaatgacaagcgcaacaacatcaacaacaacaacaaccccacccttccaattccccctcacctactcatttccagccttcttcaccccccaacccaacagcacgacacgcacctcccaactccaaaaatggtcttccctgatccaatcctggtgccgacaccaccgcgtctaccgactatcgttaatcgaagccatcgagtcaccattattccataacacgacgctccgaaagcgcatctcgatgagcgatgcgcgggatattctagactggatggcgaaaagtgaagaggagggtggtggcgggaagagagcggagtggattgatggtgggagtaagagtgttgcgtggatttggtggaagaggcctgaggagtgggcagggttgattgcggattgggtatgtattcttatattccggatcatcattcgagatgttggaggggagttgggggtagagttgggattgaggggagatagttgctaattgcttatttttgctgtataggtggaaaacactggccagaagaacgtggtgcttacggtttatgagttgttggagggggaggccacgatgtcgcaaggtaggttaagtggatttgctcctaatcattgggtgatgctggtatggtatggtggctaatggttcggctggaatagaatggcatgggatggaccccgatgtgatgcacaagtccctcaatgttctcgtgaaacggggcaaggcgcaggtcttcggtagcgaaggccaggagggtgtcaagttcttctaggaatcggctaggttatctggccgatttacagcatgcggttgactcgtgggttcgttcgaaagcaatgtccattggcaacgctgaggatacggcaactatcttcatgataaagtaagggatatacaaaaaccagacaatgtccccgaaagagctatacgagtttcccgctgttcataacaagcaaatatgcctcatcacagcacgcctctaacaccatgctcatgagccggctactgctccatcttttccgccatctcctcgtctagctcatatgcatctgctgcgcgcagcgtttgggacatggcgatatcaagaagccaatctacccggactatccgtggtgttttgcctctgtttaggaccatctggcggaaccgcggccacagcttggtgtggtctgcagaagtactgctcagaagatatacctcctttcggctgcgatcgtcgtctcccgagctctcttcctcgctctcctcgcgctgtgatcgatatgaaacgcgaccacggaaaagagagcattctcctccattagcatccacgatggacttgaatgcgtcaaaaccaccgcgaatggtctcgacgcagtgtatttgataccctcgcaggagcttgttcttgttctttttggcgttcatctttgcttcttctaatgagaacccatatttcttctcggaagcgtcatcttttagagggaaatcagcagggtccagaagttcgtctttttcgaggcattgcgtgatgaagtcaatgctcacaatagctggaccgtatgcaagcgcgttgacaaacttaggagttcgcaaaatagagggagcagcaagatgagagcatcttcgggcgtcttggacaaccaagatgccaagctcacggagctgacgctgctcacagtcagaggggcactctcaatcatagacatgtacaaagaggtgaacaaaccttatccgaatcttctttcttcgggttcccaacccatttttgataacccgtaatgagaaggtgcattgcgacagagggcttgcccttcttctgcctctttgcttccgtgctgtcctcttcatcgctcttgtcctccgcttccatggaccgccgcttcttgccattgttgagtatgactcgatcctcgtcggtctttcgtcgaccaccatagatcacgccaccaacacgcttcttttctttttcgtacagggcaatgtccggggcgatctcgtgcagtcgggcggtagcggcctctttcgacttccggctacttgtcgtagatggagtatcattctccttgccttccgacgtaagccgagcacgcgccggtgtttgtaacttctgattatctgttgtacttgtcttacgcgacctttcaaccgctcgcggagttgcgatttgcggctgcggcagtacttcgctctcggattctgtcactttggctgatggtggttgcatggtatccgatgacttcgcagcaacggtattctgttccttggtttgcatcgcccgtcgaggactcacctgctctcgggataagccttcactttggaagaatatgctttcaaggaccgttctgtcgagcctggtctggccaacaacttcgcctaggttcgttctcttagggaagtgagtatagcgcggatcagaaacgggttgcaacttccatcttgcgtaactctcctccaaccataagtgattgacaacctgcaatccccactcctttgccgcggcgcatttctcactattaccatgagcagtcacaagatgggtattttcttgctttagcgtctttgtgcattctgcgcctgttgcggtgatcagattctccaaatatgctcttgcttctccaacatagttggacagactgatcttgaatcccttaaaccctgggattccagaccgcgagacaggatagtgtagcaatcgccgtagaggagatgtccaggtgttgtaggtcatcaggtggtaaagccatgatagatttccaacgtccttgttcagcctcgatgccatacggtatgcgaaaccctctctatagcgacagatcaagatatcagcctttgagacatccgtcgtgatagagccgccgccgttcttgatgataccctcgatggacccgagaagacgaggtccaataccgaggtctgtggagagcatgacattcttgtcttgaaatacggtaagcgccggctgcgcgtcaggcgatttgacagacgagggaaggttggctgggttcgttgtggatgcgccgatgatgtcacggttttctgaggaacggatgggtgcatctggcgctgcacggaggatttcggggtcgggaagggtatatggacgctcgtcgattcttcggccaagctttaggcagtcgtcaaacctatgtatggaaaccattgttagattggtccagtctcttcggtcactaccgtcttaccagtgtggaagcactatcttgatattcaacttctttgcggcgattaatcgagccttatcggactccgcggtcaaatcaaccaaatgcgtgacctgctgagagaccttcggactgtagatcccacctttcgccagcacgccaccgatgatagcctccttatcgcctcctggtatatcaccgcatgtgatcaccacatcgttcaagaagagccgcgggtcaggactatattggcgcggatttgctagctttctctttgctaggcacgcatgtacccagtgaggtttgacgactggtatcagggcgtcccccgccgcgtcgaaggcaggaaagtcaatcgtgcaggagatgaggtgggtgaaatcggagaggggagggaaggtagctggcggctcatagatcacagtttcaccgccatgttcttcgaatgtagatgcgagctgttatattcaatagttcttcccttcagcctgcgtaaaatacccaatatagcatgtgctgggtctgtcatacctgatgtgccgtgtcggcactaagatctttagagcatatgatacagactttgcactgactgaagagttgaagctctcctccctgctcagccattatgtggatattttccggtcagcacgggtgtatgttcagtatgtagtgcgcttcgagcggaggtagtagcattgggtgaaagatacgtttgacttgagagaccagtcgtcttttgcctcttgtggctttgcgatgcgacgcgcagacgcgccgacacgacaccaggtcacgtgtagataagatacgtcgaagatcgtcaatatgtggtgtcaggcacgtcttatccacgtcgacttggcatagtcagtatgtatggtgtgtaaaatggactttgtcgtaataagctccagctttggtggggaaattacgatattatagtcttgtggacttccaccggacggatgagtaggccgcggcatatgtttcggaacgaagcaagtgaatcaacgataggatatagattggccgtatgatgagttagtagtacgcgtgctcacattatggcgtgtggtagtttttaaccttcatgttgtcgtcgcctgatggaataagtagcagtgttatgataatatcttaggccaacatagtatttgacaatgtccgaagagctgcaactacgagtatgacacaaaatatatatctggttctatgatgcgagttacactcgctacaccccacccgtatttcgggcatgattttttataagcatcgacgtatctacaaagttttacgtagcgatagccgacgaactgaaactcacttgaaaacaaagaataccaccgcacatctaaaggtgtgtgggttatatataccataagcaaaaaagacaaaaagatatgacaagagtgggattcgaacccacgccatcttacgatgatcaggaagctgtgaagctaggtattaaggtggaccttaacctgacgccttggaccaactcggccatcttgcctgttgatatgttaagagcagtgtactttgacaatatcaatggcaagtctggcccaatgtcatgacccgattgcccgagccgtaactgtttgcctgtactgtgactagcggtatcagccgaccattcacattccccgcctgacatttcaatccatcaagcgatcggccattttttccccggtcgctcctgatcatgagcctcggctcatcgtcagccccggcagttcgaaccctccggtccggggaataagtgcccccccttgcctttaatccatatatactagagtcgcctcggatcgtgcgacaccacataaacccattgataaaattagcaaaagaaatgtcgctgtcttcacaatcctctggcccttttcgggtcgttgagcatatcgtcgaatgccaacatatcagggagtatcccgcggcgacggcaaatggccaagaagatgtattgaatttggtggtaaaacaatatatcccactcgataatcccaacccacagccaggggatgtaacgattcttgctgcgcatgcgaatgggtttcctaaggtttgagggcatcacatcactgagttcgaatgaacgtagctaatctatatactaggagctttacgaacctctatgggaggaactgtacgctcgatcaaaagccaatggcttccgaatcagaagtatatggatggcggatgtcgcgcaccagggcgagagcagcgttgtaaatgaggatctcctgggcaacgaccgtatggaattgatcttcattgctcatcactcctcgaattgatgctgacgaggtgcatatagccagctggttcgaccaccccagagacctccttcaccttatcaacgtcaagcgcaaagagatgcctcgccccatcgtcgggataggccacagtatgggcggtgcacatctgtatgccccccccccaacctaatcttaccacgaactaaaacctaacacctcccacagcgcccagctatgcctaatgcacccacgtctcatccacagcttagtccttctggatcccgtaatacagcgtgaatccacccagctcgacgggctcgaaatggccatgcgacatagacaacggatcgccaaaacaacccaattatccacctaccgacgggacacatggccatcccgtaaaaccgctgcggaggccttcaagaaaaacccgttctacctagcctgggattcccgcgtcctcgaccgctggatcgagcacggtctccgcgagctccccacggccattcaccctctggacgaatcccagcaaaaggagggaagcaacgaccgccccgtcactctgagaacaacccttcaccaagaagtcttcaccttctctcgtcccaactacgatggtcccccgggaaaaaaggttcccgtgaacaaagtgactcacccggatctaaatcccgaacatctaggttcatggcccttttaccggccagaaccgtcgcgagtgttcgctatgctcccgcacctccgtcctagcgtctgctacgttttcggagggaaatcggatatgtgcttgcctgatatgatggcggataagatggctgctacaggaacggggctgggaggtagtggtggggcccctgctggtcgggtgcgcgatgtttatcttgccgaatatggccacctgcttgctcaggaggctcccaaagagtgtgctgaggcagcgggtaaatggctcggtgctgaattagagcgatggagaactgaggagcgagagttccaggaacagtggagtcggaagtcaaaggtcgagaaagtcacaattgattctcggtggaaggaccatgttccgcgtccagagcggccgaagaagcctgctcagtcgaagctgtgaatggtagttgttggtttgtggataaaggctgcacactactccagcgggttgtatagactgcgtcctctcagcaagacattaatatattacgtatatacgtggccagagagatacgtgcgtgtccaatgaaatacccagatagagagatctatgtttgtctcttgttctcaatttcttatctataggatataatggtatactcgtctgagcggctcagagcaggtctataagcaactcaatcaatcaaaagtggaagttagcgactgttccgacataggagagcgctcgaagctccggtcctcgaggctcctcgaaaggtcgagtctaaaaaccatggaaaagggtatgtgtaagtccgattaattcgacttcttggccactccattcgcgcccttgcctggagcgccggtgcggagaacctcggggatgttccaaatgcgaggccaccacagatggtactcttcctggcggttgttcaagcagtgacggagccagatgccccaaacaaggtacatataggccccaaggccagtcatcaaatgcctagtaagaaaattagtattggaagggcagtcggacgcatagtgtcagcgcgaaacataccaccaaccatggccttccagtagaatgccccagggaagacccacttgccggcgccatccgcggatcttcggacagaaggcattgtccaagccccagatggcaaacccgcccaggaacacgctcaaaccgtagataaccatgaaccacattgtcttgagagtcttgatgtcccgcacgttttcgtaatgttggtgttccttagtcggaacgggcaggccctgcttctcacgcgcaagcctgtcctcctccgttgaatgacgccagcgaggacgaagcgtcacctccatagtgtacatgctgcggatgaggacgatggctgtcaagatgccatatgcgttctggtggaacaggggatcctggaggtagtggtagtaaagggtgatgaaaattgccaagctggcaagaaagatgcccaggacgacgcggaagccattcggtctggagtatgagaaggatgcatagcacatcagacacgtggtgtatatcatggacagttcatcgaccagctgcatgggatctgtgtgttcaatgcacggattagcaatttcgaacaacacaggctacccctcccccacgatgccacctcacttacatttcaacgttgaatggaagaggaagcttccagttccgactagcagatagccaagataagcgacctggaaaatcgagtcatgtccattgcgacgacaacttaggaaacccttgattccaagggccataaacagcaggtttgtcagcgtattgacgatctctgcggagtagatggtggcatagtaatcctatctcgttcgcatgatggttagcaacctattgtaatagtagaaagagtaaccaagagtgaagtggaactgagcgccgcgtatacctcttcgcaccaattcagcgtggacgtgacggggctccaatatccctccctggaggggggatacggaatatgggggaggaaggatgagagaggcatgatggatgacggagactcagctctccgcaggctggagggattggtgacgtctctggcagaccacaatggaacgacggggttacgagcaggagggcatagcaaggggtactcttgaagaaaagccagattccctgaagagaaaaaaggaaaggcagggcagttaagtttgacaactgaaggtggccatccacctaccagttactctgccttaccggctccccagaaccgtgacgtcgagtaatacgcccgatctgcaagccagtcgcctaacctccaaccgaaccggcgtgaatgtgacggttaagtacggaggaaggtatgccacccgctaattacagggtcccgattggctcgatgggcctgggcagtttgccgccgggaacaatgggtggtaagattacagtgtaagtacatccgccgtgagcgtggccaagtggaatgaatggaatggtctcttaacaacctgcattcttctgcatgcattggccgtggtgtctccctatcatgtctcactctgtcaagtgctaaaccggcacctgttcggagaaagctcgtggattggtttatcttaagttgcccaaatgcagcctagtagttattctcttgctacaaattttccgtatcacgacatgatcagccctgtgactactactagtagtactgtaatatttgtagttagttgtagttcgttattactggtagtgagcagcgataggcctggttgttagatatagtactatatagtagacacagcatgttttccagtagttcttcagttcctgtcagtcactgcacaggtacgttaaccttaatctgaacctgtacctgtactaggtgtgcctcttctggcaagtccttacgccggagatatcggaagtcgagaggcggcgacggccgcggcaactgtggctggtgatctgcgaccaatcgagatgctttccgcccggcaccagatgacttcaccaatggccctccgctttgggaaagaacgagtctaccgcttcgtatctacaccgtctgtcactaatttttccctttctctctttcacactcgctgagaaaaccttcctatcgcctatcattttcacggaaatctgatttacgccgcttcgcttctgcaatgctatcctgattaccatcaatgtgaccgtcaccgcttcaagcggtctgtctcaaattcttctccatccattgtcgtgcagcgtcccggatgagttgatctcatcacgcgtacctcttcaaatcactcctctatctatacatattcttagcactggctgcgggatccgaagccatgtcgaacaatgcggtctatgctgtaccgcaggtgaaaaccaccaaaacgtgtatggccactcactcatctacaattctcttcactcagtaaaccctaaccatcaaatcaatcaaacagcttccaagacaaccttccacttcaccgcaggcctcttctcgggccttacctcttccatccttcttcaacccgctgatcttctcaaaacccgtgtacaacaatctcagaacgcctccctccttccaactgtcaaggccatcctttcctccccaaatccaatccgcaatctatggcgtggtacactcccctctgcccttcgcacgggcttcggctcagcgctgtatttcacgagcttaaacgcccttcgaacgggtctcgttcaaacaaacggcattgctcccgtcaccaatagctcctccgcactccccaaactgtccaacaccgccaatctagctaccggggctgccgcgcgggttgctgccggcttcgtcatgatgccagtgactgtgataaaagttcgctacgaatcagactactacgcctatcggagtctcttcggcgcggggcgggatatagtgcggacagagggattccggggcctgttctccggatttggagctacagcggcgcgtgatgcgccgtatgctggactatacgttttgttttacgagcagttgaaacggcggctagcaggattatcaagctcatcgtctgatcagcagccactgaagtcgtcctcaattaatttcgtctctgggggattggcggccgggctggccactaccattacaaatccgtttgatgcggtcaagacccgattgcagttgatgccggggcggtatggaaacatgatgcgggccgtgaggttgatggtgcaggaagatggagtaaggagtctatttggggggttggggttgcggattacgaggaaagcgcttagttctgcgcttgcgtggacggtttacgaggagttgatcctgagggccgaagtccagtggggatcgaagggagaataggctgtctgtagatcatattaagggttctctgttgtagattccttagaaggaaaagggttagttagggctggagttttgttatcgttatgggtataaaaagagctcggatacggactgcaccgggtcgacgtttggtcatcgtcatcatcattgtatcatatatatagcaactgttcaaatcccaactcatggaacgaaaaaattcacgacatcataacttgacaaatcatcatgccaacatcttgtataggatagctgtgcaaatgaacaagagaacgaatatcgatggacaaggcaagagaaaacaagacctaaatcagatcgatcaaatcatggtatcacacttcgtagcgcgtcaaaaattgcgagattaagtgaagatccaggcacgtgcgccggggttcttcttgcggacaaggtacattttgtccttctttcggtcattcaccttgagctcggtcagggtgcttgagtgctgagtgacaagcttgccctcacgcagacgccgcgtatgagcgaacagctcctcctggaagtcctcggagatccattgcttgatgatgatgtagttgccgtcgagctgttgtgggaaggaaacggtcagtcatcgtctaagatatctcaaccaagaaggtgtagcaagggctcaacttacctcatcccagtcccagggtagacggtaggcaataagtgtgtcggggagaagatgcttgcggtggacctgagccagtgagttagatgaacgacgacttgaatagggttatggggggatggtcgcataccttgatccaggtggtccgttggggctcaggttccttttccttttccttttccttctccttctccttctcaggttcctttggcttctcaggctcctcctttggcttttctggctccttaggtttctcgggctccttctgcttcttgataatcttctccagctgttcttcatcgtagccgaattcgagtcgtagtctctccttgaattcagcgtcacgtctctttctctcttcgcgttcggcgatcattctccgctcctcgtttagcttccactcctcgatagcggcctgcttcatggcggcttccttccgggcacggtcctgctcagccaggatccgcctggcctcttcatcacgaagctcttttttgatgcgctccttctcttcatcctcttccatcttgcgctgaatctcttcgagctgccgttgacgcaacttttgtttgagctcctcttgttcagcagctttacgctgggcctcttcgaatttaatcagttggtagcgatgctcggcctcacgctgctcttcttccatgcgctgcttcttctcgtaccgttccagccgtcgcagccgctcactgatctcgtcctcgtatagatcctcctccctcagcagccggagctcatggtgatgatggtggggagagcgatgctcatgctccggtgccggcggaggcgggggaggctgcggctgcagctgctgttgacgatgctgggaggtctcacgatgacgagccagctcccgctctagacgcgcgatctcctgctgatggcgcaagagctcaaggtcctgacgggcatcattcctctcgaggaatcgcgtatcgagcatcagctcatagtcccgggcaggtgggagtggtgatgcctcccgggagatactactcgggcgagtgcgagctcgacgatgatcccgcaacctggtctcatcctcagactcgtagggatcaatgtagttttgctgctgcttgtgttcctgtttacgattcttggtggcactcttggtacgagcgtcgttcttggcatcgctcttcgcatctgtcttggcgtcggctttggcgtcatatttgttatggacgtcgacgatgacggcgacgggctggttgttgcgttcgcgttcgcgctcgcgctcacgagcgtggcgacgaggggcgccggtggaggcagagcgttgaggggggtggtcatggatcacggggctgaggtaggtgttactgatgtgttcggggctccagcggtggcgggagatggagcgtcgacgagttgtgactttccggcgcggagtcgtctctaccatggagtaatccgattcggaaaagtcagactccgaatcggtgaggaggtgacgtcctctaggatatgctgaatacatggcggtggatttatctgctccgcctatatcccctcttctgtgattatgagcagcttgctgcgtgcgtggatatagacggtagggtcagatgaataggctggcggggtgtgacgtcgatagtgggcagcgaatcagccgtggtggcggaggctgggcgatgatagcaccccgacttcgagctgaacgatatgccgctgaaagtgaggaagatctgacgatggaagtcagagtagaagaagtaggtgagaaatggacagagacgaagaggaaagggaagagaaaagaaaagtcaaggcaagtcagtgatcaaataggagcgaaaacaagaaaaaccggcccctcgtgcctcgtaaacgcgggcgcttcgctcagctgaagtgggggattggcaaagattgggccgccttgatcagctgcgggcggcgacaattaaggattcaggtacttcccactttgtcttcgatcataggcagagagtcctcgaatttacgcgaagctaggccctctcatgcagaagcgctgaagctacggaatcaaattaacatctgtttatagaaccttgacagcggcggctattgaaactgtagtattatgtagtctagctatagaatgtagtgaattggtctatctcgactcctcaaaatcgagtaactaccagtacgagatgcggtggatgctggtggtagcttctagttcgtccagacagcatagcgtattccatcgtgggaaaagaggttgggcgtctaaagcgccacccacgccagtcaattcacccaccattttgcgtcaacttcaggttccactgcttaatctatatttttatttgttatcaattagtctatctaccgatctattcgataggagaattccgtcgccttcgctcactcacccaaggaaaaacccacgggtctaaccgttggcgtacccatgggaccctgggtacctgacgtccaacccagtcttagcggtctagtcttgctggtaccgcggcagtggagattatctatcgactagttatcttctgacccgtaaagtcaaaagtagggttcagagccacccgctcagcaggcatcaaggatgaccaggcagtagtagtgaataatggcacctgacctgaattcagtgattagttggcatttcggagatggatgacttctgttgtgtaccctacattactaggaggaggcattaagggtctagtctagtcgattgctgtttggcccccactgacaactaatacatccacagcacagccttgtgggccgaggctggccaaaactcactctcaagtgtctgtataggcacacataactgaggttattaattacatagtacttatttggagtctctcattcatgtagggtgtccgtcagctacaggcctgagctaatatgtatttgatgctctggaaatatccagagagtcctttcatagctagtagcatacttttgttgcttttcggttaattcgttgaattttggatgagatagaccgacccccaaggagaattgtaatggtttcattaacaaggaaagatgacccagaatatcttgaacgaatacttttattcaatgagttatagaattttgacaaaacaagtcctttatctccgctagcatatgtagcgactcatatattctactattggtatcacaaagagtggctttcaaaaggaaaggattatcaggtttcagtgagcttgccaaagaggttgcaggcggaatggtactagatacctagtatctgattttattcattactttcattttgacatgtaaaggacaaaatggatctctaggtctgatcacgaatttcactcaactctgcactctacgtgtaggcatcaggtagtgtctaatatctatcaattattgcagataagaaaagtgagatctattacaggttgtaggtagcaaagtgagctagagaatccaaaagaaagtaacgatcaggacaggacaaatgaactggaaaaacacacacacacacacacacacacacaaaaaggacaaagagatgccctctgccttggtcatattccacctgctaatacaatgggattgacttcagtgcaagttccttcaaggtagtctcccggacttgtcccagttgcgaacacttattaatatcttctttcttggcttatgtagccaaaagtgttacctatccttgagattcttgcccaacgcctcctccttttcccgtcgctgtatataccagaagattaccgggtatgccagatcaaagccgagatagagatagcagcaccagagcatgaaaggctcgcccaaccatccaaaagcctcaggccagtacttgattcgaaggtaaaattccgggatcagagtcaacgagcccgtgaatcggaaaaacctgacaaaggtaaatctctttccaacagcactgtcatgacttctagacctgggtatacgtaccataattgaagggagaatccgcgtgtggctccccgaaccaaaagctggctgacatatccaacacttaggatgacctgacatacgattgcgttcgcgaagcaagccttcaccatgccgagctctgaggcaaggcaaagatggccggcaattgccagtaatattccgcccccatatatccagggcaggttgcgttgtattattggggatcggtcccactccctggatccccatttgattgctgcgaagataacgccaaggttgcttatgacggcgacttggaaggttaagcttactaaccagtggtccagagagaacaaaaagccgaaggtgatctcccatgcgatgttgaggcactgacaaatgagtggcatggcaaaggacttatctttgtaggatcggtatatcatgccatagtacacatagagccagatgatgttagtgtaagcgttgaggccatagactgttgaggcccagaccgcgaattccgggggagcagccgaaagatcaaaggcttccattctgcgtaggctgaataagaaagcaacagggtatgccaaggtagtatttgagaggaatagggcggttttgtttccggaaaggtccccatgggctttatacccacagcacaagtaacatggaatattcaactgacaatttcaggataaaattggaagtcaaaggcgaggaacggagttccagcgagctgcactattgactatgatcaaacgcctgacagccccgacctatgcacagaactattccggcctcattgcgtttgattgcaagtagtgggtctcagagaccataccagaatcattgatctctcaagaagccatgcgttccagcagactgacataccgaccggtccgatttaaaagtgccatggttgagcttctccaggcatagaatgggatacccgcttccttcatcaatagcccgtagcgactgagacatagcaagcaataaagtatctggtctgttgctgattctaccgttatctgaaagtcagagcgctgggaatagtcaaacttgcattcgtcattttgagttctgggttagtcaaagtgcagcataatgtgttctaagctccgggtgacccttgtagtgctcattcggtgcattgtaagagctccatccacccctccaacgagcaaaaaacgaccactctgatcctaagaagtagaagtttagcaagaaataaccttcctactcgtccaagctcaagcctacaaattcctatcacccagctaggatggaaaacaacaatgcaggaagaagagggggaaaagaagggaaaaattgacagaaacagaataggctacttgttggttcataaacctgaccagactagaggttggcaggctcacattctgcactccacggtttaagtttgattgcgagtcagggtaacttgctcactggttacgacgcagcccagtgtacgccaccacggagttattactccgaagtatcatgtgtcccggtactatcagctcttatagctgattgttgtactgtcaaacaaaaagaccaaaatagtaccgttgtgcataaaatatgaatccatgaaagggaaccagagagcaatgattgctctaaaggatatgaaggctgcgcgatccaatgtccatcttgccctgatccccatcatctatgccggatcgggcttacagttcggagtggtttaaagagaagaagccggcatggccagattttccattggaaaacctactagggatggggtttggcatgatactcttcttcacccccacatgcgagctgctcatcaacaacctgaccacacattcttcctttgcaactgcctaaacaatataagcagcccatcaaattcgacacagcgcacttctgaatgaatgtcaaatgtttttcttatggataaaccggcactagcggtggtactgcagtgagtgtctcgacttctgtcaggttgccatgactgctgcgccaggtggctcaagcgaccaatcttgaactgatagtttgacttgagcttactgtcccttgggccaggatcaatatgctgaagaaatgagacacttattctaagctgcatgagcgcagatatagacgtataacaaacgagcttgaagatttcctcttacgaaattgaccgatccaatgcatccttcgaccaaaggaaagctttctctgcgttcccaaggttgtttttacaaatgttggtttgagctgcctatgaataaattaggcttatgaacaatgcacaatcaactccggccttccttcgcagtagtcgctgtctccaggggctaccattgttgaagtgaaatacaaaggtgagcaatgcccacaaatgccgagttgaaattcgattttagcaggtaaaggtggatgcctaggacttctcctattgctctcatgataccggaaaaatacaaaagattttcacatgccctggttcttcaaaatatattcgtattcaatcttttctgcaacgagtgtgtttaaaacatcacaattaccataaaccccagaaattatcttagggaaactccctcactattactttcgcgcagctcgcacttgatacaagcggaacccagatccagagaccacagagcccagcagctagtcggtccaatcctacaaatacacgtcagaacaatgcttcttacactcgacctccacactaagagaacagaagatgaataacaagaaagcgaccaagaaaatctaacttaccgcccagcaagctgtggggtaactatcttgaccacagtggatattgtcggtgctctgcatataccaggtcagatttcttagtaacaatctagactgacacaatacacttacaccaagagcaagcttcaagcaatcctgggacgcgtaacagtcactggcagtatggcacttcaggccgagtcagtaacaactcacatctggcttcccatatacagtagagcaaacgtcaaagacatacctcaatgccggcgccacagccatgccaatgataagcccgcgaatcaaggctattaggaaccggtgcaggggaagccagagttcctgcaccgagactcaaagttgcagcgaggagaaggaggaactgcatgttgaaggtgggctttcttgaatgccagattactaataatgtatcggcggttgatgttgaaggatctgatgacaggttgaagcctgagattactaccttctccacgccagagatgagatctttatatcttcggcgcaggattaggcgtccaaagcccatgcatatcacgcatacgccatagatgctgccattatcgaagcataagaaacctgacgaataagcagctttgatgacttgcatatcacgagaatagtggacatatcatgttctgagaagcaacatggccgatggtctggtcatgcaaaatgcaagggacccccagatgagaggctgagggagatgcctctcgtattgctgattctgggcggagggccttgcatttccatctgccatatgttagtgcacgtattggattcagaagctctactcctctgtttgaacaagctgatccgctagatcttccaatgtaagacacgatttcaagttacaacgaccgcgttagaggcggctaccacaatgatctccatcattgtagaacccactataattagattaacttttgcacgttacacagcgccaacgtcaccacgagtcgatggctgatttcagataggatatcatggccaacacagagaaaaggaaccgtcaaaagtgtcgcaaatcaccgcctaatgcgagcatatgtcggatggatcagccaaggggaccatgctgtccttcaacggtctggagtctaacgtcagtttgtacgtaaagtcgagcaccaactgagacatattattccttatcgggcaaggcttcggcgcatcatggaacacttacagggaaacccatcacccaatttgcaattgtcgcaaaaattgcaaatggaccctgcacagctggaatctggcgatacgcaacgttgccctgacgccccggctgtccacctgtatcacagcgggaaggaatagccgcatggcgtgtgcgccaacacggtattgcctgcttatgctcctccgctgctgggagggataggatatagatagatattcggcatgcaatcagcacggtcgagtaacgatgattgcccgagagattcgtgcagcaataatgcaagcccactccgagtttcactacacttccacttcgtaggtgcctagagcagccttgatattgatcccgcccatggctagaatttgccactgtgtatccagagagagccttctagttgaatcgtacgattattaatatatgctgtgtcccaagtccgggggacgcgatgtcccatcatcacattttcccatcgaacccatgttgttcatggtggctgtagaccttgagaacagccaagaaagagatacgcaagctgcacaacagaagaaaaggaattattttctccgcgggctcagtgcttgccagggagaggttgcatgcgagtgagataatggacctgggtggtgagcgtcgcgcaccacatcgatgacgggtcgcatccttgttatgaagtgtagcttagtgggcttgcgcatattgtttcgtagatggctgacatgacttatgagcccggaaaataagaattaggaagattttttatttttattttctttcattttctcatatgctacggcatcagatgtccgattcactgattcgggtcgtcgatcaggatcgcaactgtcattctgctggctgatctgcagtcgcgcgtgagcttcctcaatcctactattgccggtgaacttgtttattgcctgttgggtattatattagtacctctctttctcaaattgtccaaaagagattttgcgtctggtgactcgggggtcctgaggcacgatctcctggagtataaaccccccctctttcctctcctctttccctattccttgttcaccatcattcttttccatcagcgacagaatgccagagatatctttctgggctacattggcgctctgtaattttgtttcctcaagcttgacccttccgtggctctcaacaacctgtgatcctatgcggtttctggccttgctggtgcagccggacttcttctcttccagcgttgcggttccgaccctttgcaatgatactaagcatacaaaatcactacaatgtgcgatgaagttcaaaagttgtaggacttgctattgtgcttcgcataaatggcctgtatattgtagaatattagtcgggcaaagtaaaccgaaattagaaatccaagacagacaaagtaatcgtacaatgtcgaaggtaacccgagaaatcccagagaaacgtctcaaagtattgacctaatgcactcatgtcggttatttttcgggaaagcctcatattactccaaagtagaccagaacagctagtatcctttacttctgatccttatattgaaccgtataattgaccgacttcacgatgccattttgttccccactctcattcctaactattgcctgtgcactctctgcatcaccatcttgatccctccctgcgtttgtcagctgagtgtggagcgtagtcaggtagtcccaattgcggatcttcctagctggcttcttgagctgatagctgttttcactggactgctggtttccgctggtatttctgctgccgatgctgctaaaaaggcgcgggaaggtctggaggaagagagggcgcatgactggaaggcaggcacagatgataccgacattgatttcgaccatgctacgccgagatgttagcttcgtcagacgttgagcaagaaagcaagcataccaccaggccgcaagggtaactttgtaccaggtaaagtcactgctatgaataaacggcatcatggtgatgatccgaacacatgaaacaatacaagcactgggaaagtttagtgagtagtggtatgaacgtgtgcacatgaagcttacaatgaaccgagaatgaacagcatcaacagcattgtcttctgcctccatgatacttgcagagaccagcaaagacgaattggcagtattagaatgatcacatcagaaaacacgttaaatgcggcatttgcgtaaacaaaagagaattggtccacgcatttcgctccagccgatttgctcacgtcccacatagcagcgactggttgacagcccagtgtgaagacaaggatacttgtgagactgtatgccgcaacgaaagccatgatagcgtaggtgatttgacggaatcgtttctcgggactgaggcggaggtagaacaggaggatggatgtcttgacaaaccagacaccaagagagtatacgtcttcttctgcgagatcatacttctgaagttagtaagggtagaaatgcgaatgcataaattagttaaatacttaccttcttgaatgctgtcaactgatcaagatataagtcccagatgtgtactccatatccgtttttgacatctgttctcgtcaacctcagccaaggcgaaaccagatttcgtagacatactgattatactgagaatggcaaagatccatgcacagagttggcccataacgcagcacgctggaaggtcagtggaaatgccaattgccgttgtctgatctacttaccatcatcaagatgtagattcttcaaaataaatgcgcgtgtgtaaagccgaacaatcaagaccaatgtcgccgcggcacacaagccaatgctgaccgaatagatttgatattcggagccgggaggattcacgaaatttggggtcactccaggtggaggagagcctgcgggggttctgcctgtgtctgccattgttgtttgattgttagaaaattgacctctggctagtttggaactaactcagtgtttgaagtcattatataccttgaggatggtactttgtttcccaccgaagaatgaattttcttgtgtgcaaccagtactaacatcacccctgcatatagagaaagttacctctaaaaatcatcgccaagctgaacccgtgtgtggcttgatcaatgcgcctataaggctactgactcatataatttaattaattatctcgtcacttcggatatacgtccgtaaagtttgttcgaagagatgaagctatgggctcagatggcttgaaggtaaagtaactgacagctcaattctccgttcaagccttttgatcattggtgaatttgtgaagatcataagcgacatggtggagtagattgcgatgatctcggacgctggccaaacttagtttgcggaactgacggctcgagggttctcaagagaaatgggggcatttcggggatagctatcagtaatcaggggcccgagctgggatgatgatcaatagaccattacatggaggctgatcggtattcccaactgaggaccgaggttaccggtcgacttgttaggccggccagcctagtcacagaaatctaatgtcgccttataaattgatagaacggggtaactctgcactgacctgaacttgattctactgagtgtatgcgttcgacaacaagtgtttaattaccgaacgcaaccgcccggaagacttttcctagcctctgagaggctgaaatggtgtgttactatagcattgtcggtcgtcgccttcctgaatattcagaaaaaaagggacagaagaaagactgagctgtagcaatgcattatagtctgctttcaccacttagtgccggaaacttagggacatatggaggatatctggaatgacagcacgaaaactccgtaactggactgtgctttgggtggacccacacaacatattcgatggaggtcactgttaacctgaacttggtttttcctgattgcaatggcttgggtaaccgcaggggcaaaagtccatgcaggcactgcctccatcccgctgcaagggaatactctaaacgtgcacaacttcttgcaaggggtgcttccatacatacatacgtacgtcacaaactctcgatcgagcaatatcccaagggaatgatgagcttgcatggcgaaccttcttgccttcattgagtgatcatcagagggaagaatatgacctgtcaacgagacgaggggaacagctcaaaagctccatagcccaatcggaaatagcggatcatattcgcctaaagctcatgcacccgtggctcaatattggctactagaagctgatgcaatccaattcgacacgacatcccttggaagaatacaattgattgcccagattcacctttgataagtctggcattgattagtggccgtcgggcaagaatgcttctactacatcacctcacaatagaatgtttcacctgcaagtttcatgtgtaacctaaaacttttagtaaccactatcttgaggaagcgagggattttcacaccggtttagtgggaatatattatagccatgccgaggactgtgtgtctcactcacatgcagtgcgtgagtgggtacggcagtactactcttgcactccgatccattcatgagccatgtactggcacacatggaccctttatatagtcaacctcgcagcctgggcagtcgcaggtgtcccggcaagggtgccctagctgcgcggaattcgagtgacgcgtaaatcagccaagctacgggttgaccactgctcgactaagtctgtgtggaagcctatgctataagaaagctctcagatcctctagatgtgtccgagtatacagttcatctacccttttacctcaccttcagcacccttgacactgcgtatcactcctgtaaaatgggaacgattgcccacaaggatgaagctctccagcagagtctggatcaactcgtatctgctacgaatcaataccagaagagcttctcagatgcagatcgatacaacgtattgatgaatgcaacgcaattgatccagaccttacgtggtccggcagatatgctttatgcgcagttcgaaaatgtaggtcaacctgctctacgatgatatagactctgacaatggattctgctaggctgccaacacaggagccataagaacacttttggacgctggtgtatttgaagcgatccctaccggaggcaagagtatctcagctactgagatatcggagaagacggggatggataaagaattgattggtatgttctagatggcatatctgcttctacttgttgagccttttaataagagaatgaatagttcgacacatgcgcgctgccactccagttggtccctttcgtgaggttggagaggagcaatacgcccatacacccttctcggaaatctatcttgttccgcaaatgcgggcagtctacacctcaatgtgcgaaatgtaccattagcaaaagacgaatttagagctaagatactttgcaggatgcacgatttcgtccccgctatgatacgaaattgcgattttctccgtcaaaagaactggaagaacgaaatcactcttcgcagcaacccctattcattggttcacgactgcgagggcaagaccgcgtttgagcatctatccgcaaatcccagcaacttccgccgcttcaacgaatctatgaaggcagcggattcaaccctagtcacaatgggtctgtatccatttactcaggagctaggtcccctggcgagcgatgatacagtaactctggttgacatcggcggtggtcgaggccacgttattcggcaaatcaaggagactgagcccgaactcaagggccgatttattcttcaagaccaggcgagcgtaataaaagataacggtgacgagattcaaaggcatgggatcgaggccatgggacatgactttttcaaaccacagccgatcaagggtgcgtttctgcgtgtcttttgacgtaaagagagtttaactgaccgatattgattaggtgctttggcttactatattcggcgctgtcttcacaactggcccaacgacgagagtcagaagatcttatctaacttggctggagccatggataaggagaagtctcgcgtgctgattactgagcatattgtgcctgatgtcggaggaacgatgttccatgcctggatggatcagacaatgatgacctttggtggcctcgaacggacgaagaaggattgggctcatctcttggatatttcggggttggagttggtcaaggtgtggcgtgctcctggagtgcctgttggggtagtggaggctagattgaagtgaatattgttatagaacagagtagacacatataagacgctagaatttagaggcaagtttggctattcgagaatgctgattgatcggttgtagactacctgtaagaaatcggggcagaaggtccctactaatattaaccatattagaatgagaacaagagctgacttagctcagcaaagccttacgtcagaccacttatattccgtgattagtttctcctggtagagtccgaagctgcttaggatatgctggcgctgtggaaatgtgttgcttatcatgaacgccttttccttggcttgggggccgttttaccttgcgtctcctacgcacagtaatccttatctggtaagatatttgcgagggtatcagcatcaatacgcccgaagttgattatttagaatcttgatacttgtctatatttatagtatttgtacagtgttttgcctcgtcttccagtaagccgaagtcaataaaaacatccaagacacatctccatactcatagtacggagcaaccgctcgtcaatagccgacagacttcaatctaccctcatgagctagaagtagccgtggcggtggcctcacacgcatatgtggaaacgagagtagacgtgatagcataggtggtagttgcaggggttgggttcacgacttgaaaccaattcgccgccacgggagtacccaagcctgttacttcctcgaactcatcaatgttgaacccaagacgggccgcatctgttgcaggcagcaagctctcgaggcagtcgggcagggagtagtcttctggctggctgtacagcagcaggatgtaatcgtgggcaggtccttccagcggtgtcgggtagacatactccgcgtttggggcgctcttgttgctgatttccaagacaccagacgagtaggctaagtagggctggtaccagtgtagggcggctgttgagacaccatcctcattgatggttgggtcgatcatgatgatgacgtactcgtcatcagtggaggaggtgtcctccaggtacaaggtgggaatgttgatggtccctgtggaagcgttgtgagcacggaatgcaaaggtttcatgtgtgtcagaagcaatttttcttacagttctggttgattaaggcccccgaagtgagagttagatggctcccatctttggtgaaaaccacgccaacatccgcatcgacggacggagtaaaggaggagggagtcgccgcggccgcgaggccgacagcaagagaggaagccaagatctggagaaaacgcatttctgtggtgctaattatttctgtagaggagtgttggttaggattgtggtgcgaatttctcaatcttggctccatccagattgttcttatagttccttgccaaatgcttgtttcactgccttgaaatgaacgggccgattagaatcggtttgtgtaaaggtgcttccgaaattgaggttagtattcacggagaagcatggctgatacatctacatcctgaagtgttgattggcaagacagtgatcagaagcttgtagacgaggaggaccaggatctcgtattcggctgcaccgccccaagtctaccaaggaggaacaggtgtggtaatgctagaaaaggcatcctcttcatagactagaagcaaaaattcccgaaatgtattacgtgagtagcaaatctgagataatccgagcctttgaggcgttgcaggatcggatggtgatgaatctgttgggcgttataggtgttgcatatctgccaggcacaccacgtggacgcattccttccgagttccagtgggtcttgatcgtttggaatgcaatgggcagttcgagagtgatcctgcaagatccttttgggcgtggcaacgctagcgcttactctatgaatgattatggctcctgttatgaactctgatcccctttcctccgggatgaaacaaccaatgagtttctagtcgtcagaaggggcctgattgcctttcaaatatcaggagacactgtaccaaattacatcattgctatccctggaggatgtagagggtcacaaagatagtgcgagtacgtgacctttgatatacttaccacagacaatccctactttatttactttgaagagcacaaaggcaagggtaatgtacccatgacgactaggagatactacacgaagcgatgtgtatcgagcagacgtctagacatactgcacatttcatgcgttgattttcaatcagaatatagcgcaaaccttcgtacactagactcggggaaaccggaatgagaagctgtgcaactatcatcctccgaaccttatgtccctcatatccgttgtcacgcagaggcaaaagcctccattgtaatgtgaggtgactaaaatcctagaggttaagtgagtcatggtcaaaagcctgggcaaaaggagaataattccccacctacactgatgatggctctgccgattgtgtgacacatcagcttatcttcaaataactgagcacatatagtatctctgtgccacgactctgcactcgaggttcttgggtcttcgccttgtataacgttgactggtaataatggcgacaatattgtggtacgtagtacctccatagtgaggcttcttcgtggcgcccgtagacatacgatctatagcattggtggaccaccaatcgtagtttgcaatattggcaatatgttggctaacggtggtgggattataagagggcacagtctcattctcgtggaaggcacggttacctatagtttcacagcgtcgttcatgtctaaggcgggccataatctagatcgcctatgaaaaaccgagctttcactctgtgagagtataacaagaataccctttgtttgtttgctataatgcagctagctggtgatacatactgaaataactctaaacaccgctaagcaaatccaatcaacgccgagcgctcagcgcattcagcaggacgtgtcatgaccactgatagcgaaggcggccttcacagtaccatgatgcaagggagcagcagagcgcaatacagcacatgagactgccccttaggatccctatcctagcgtaaatctctcatgcagcgttctgtgaatgccgtcccattctctggtatcatcagaggcgggccttatgcccgacataacggcaccttctacaggtatattataactaactcttgtactcatgttccagttcttttcgactgatgagacagcccctcacgcctttccgccggacttcaggatctgctccagattctcccggctgttcttatgtgtcatttccaggtagtgtagcttcttttccaagccagtaatatccgccttcagatctccgctctcgctggacaggcgcttgtcgatcgtgttcatggggacagccacaaacctaagaaaatgatatcagttattatggccgcgagattcttccgtcttcaaagcatccttagaagggtggaatagcagcccgccagtagactcacattttgccaacaccctcatatacccttgtgtccttaggaagggagctgatttcctttgatgtcagctccagcatgcggatgtctctctgcttagttgtgatctgcgccttggtgatgccgatctgttgttgggaggtgatggcttggacttcaatttcttgcagaagctgtttgtccgcaatacattagttatgaggatctgacaaatttgctgggacaatgtaccttctgcagagcttcgttggggatggacattttgggtaaggagaggggagtcccgctttggtattgaggggtaatctggggtcgaaagaagtcgcgtcgtcgggtcaggaaaagcgcgtattcaggttgacccggcagtgatttctgtggtatttgtcgagatgatacgtggattgggtataagagtaacaggaaaggctgtttgttggttatctatcgttctgatcaagctcgacgatgaacacatcggccgtccgctgttattggctccgaggcccgggcggtagatgataccgaatttggacatcagtctagggcttagggcttcaagcagaacaactactggtgtacaattctcgtgaaagaacaaacatgtatggtcttccgataataaatgttattgaaaatcaattaatacatcattgaggctcgcattttgttgtactcagcctgggtggttggcttatatttggccgggtatgcctcactcatgcatgacggaatacactcaatgatcatgtctggatcaggggacatgaaatacggaattgagtaacgctcccgtgtcatccggttaggcccctcaaatcgatctgggagttgtggcagtctgacgcggtggttggttgacctaaggcgatctgtattatcgattaggaataaggccgttttcacactactactaatgattcgcggggaatggcaaagacaaaccattgctccacatttgcaataagtccccaatgttcatgatgatagcatgtttcaatggagcagctgggacgaatgtgccgggccgagaaatatcctctacttcaaggccaccacagtcatcctggaagagcatggttatggaactccaatctgtatgtgccggacatcgggcggttcgctctgtctccaactcctctgccggcacaggtagatagtgcagcaaccggagctggttgttgtggcccgaatgcttcttcgtcaggtaacagccatcttccaagtcaaggccggcagctaaagcatgtagtatctcgcttccaaccttattgcacttccagtaaaactgaaccataaaattccggtaaccaggaagagtctcttccggtaaccactggttgggctgaacggaattctcttcgctgccaatatcgtagatttcctgtgctcaaacgtcattccgaatctcaatataagactcgatggggacaattatgaagaatttctgtgtctaatagctcactggggcgacatgaaatcgaacaaaccttgacatcgggtacctctctcagcttcttccgcgcgtcctcgtcatcccctgtgctcatgacttgagaaaccttttcaagaccgggccatgagtagcctcgatgtacagcccagccctccggatgcggggcccgcatcttgtcttcgcttgagagctcaaaaaagcgtctcatccagtcaaacgcttcatccaaaaccgagccaggaagcgagtggttcactatatatacgaacccaacatcttggcaagccttaaccagtgcatgtgcgacctgttgacgagaggaggcatccgggctgttgtaccactgcgaaaagtccacgacggggatctgcatctgagtagaactcgtagagaaagacataccgaatatatcagatacctagaagtgtctcgaagttcgaagaataattttagctacttaggaaggattctgaaactgtcatgcgataaataaatttgcgatgacactttcaaggagctgttgcaagatggatggctagtgcattagctggtctggcgcttagttcccaaattgcctggccgatcatatgctttgcgatcgtggaagtaaaagattccacgtgaacgtcactttcaagaaaaggaatgagctggtatagccagcaggtttggtatgtctgagtgtttcatgatgatctagaaagacctgaggtaagcttacgattcacgtggtgtagttgatatgttactccatgtgtgaagtgacatcatctggtgacgaagtactagtagcagaccctgagatcggagctggagcagtatttatccactcggtgataaagcctatggagaccggcggagtgccgggtgattgcctggctacggtgcaaaatttcaatcaatgcgagccaaaaataggtggacaagtcccatcctcgcacgggtggctggttattgaggggccacgggcgacgctccgttgctgtggcaggggatcgcagtggacccggcgctgcctgaacaacctaaagatgcagcatccatcacccacactttccggtgtccaaaccggcttgctcgagtgaggcgaacccggcagaaattagtacaagaagaagttttccaggaacacgtaagtgtgcttttatccgcccagggtcatgtccgttgagctactgtgtacttgcaagcgctatcgaccactactgacatctacttctaccgcttttagtaatctgttgatcgccgccgcaaagccgtcgcataaaactggtcctcaacagatcgtacgattagactggtcacagtctcccgctgcggtagtgacatattccgacgtatatcttcgatattctgtcctgtcatatctgaagggcgcgctatagccctagccttgacaatgaagctcttcgggtggatctcggcagcattcctcgcttcgactgtcctttcgatagaaacgacaccagctccatcaattgacactataccattctatccaccccgcaatgcagactcgggacggagggcctttgaagtactacaactattaaggaaacggggcgataactgtccttctggatatgattcttgcacaaacctaggctattcggatatatgctgtgccgacggtagcaggtgcacccgcgacgccgctgacaacgtcgcctgttgcccgactggagcaagctgtacgggcacgctctcagaaaccggaaacgcggggggaggagcaaccagcagcttccgattcccccagacagcgacggctacacagactacagatgggacgagcgtgactctcacgggctctacaattgccggggcatatccctttgtcaatattccgacatcatttgccaacgcgcgtgtttgcacatcatattactctctatgtcagagcgagtatactggttgcctttcgcaactcggaggaggctatgctgtgactgtggctgcagaagggggaggtgtcactcgcgctgatggaggagcttctgcagctatatcaacatgctctagtctgagtatggaggcatgtcacggcctcagcattggttactgcggcagttacagtactgatgtctacgagaaccggggaacgatgcccagtcggagttccagtcttgaggaccttttctttggcatgatcattggacttgccgggatgttcctatgaagctacgaccaagcttgattttcatgtggatatgcatgtatgagatatggacatacgctcgctcaaatgacgtgaacaattttttcgaagttaacaatgaccactgcgacactcaagcgacaactacctcggttgagaatgcccatcctttgggtagctgaaacaaatgacggaatgtatctatgaagtgattgatgatgggcgatagtcaggcagctatcagtataatgagtctcatgattttgtggcgttctgtatataacaagagcatctagattagcaataacaatgaaggaaattgaatgatcggattatgatggcttccctatttggaagtgtgtacactgagcttgttgctccgaaatacacaagagagatgcaggttgacgaccagggtgctacatccatggcgcctcaccaccacatcatttttagggttcaccatgtagcggagtatttatgatgtgaatgtcgggccacggacaatgcgcacttccagtcacccgtgccaaatcactgcctaagcatggggcccctccgttgggtgacacgtcggtgtagtcaccacacagtattcgcctgatttgtgccgacggatggaggcccatgcagtcagtacctgacggacgcaactctgtcgaatcagagaatgggtttgctagaccgactcgccatggaacaaaagataatctggcggtggagccgacagcacagtaggccgggtctgtccaagttccggacttttcgcccacggacactattgggtgcagacaatgacgctgtcaggaactgaggggagaattggtgatgagaggggcagcaacggcatcatcggccacttctctgccattggatcacagcggggcagcaacatgcagagtcaggaaaagtgggcatcccagcctccgaaatttccttttttaaattatgatctaagtttatcttcatcactgattcactcggcctcgcagtgattggtggtggccgtcgcaggaaatgcggtggttgggaagtcgaccggacggaggctgggatcaagaagagcggacgggctgctcgtgggatggcaccctgctccgacttctctcctccaaccttccatacattctctcctcaactgatatgcattctttcgatctctgctctgcaagctacctgtgacggtctcttgcattccatctatttgcttggcttcctttcgttcgctgtctctccttctataactccttgtcataccaagacctagtatatcggatcatccatcggaaaccaaaatttgtccctagcagcgatcgcaattcaagactgcttttggtcgcatcgtgggctggcctcgtggtcgtggaaattcctacattcttccctcgccatgcatgcgtctcgcataatcccgtcgactttatctatactggccctactaagtcagtttcaactctcgatagcctcgccattggaacctgaggagagcctcgaggaggccaccttagaaaagcgctgctcaaatccttgcggttactatagtcagctttgctgcagctcaagcgaaacatgcagcaccaatagtgatggcgaagctgagtgcgtcgcttccggaagctgggagtactacaccaccacgtatgtcgtgaccgaaacagagcgtgcgacttttacttcaacatggagctcctacgtttcggcaacaacgagcactggaagctgcaatgccgagtatggcgaaacggtctgcggcagcgattgttgcggtcctgcatatgtctgctccgacaatcaatgtgtcctgggaagcacgtcaatctgggcaactgctactgccacacctcccgtgcgcggaacaacgctatcgactgtaacccaaacggctacgactactgaacctttcactgcccctgttagcacaagcggcacgccattggttgtgaagggctctggcgggggactcagcggcggtgccatcgcgggaattgttatcggaacaattgctggcgtgttcctcctgttgcttctctgcgcttgtatgtgctgccgtggagcactcgattccgttcttgcttgtcttggtctcggtggtggcaggaagcggagggaaacaacttacgtcgaagaacgtcgtcgtcaccaccatagttcttccggagccagacctgagcagcgcacctggttcggcagtcgaccggctccctcaacagcaggtggcggtaaaaagaaggagtctggaatgggtgcgttggcgacaattgggatcgtcctgggtgcgattgcgctgtgtctagggttgaagaggcgcagagaccatcgcgacgcagacgagaagaccgattacacgtacccgagcacctactacagttactactcctctgactactacaccaatgatggtaagtgatctcttgttgctcttttgatcaaacaaaatcgatgatgctaatagttttgcaggaagcgttgtgacagatgatcggcggacgagagacaccagaagaactagacgatcgcgcacgcgctcacgaagatgatgattttatgatttcaattaacgaaaaagaacgacttaccgaaagacaacgaattactgaatgttgattccgttgtcagactttatttgaacgattttgcatgaactggcgttatccatggtttatgattgacgtgtgatggtttcttctttcgtgttcgaaagatctgcaatgtacgatgatgagacatgtatccatgttttaatgcccttgactgtatctgctcttatcccttttctttgtctcttcgcctttgttctccgtccctgcttctgtctctttcccatctcttaattgaaagacgcggaaggatattgtgctgtagataagattctcaatatagattgacaaagaacagtattgtacatattaataaacattattgcctacctacatcgtacatcaagtatcagaaagttagaagtaaagagcatctcggcccagaaacggtgagggctgaaaacaggagttctacatatccagagctgcaaatgccccctcaatcacgttccttgaaggccgacgcggggatagctacaggtgtatgaaggattagagcaaaagtcgcaactttcgagagatccagtgtcagcgcaccccttaatcaagagctgattcttgataatcatgcacctgccggagcaactcgtgcgttcttccaataactgcagctgcaaggcggccatcaacggccagcatgccaacccaagacagaggtggaaggagttgtcatcatacttagattcggctccaccgatctggtaataagggcaaactgaagggatagaaaatgtgaatcgattcgtgttaccgatccacgcgatcaagttgttccgatcgaagcggttcgagtccgacagggtccagagagtgaagctcggcaccttgtcgacggcacaaactgcccgggcggaacctgcgactccccgcctcccgtagtcccaagccatccatccatcatttcacgctcgcctgtccttcaatcccgctgtcattcccacgccctcgtcacaacccccccacaactctcaactcttgtattcgaaaacccttatccatgaggctactatcgagtatacgatcctgacaatacctactcagcatcatagttcattttgccctcgtccggcttttccccgattatccagggctgtcaagtcttccctcctgaggattacgagtcccgttgagctccgattcttcgctggcccgccatgcttcaaacgcagactcagcacgtcttttcccaccagcaccagtatccgcaggctgatccgtcctggctgcagcaacagcagcagcagcatcatcaaacccacccgcaccaggctcagcaaccgcattcttcgttggtcgcccaacagcatgcccaagtccaggcggctgcagccgccgctgcagctgctcaacaacaacactatactcgcatagccatggctgggaacgccggtgccggtaattccgctcaaggggctggtgcagggggcattggtggggatggtgctttgcccggtgcggtgtccgtgatggatggtggcatcagtgatgagaatcggaaagttttcatctgggtcgcagaactcctcgatccgagtcgcagagaagcagctctcatggagcttagcaagaagagagagcaagtgccggaacttgcgttggttatctggcactctttcggtacggaaacccccctttgatcggctttgttggtggcgactaacgggcgttttttcaggcgtcatgaccgctttactccaggaaatcatctctgtatacccgttgttgaacccttcgcaactgactgcggctgcatcaaatcgagtttgcaatgcgcttgctctcttgcagtgtgtggcttcccacaacgagactcgcaccttatttctaaatggtacgcagccgtcacccaggagccatccaccccacccttcgtttccaagtagtatatgctttgactaacaaaatctctttcgcaacagctcacattcctctgtttctctatcctttcctcaacacaacgtcaaagtcgcggcccttcgagtatctccgcctcacctcgctcggcgtaatcggagcgttggtcaagaatgactcatccgatgtcatcaacttcctccttaccacagagatcatccctctttgcctacgaattatggagaccggctcagaacttagcaagaccgttgcaattttcatcgtgcagaagattctcctcgacgacatcggcctcgcgtatatttgcgcaacgtatgagaggttctatgcagttggaaccgttctgagtaatatggttactcaacttgttgagcaacagacagtacggcttctcaagcatgtagtgcgctgcttccttcggtgagtcctgcaattttccttgtatcgcctaagtcggtttggttctccttcaaatgctgacttctgtagcttgagtgataacagcagggcgcgagaggcgttgcgtcaatgccttcccgaacctttgcgcgatgcgacattctcctccgtactccgcgacgacgccgccactaagcgctgcttggcacagcttctcatcaacctttcggataacgtctccgatggcgcacctggtgttgcgatgtaaaaagttcaaaagcatttgttttccttctggtttacttgatatatttgacaaccttacgacatgcatggggcgggctttaggcgaaacacggaatacaaggcgcaaactgtgtggaatggcaatgcaatgacgcgatctcagggaagttgcacaaaatcaacagagagaaaaagagaagacatggcgggtatgggagcactgggcttgggggtttctgtcttgttatggtttgaaaggttctgttgttttgctgattatctattctttcttccctatccctggcttttactgtggctttctttctgctttctatttacccctatttttcattcgtccaacacttcgttccccttcggccatagtggtatggctgtgcggtggcgtgggatacggctggcgctatttttctgtgtgcattttgcttgtcctctatgttccccattccccatcctccatctgagtgagatagaccctctttgagcgagataccaagatctagttttatgtttcgttggatggtgctgattctgcttgttgcttaagtttcatttgctggtgacctgattacatgcagaggcaaattatcattatcataagacattctctccttgacttcataatatgagcctgtatcatcatctaaaatagtctccacgaggccttggtaaaatgtgagaaatcggatcgcatcgaaagcgcaaggcttatcggcacgggatcgacccaatcggcggatggaagtcacctgactggggtctcgacgcgccgcccggcgattctgtgagctcatctcttctgcccagcccgacacgcccgccctggcgaacgatttcctgtcttcacgccgctgtcgatcacgtcgatacccactcattctgccatttggtagaggcacctgtgctcgttcttctgttgcatatacgctgcgatactcatccttcacagaactcccgcccccgccgcagatccgccgcagtggtcgaatcttgtcctgcgccgcggcgcctttaatggtctatatccgccttcatggtatcgcgaaagcgcacccgctccgaggtggacactgccccagagcagccacctgaggagccgggtttactccagaagcttcgaaactgctgggagtttgcaagcctaatgcaatacattgccatatttgggaaagttatgaagattgacgaggattttgggattgaggttcgcagtgcaaacccaacacctccagttttcttttacgtttgggcgcgttcaatcaatgctaataatttactccgatattctgcttataggatctggaaactgagtgcctaaagcctaccccttccgagaaattactggagattggtctctgtctcttgaaatgggtgtcgtcgcatcggggcctcacgtacgtgcaccgttattctggccataactgtagctatgctaataggatgctcttgctgatagttttgataacttcgatgagtacacgcgacgtcagtacaatgcgaaagcaccacacattcctaaccctttcggatacgaggaggttccgaagagattcttggactttgatgttttcttgaaattgcgcgtcttgcaccagctgtctatttggaccttctggaatcccgatcgcatccgcgagaagatgccggagcaaagggaatcggatcagacggagtgggtgggttttacgtgacacacccctggattcctattatccttactgaccttctgctagcgtatcgaagaagtaggctacgatcgtgaaggccgttactactatattctcgatgataacaggctctatcgccgcaccgacccccctattccgcctccgaaaccggcgaagtcgaagtcgaggagaaagagcgcccgtgccatgagagcctccaaacgaagacgagtaacaggcgccgatcccattgaagagtctgatgaggaagataatgttgtgaacggcgacgcctcagaggatcctctgcaagcgatgacgtgggaatgcattgccattacactagacgattacaagcagttcctcgagtccataaggaagacaagggaccccgatgaaaagatcctgagggataggatcgatgaacaagtcatgcccattattgagaaggaagaggaggcacaagagagacagaaacagaagcgcgagaaggagcttttcaacatgcagctgctcgctggggctaaacgatccagtcggattgccggaaaggctgagaaagagcgacaggagcgtgaggccgctgaagcagcacgtaaacgagaaaccgaactagccgcagcccgcaaagaggaagaaagagtgaagaagctggaggcggaaagacgttcgcgcatcatgacccgggaacagcgtactaaagatcgcgagaggaagcggatactacacgaaagcgagcttcagcgcatcaaagaagagcaggagaaggttgcacggggtgagagcagagcctctgagagacatcttcaagcggaaatggagaagtaccgcaagaatttggaagacctttcgcaggaggatcaatggatcttcgactgctcaggctgcggtgttcatggtcagaatttggtagggcatgatcgtatctttagatccctatggcaagtgtactaattttcagtaggatgatggctctcacagtgttgcatgcgaatcctgcaacgtatggcagcacagcaagtgtctcggtatccccaagagtgaagccgaacgagaggatttccacttcgtttgcaatgactgtaaacggcgcgaagaggaagcgaagttgcccaaacttccaccgttgaaattccgcgtcggctcgtcgacctcgccgtcctcagctgcgccagacggagataccaagattaaagtcccagatccggaacaaagtcccatatcgtccatcaaaaccgctcagcataccttccagttgcctcttactgggtcccctcaaaagcaacctccttccatgccttccgttcccttacaaaacccccctcaagccgtctccttccctcctctgtcccccgagcgcaggcctcagtccgcccacaccacatcattcagccctcctcgagctcctttctctccatcaaagggcttgaatggacatactccgtcatccaaggatcagattccgaaactgccatccatccatcaagcaatgcatttaccgccccattctcgtgagtccttcagcggcgggtcgtttccggcgcggcgaccgtcgtcctctcactctacgcagagtcccactctgccttcacccattcaaaaccggccatctatgtccccaactcaaggaaaccgagatgttggtcctcttgcggggtttccacctgtagcttcgacagatcactcagccccatggacgccgtacgctcaacatcaaaccccccgtccaaatacgggcaatcattcttccttctcttccctgcataacgggcgtccatctttcatggccacaccaactgcaactcgctcctctcctccacaaagttcccacggtgtgcctctttcgggaatcagtccgaccaagcagtcaccccgacctatgacatctggcagcgtcactggagctccagtccttcctccgattcagaagctcgagccgagtcctaaactaatgggccgaagctcacctgatgcacccattccgccgccggtcaaatgcatgacaccggagcaagaggagcgcaggcaaagggaaaacgccatgctgcaggcccaattgcacgggaccaatggcccgcattcagtgatgtcgtcgccatcactcaatcgtatcccacctttagggccttctgcggttgctcaacagcctgcgccatctcctcagtcaggctcaaagtgaagtcgcttggtactttctgcttatgcatgctggcacaagagcagctgcacaacaaatagtatacccctctcgttgttcgaatttgaacacatacattcactcgtcattttgtccttggctcgattattggtcacctcaaacaccgaatctatcaattgtggttcggcaggttgatcttgcagcgcagtaaagcttaagcggccaaattctttggaggcgccaagccatgcgcgcaggtcttgtgtaccttcctttcaccttctgtctcgcagcgtttgagtccgggaaaaccagctggtggtcctgggttttccgctgctgttttcttcgtaaactctgttcttccatacattgctcttcgaagtgcgcacgatgtggagtgtgtgctggtctagcaatccacaatgggatttttgctttttccttttatgctacctatttcgcttggttggtatggttggtctacgcttctctcgtgtcttaacttctattttgatatactggaatggtggcgttgcaggatactgagctaatagagggatggggttgacaatggatgtgaagtagacattgactagatgtaataaaagcgaggcaattacaatctgatggttttaattatggaccgagatcgatcctgtagatgatcaccgacatttctgttgtcgctgccccttgtgaaccgtacatatcccggcttcgtcgtgcaattgctactacgacttaaacacccactcctacaactaaatccaccagaacacccaacccccaaagacagaaacatatatgaacataagcattacgccgcaaccgcaacggcaaacaagtccccaaaccaagcaagcgccatgcatgcatcccacagcctcatcgccctgcgccaatacgcctaagcaatctagtactcacgctactcctccattgacccgaagtggatcatcacctctaatttaactaaccaggccccaatatatgtaatgtcagcaagatgtctcagatcccgttctgtccccttccaccccgtgcgtacgtgcgtgcatgcatacacagaacaaactacatgtcactttcggatctgtcacctgtcaaactcgattatctatttatctgatgcgatcatacccctataacctatagattgtgtggtgatgccgactgacttgaaacaggattaatgtatatggtagtatcgtggcgtagtatggttgcactgcatgtgagattgagtggtgtgtgggtacttagtagtgggtaaatctgaagcagggtcgcattggggaagggggaaaagggccgcgtggtttaatttcgctttgatttcgtttaactatttatatcatgtatgctagtatactagtagtaggctgtgaggctatgaggctatcagcaaacggtttggtatattgtgtctctcgggatggggttgctgcggcagatggatgaaatggataaatgaggtttttaagtcggttaaaattgatgggttaacatccgatgtcactaagtacttagtccgtgtaagtatatataagtagtggagtaggtggtgggagtggactggctggctggctggctgatcgggtatgaacgggggtttttctgggtgatagtcctgattgcccatatttaggatggagggagtatataagtgtgtagtatctactacaaagttgttgtatctcaaacatgtggctttcaagctggtcaaacacactactcaaacatactacagcagcagagtaaaaagtaagacactatcccactcatacaacgatattgttggggagggattttccacacaatggtgactttgtcggctcagttccctgtcttgccctagctagttactatttagtagttcagaactaatgacttagttctcacttgctaaccaggatcccagttcactaaaaccacatgagctaggatcatttagggagttcattcccaacatcccctactcatgcagtagttcacctcacagtaaatacctccctaatcctcctaatctatcgttctcctgaaaacgttcgctagactagttagttagtcagttagtttgaaaatcacaaccgaaaagaaatgaaaagttctcgacacggcggaatgaaccgatcatactagactagtctccctttaggggaaagtcgcggcttgaaatggatcgtttggatatattgattgattgatcgattgatagcttggttgaagtggactgaactggactgtcctggagacacatactaaatcaacaaactacacgcacttgtagttggatgacttggctccactactacccggagattgtgagaacagtaagcatttgtagcttccttggtatctccgtcctccgatcggatccggatccgtgtccggacggtagtggggagggggacgagcttgcccgcacggtctagacggtggccttgtccgtgtccttttctccgtgtgtatgtgtgtgagttatatgatgggcgagggtaccatgggttgggatggtatgttttgtctggtctgagagccgcatgcttccagaggtatatccttatcttgggttttttggtatgtagccgatcccaaggtatgtagcggacaggcaccgaggcataatgagatacatttttctcaggaaaagcaaaaagaagtatgcaaatacgcggagtactgtgagacttggcttgaccagtcgaatttcgcccgagcccggaatatctccgcaaacgctcaggcgcaaacatttatagacgcatctcagagaaacaagcactgcgtagggataaataatctctacctacgatggcaaggcaacatagcagatcagaagaccgattgaccgatggccatgataatttgccggtcaatcttggcgatacatacacgaacacggattgatcacccacgtacttgtgccccgaatgcctcaaaaatggaactaaacacacataaatccgcatagctatacacctacatatgggaacacaaagtgtgtgatcatcgatggagaatcagctagtcatactgagaatgctacctgcatggaaggattccggcaccttctggcccaaatactggaaccctatttttgccgtccactcaaggcccattatcggatgtgcgcgaaaccataattaggtttcctgggctgcgcaggtgcgccctgctactccactgaaaccgttccggctgatcttctggttcggagatagcaactatactcggttcagcctggaaagacgtgccggtgccctgttgcgtccatacagaacacacacatgaccggtaaaggttagacagatgtcactgctgttggcaactttggaaaaggcaacaaaagtgacgggagtttgttacaaagcgggaaatgctgtaagcggcaggccatttgtgaggtacctcgcttgtacttttgtcggtgaccgtccgcttagaataggtggaatgggtacctcctggctactcgggctgggttggcatggcattcatactagtagtgggattcgctgtaaggagtaccaaaagaggcagaagaggggagtcaagggcgatgttaggttcgggcgcccatgttgcaaacacacgttgtctgcgagatgtcagatgtgtaggttgacctcgggcatgttcagctcgttattcccccataccttatctcctcgattggttccagtggctttccttctgttggttcctgttccggtcattggaagcgaaatgtgtcatgtctcaccgactgcatgacacgacgatcccgtggtgtgggaacttccagttggagatttgtaaggctgaactgtctgtccgcttatctacatactcactgctactaactagttcacctgtcaaatttttagatcgtcgacatggtgaccatgacaaattcggtgcggctgcctgacaaggctggctttacgcatctcgcgtgggaggctcattggatggtgtgtgaatgatttcccgacaatgcctcagatcagatcgtctgaacaggctaatatgaacggctgccaggcgttggagatgttggcgctgtgtttctgattggtatcagaaaataatactagtactagtggtactatcttaggcagttgcttatgtgcattgctggcatagaccccattggatccctagatctctcttgcgccttgacactgagccgtaatgggtggttacgagaggcatgactatgcctatcggattgcccggcgggaggaagtgggttgacctgagaactctgtaagagtctctcatgttggacttacgcttaatgtcgatactaggtaaggaagagtaatgatttcccgttcttctaatgaacttaatgagacttattcgtccaaagcgtagagggaggccatagcttacgtagtaatgtcccctgagtgtgggtaaatgtgattttctgtatgcagtaagtactaagtacttgctccacaagcctagggtgacttagtcttacgtaccagctactttggagttaccctcggttggctggcgggagaggcctgcggtggcgtgacgccggccattcaccttacaaaagggaacaggccaatgactttgcgatttggtgtgataaaatgacaggcggaacattgctcgtgcttgcccatcgagcaattacagtactcgatgagaatttaagtcgatgattttcttcccgtcaaccaatggcgggcatgtgggagggcagatcaggctgcctcccaggggcactgcggcgggtggttccccgctgggggctgcgcggaggctaagctaccgtagttagcggggatgtcaatgggtccgtggacgacgtcaagaagttagtggttagttactggttactttacttgctttacttgcttcgtaccactgaaagcggcaccgataccacgctagtccggatgagctcggtctagactgggcgccgcagcagtgaccctcttctccaaatccaacctccaatctatgcaatggccagtgttgttgcggttttcttggggtcatccatccgactttgctcttggcagtctactgttagtgtcacctagaaacccctcgtcaggttttgcagatcgtcgacatttcgacatttttaatgaagatgtgccaaattccttgcctactctggcttacggaggttggcatttgcttgtgcgtattgtctcctccagtcgaatcccaaccttaattcctttgccggaatacttgcagtttccattgtatcatgtcaaggttagcgttatagccgcggcgcaagtcagcactgtatcatttcctgcttcttagttcgctcttcagacatcctatgcgatattatacctttgctcgcatgcacagctcctagctctccgtcgcacgacctatccccgtaaatctcccaccatccactctggggacacagtttgtgaggaaagtgttggactgtgcgggactgagctttcgtccccagaagtgagggggcaaagcaggtgaggtgggtatcggggcgtccttttcctctgtggactctataatagtcaggtctaaggaaaccctttcccagctgtgtaacgaaccgggcagtggtcagttagtgacgttgacgcaacacccgcttgtccggctgcaggcttagcaatcactaccaagagaaacgctaatggctcaggcactaggctagctgaatcctgctcacttcgcgcacccaatacccatactgtcgggtccttactatgtcaattatagggggccacaaattgcaaatgccacatcgcgcagggaaacctacacgagtaaccaatgaatggacaagctcctccgtaggtaatggcaggtcggtccgtcagtgcgacctaagacgggcggcctgttgcgactctagcacccttcctccccataggaatgtcttgcaaccaaaatcatggcctgtccgaagtaagcgccaaatacgtaggttgtgtgcatggtgattcaacggttgctgtcgtgattgaccgacaatccccatgtcttgggccacgttttccttgtaaccacttcctgcctgctaggcctgctatctagcggtaaaggcgtgtctggtaaaatcggtgagtagatagctcgccagctctggcttgatcacgaggcagtttggctgggctggtgtttaccggctacggcgcgcaccacttcacgcctatccaattgcaccggagacaccgttccagcgtatgtgcatacctgcgcccctctggttccactccgtgtcatatcaatcccgtgactggaagaaagttcgacggctgctgcccagcgctaatccctgcagaaggcgtggcgctactgggctgtttctgagcatctcggagatattcgtcaatccctctgtggaaacgatgtgtccaggatagcccccatgagaacctaagggaacctccctgtcattcttcatatatccgaggccttggctcaattccctccctttcccctgcagatgccactgtaatatgaggcaacatcgaaacccacaagagataaagcatattgggcactgtggtgactatctgaaacatataattttaaggatgagtgttcttctcgactactacctgcgtttagtctgaatgggctcgagtccaactggactgactcgaagaggcgacccatcaatgtagccagattcaataaagacagcggtgctcttggcgtatcagggacttcaccagtcagcagaccgttcatattcttcgactgcgttaggtatacttcaccgagtggcttggagaaggatggataccggacttggaaaggtgcactgcttggcggggatttactaaccttccagaaggccatcgaacgcttgtagatgatgtggatggttgcaaaggtccatggcgagcccgatcggatccctgtgtcaatccccttctgcaactggaagcaggaagttaccaaagtgacaccaaccatacaaattgggtaaatcctccgggatctcaatgataacgtctggggacagcctccgggcgcaagccacctcagctgttaacccttcctccagattcggtgccaagcagttacatatggtttccccatgttactcgatccatacttgcgctcaaggaagcgggagggggctgtcagaaggcctacacgaagtggccgtacatgcgacccatgggaccaatgatgaattccatacgatcatccgcctctagaaggaagtcgccgctcaggcctctccctagaacaaggaacgaaggaaatggtttccactaaggttttcttcttcagcaatgttcctgcgcccgagaatagtcagggaaaaccgaggaagtccggacaaagaatgtttacaccgggcaactttggttcctgcgcaaagccatcggtgtgtgctttcgcgggtccatcagaaccttgaattccattttggcagccgcagatcatactagctgtctaggagaggtcttcagatcatcccttcagctggaacgggggggattcacggcaactgaggctgggaagggggaggatcgattgaggaaggagaatcaatgagaagtggatcagccatcagtgggagcgggcgatctgtgggcttctttgcaatctcatccagtccaaccgactcacagaatgaggagttttgtgtggctactgttgttttgatacttgtagctgccgcacacaacaccagctctgctgtacgtcttgtgccaatcagcggctatcaacagtccgtatacaatgttggtatgctacaactactcaaattgcagctgaaacgccgtttccagagtggcataatgcagaacataatgggactacataatgcaaaggcagtatgcatgggaggatagaatgccatgacaatcctcagacatgacaatccccgaagtcttccaatccccgggcatcaacgatggctgggctagtaccacacgtgaccgtcgaggacccaagcatcagggtggcccagtttcaaacaagggggtgacagaacgccggaaataaacatgcgccgcaatcccatttgagccagccaagctaagccgcaatccatcatacatcagcgtactgcatgcagaccccctgtcagaattggcattaacaagctaacggcatgcagggaaactacgcgatacttacgtagctttggtacggcctgctcactaggacgtgggcatcgataactaacctatagttagttactcatttgggttacttgattgagcagcaatccacatacgatctgtgtctatggtcttccgttcgcataaaaaatagcgcaggtacggagtacagttctgcctgattcaagcatcacattccccaccgcgaccccactggagccatttctccttccgcggcgagccccgtgtcaacctaggtaaaacgacacactactacgccggactagctggaagttcgcccgcaaatctagataaatcgcagtattaggcaggacccccaccagcggccttaccggcacgatcccgccagctttaaactacccaagtgggctagtcatttcaatacatgacgctagcgttggtcagcgatctgctggagccagtcgtagcttgccggctacttcagcccgaccaatggataagccaatagtaatcgtgtggcgtatttttgggtccatggtctcagatactacgagatgctcgcggcatgcgctttctactctgtaagttagtctaaattggaggggaggaagaggggggatttaccatctctgatcggaatgtcgggcaaccgaatccccgcgcaaacctattttctagagggatgtgattgcgatcgctgagtagaaaacaggactaggatgccataacaagtctcgctattcatttttttcacggctatgcacactctccaagccaagaagatgtcacaaaatgtatacggagtgccctgcgccctttctggttgggttggttttggcccaagtacaaacatggatctgctcgcatccgaaccaacatccaaatcaactatccactggttcgacaacatgacggatgtctctcacgagtcacgcagcatcttatagtgggctacctcagacgtaccaagagggcctgtagcccaacgttcgcctaatgcgcgcttgcctctgatctccgcctctcaacaacgttgtctggctgttttcgctaaaggataagcaagaaaagacacgaacgatctactggcttgattgtggggtatgggccaagcaatagtatgctcatgatttgcgctagctacctaccattttcagatacatacatacgtgcgcttcaaaacttcacctggatgacccaggggcgagtcgcaagctctgctcggcgatgtgcggatgcggagaaagcagagtctagatacacgtatgtggacgtcccaggaggtagaggataccgatccatggaacgtgttcctcttcttcggagccgaagtatgtagacggggtagtgacgctgatgatgataatactggtgaatgtcgatttctcgggaaacaggtcggttgcttactggctgggactgactcgttcgggttcaaccaagcctagtctccaattcctcttgcctgtcttcatggctgaagaccgaccaatctcaatatactgagacctggttggtcgatatgaatgtctgcaagaatatctccatttcatagtagtagttcgagactgctcggatgaggagacccgatatccggggagttaaaacatggagttaagctcggatacaaggagtatccgacggtctcaatgtgctctcatgcgagccggtaatctcaataatcacttggtagtatcttttttgcctcctttttccctattcggaaattttacgtagcttccagcattagccttgtgctttcccgatctactcttgctatcttaatccttctttgctatccctgtcccgtgtaattgccccttctatgtccgtaaaagaataggacgaacctatctgcttcctacaatttatgaggaggctttcactgttgtgaacttctactcgatatgaacacatacatagtgcaggctatcacgttcagagcatggggctaattccgaccagtgtcactgcctgctttagttccgggccccggatagatagtagatcgcactaataacttgatgggcaaagagtgggacgaatgcctgaacgttagactgtcagtcacccctcgttgttatgattattaattttttaaattaaatttcccttattttatttttccctctttcccaattattatttattctagtttttttaattatttaattttgctgttagatttggttccccactctctgaaattcagaattcaataataattttcttattatgaggtatggtttgctccacgatccagattcactagggaccaatgccctctacgtaatgtgaataccgatcatacccatgctgttctccattcaatttccgcaatcccttccagcgactgaggggatggctcagcaatgccgcgcctcaatattcaatgccatgataagagtcgtaaaaccaatccgtgcctgggtagatgcatgtccgcatttagtaacctccctgagtcaggctctgaacagcctcaaacccgctggttctccccccatccccccccctctccccctcctgtttcttctggaagagtagaggaaacctagatttggcacaaagagaaatctagaagcagacgccgcagaagaatgaacaggggaaatgaagaaagagtgggaggatccgaaaataaacgtatgggtgccccaggagcaaaagtgtagcagacaagcgaagagatgctaaaataaaatggaaaacaaatcacatcaatcggcggatgggatgccaaagggaatgcatccatgtctgggctccggtcccaaggcagcggaacaaagacaacgccatccagcaaccccgtgccaacttcgagggaatcaccaccgccggccagcagaggcggccgtcaagggtttcagccgctgggaattccatggtagtcatccccatctagaacttcgtgctgcagtatccatcccgccttaaactgcttgatatccgcccgaattccacactgttccccttgtccctttccctttctccctttcacctctgaacaacaggtgttcatcatcaagcttctctcaattgtgtctcctcggattgctttggcttgtgttcagaccagagcgaatcgctagactttccccatctcttaccgcttccttctggggctccacctccctctctcacttgttgtcgttggtgttgcgggcctctacttgtttgtccttacaggcttcacttcaccgtcctctcttccacgtccctgttcctatttctttcactctcctattctgctgtgatctttattgtcccccttttgacaacagcttgtaccgtctcttctcccctggccattcgtttcgaattgctaagctccccgccgtctatcttgttcttttcccctctaatttccaccgcacatacttcttcggtttctgtaagcttttgctgaatcgcaaccctgttgaaacccttcagatgcatagcttctgtgctgtggactatatttcaactgctcttaccactattccgggttactggctcgcctaggcgtgcatgacatccactcaactcacaccagccatcgcatccttctgcctgcctattcctacacctggaaactggagatccctctgcctccacctctggtactctacctctgttttctctttgatttacaacacactatactccgtccttgtcatcttctattgtattcactccgattttctctttctcgcgccatggcaactgttgctacggcgaggatgattcgcggtcaaccgccttccccacctcattctactgatggagaccctgcacctgaagttcatcgaaactcctgtggcacgctccagcaaacttatagtcatcacaacccttatgcttcctcaatgttacatggaaaccgtgcgcctggagagatttcatacgaacacagatctcactctctggtaaacacacccaactccctccatgggcggtactgaagactaaatctgttccaggactacactcctccttcatcatcggagtacgtctcttccggtgactactctcggtccctgtcaatgcaagccccggtaagtcttgtcagttctggatactccaggcctccgaggtgagcccttgtactgattgtgtcttagatggcaacaaatggccttcaagtcaacacgcccccttctgctgcagatgagggcctagtatcagactcggtaccacagtggagctcgccgccatcccagagacaggtgacaagggcaagggtagccaggtcgcctagagtgcgtcgcaggaataggaataggaaggacacgagagttgaactcgaaggtcctctgagtgaagtgaccaagcatttgacgaacatccctattcgcgacatggaacgttgggtgaatcgctcaatagaggttcgtcaccaagaggtagccaagaggaacggaaaggttgccaggcccatgaattctttcatgctttatcgatcggcatatgcagaccggacaaagcaatggtttgcgcagaacaatcatcaagtggtttccgaagcagcgggtgacagctggaggcttgaatccccagaaatccgacagaagtacgagcttctggcgaatatcgagaagagtaatcaccttaaggcgcatcctggatacaagttctcgccgtcaaaggataagaagaaacgagctgggagcgaagatgtgcgtccactggccagcacccctggatccacttcagcgtttcttcaaacccgtgccgcaagctcttcggaaattgacagtagtggatgggaaagtagggactcgactccgtttgactttgctgaccatggtttacacttgcctggggatgcctacctatcttcatctgcctggcatgctaaccatgggcggccgcaccctggcatgattccctcctctgaaccatctcactacctccatcaaacgattcatgcaggtctcgtcccgcacgtagaggatgtccgattcaagaagactggtttgaacggaatccaatatgctacatcctcgtcaactccactggctgctctacccggtgctacacaccatgatcttcttcaaccgtccacttcgttgccaggtgatggacaactggatccccagctcttgaccctgcaggtcgagctccagagcccgaatcagctctttgacagctctcacagtatgtggcaagactcttctaatgtcaactgctacgcctctccctcgtcttcattggcaccttactcaatcccttaccccgcgtcgacctacccacagggaatacacaccctagagagcgaccctgcccttgatggtaccagtggggattttgacacctggattaaccagcagggcacaacatactaagtgtcatctcagaatcagtaatcgttgaacagacaaagtgaaataccctccaccacttcatatgctaatacatactagtttatttgatgtttttccttaccttgttttttccttttttccttcttatccgggatggaagtttgtttatttgtttcttgcccctcaaagcggagttcttgttgaaggcgtgggtttctctattggatatggcccggcgctctgttgtcggtgattttggtcttaggtttgcctttgctgcactatttactaggttccatctttcggttttttttttctttgggtcatggggcatgttttgggatacgttcatggatatggatatggatatggacatgtgctttgtgggaggcagttttgttggcactactgtgcatatctcatggtagttacgggatttgatgcattagatcacttgggcattgcattataacaggaggataccaccatattccaatcgagtttactttctcttatcatgtgctgagaaaatcgaggctgtccctagtatgctgaactttaacggcacgcattggaccttctgatattccttctagtggacatatcatatctgagacattacggtgtgttaatagcctatcaatagcatttatattgtgtcatgaattgtagctatcggataatccttcctatccttcctcctttcagggactatcttagtgaatatagcgattctaatcacattaattatcctattgactcttcaatgtgtgttaccaaacaccagcccactgcttctctgacccctagaatcacactctacacagtaagcaattgttctaagacacttattcacccctctattcttattccaaacaagtctttcattacatccccattcatgccttttatttcatcttctgccagctatttatgtatctctttgttatcggctattcaacaccatcatccaaaatagtacctccaaagtgaagaactatgaatggtttctttcagcttgttttcccttgttcgtgttagttgattattacgccaaagggggctgtgcaatggtcttagaagatcacctgggcctttttttttgtctattgagcttgtcgtttgttctattgtgaatcttcatagaggtctcacagtctttgttcagtagttggatacttcagatatggtctatttctgtttgctatgtatcttcagatctgaaacatgttctccaaatagatacatgttctgtgaggtcatggaagagtcttcactttcctggccccgagattatttgctggtagcttttggagactgtcttgcgcatcgttaccatgatataggagagctactgagtaaatagatgctgagattgctatcgcaaacatagaatatctagagtaagagtcttaaggacctagcactggatatattggatgtgaactggttcctcaagtcttgaatgagttctctctgcatgggctaaataaaacatacagatggcttggtagaagtgtggaacagttcatggcggtgtgtatttgttatttggggcttactgctacctttcttggaggctttaggtaagagagatttggactctttttggtgggttggtccctagtggcgcttgaagtctggcaaatatggtgtcagtcgaatacatcaacctagcgaatagactactattcagtttgtcaccataagtatcctagattagctgaagagggctagtggactaaacccagctggctagaatatttttctgcaaaagcaagactatatcatctcaacaattgccagaaatcactcatccaattcgcggaagcacctacaggcccgatcaacgaacggaggcggcaggacgccctccctcctaagcttcttccgcagagctcttatccaaagattcccgtactgtatttctagcttatcccaaatcggctggatgaccgcttccagcctgtcgatctgcattttcccccgctcgatgacataccaacggatagaggagagcatccgataccaatcatcatcacagtgactattgtagccctcgtctcggcagcgtaagaggatgagagcgtgaatgagcatggtgaggttcgggatcttgatcttatatctttccagctcgtaagggtccccggatgctcttttattcagctcgacgtatagcatcaaagtctcatcgtgcagtggcccgatttgagtagggaggcgttcatccctagttaacatgtagtacttatcatgtcgtgacgggtcattcagagtgggttccggaaaggagaaaagggtttccgcgtgtccgtatagcttcaggtagtatgtgcgcgcgggaacaatccagtagctctggatatgaaagtgtcttgctggtatcattccgtcttcagggcattggaagcgttcgcaagcttcgacatcgctctcaggacaggctgagaaccccgcagcttggagagttcgatacgcagcattgatcagtctattggggacgatgtaggatatgtcgtggggcttgagcttgttagttattgttgattccataattatggggatggaatccttacctcttgcataaaagccccatagtaagaaagcatgtactcgttccagaggacattagggatctttgcatgatccagaagacgcgcgatgatggcgcataaccttcgtccgtaacagcgcatttctgtgattaggatgagtatcccgctctaaacaagagtgttgatacatttctaattgggtatataaggagttcctttcctgctgatatctctgggaaattcagaatattctatcctttcctacatcgaaatctccccagaaacaaaggggttgttttcggaataatcctatcgatgaattcagtccaaggctctttgggcctttctgtgtgctactgcttctctccttctatggttttcatgacacattgtgcgacagacaaagccgttaaggctgtagatggcctacatcggcattagtttaaatcgtcttggaggatttctcggacatataactattttctttatgcaatttccgtgccattatactaacttcagaggacccaggaagtaggttcgattttgaacagccgtcagagaatgacactcggaggttatcaagggccactgagattctcgacatatgaccaccgttttagcaatatcatgattccaccaagcactactataccatagcctgagtcagtagaatggaatatttcttcaactttaacggaaattgcagagcgacacatgtctgacttgtggcgtgttctgtctggtgtctgacgaatggagagcacctccgcagctggcggagaagtagtattggatgcgcgccttggttatcgtttgaggaagggagggattgaagataaaacgagaatgaatctttgatctttctgcgcttcggcttcttccatagatctacattctggcagatggtatgctgtgtataatggaacgatgatactaccaaggggacttccactggctcacaatctatagcatcagtcgggttttcggggcatggtatgcttgaggtcatttcagagcaccgaggtcaagagggcattccctttttcggcgcctccagacatactcctgggggaatgtctgatcctgcttatctagaaacatgttgagaggaaccatcttcaaaaatttgtcgctgatgtcaagtttgggttcaatatatcacgtcgaaaggcggcttggcaggaacgcgatccgtccgtcacgtgtagatcttcgatcgggcgcggcctggcgatccgcgcgacgcttccctgacacaattgacctttaaccttgaataaacactctacagcaacttatcgggcttacatgcttatagtgtgagatccatctttgtcaagtctacattattactagtacaattctcatatacggccaacggcgcatgtacatcacccgaaagccggaacattcctctgaggtcgtccccaatcgtcatgtacggcgaacacggaaacaagcttgtatgtgcttttctaatgagccatgctttatgaataacccgtcctgacgaaacccacaaacaggttcaacatgccaagcgcactcaagctctcacccatctccctccctaccaaaccgaattggtccgttccgtagcccgcgaagtacgcgacctcgaccgtgatgtcgcacacctcctcggtccattcgagggcagtttcaatccgtcacaagaaccagccgttgcctgtgccctcttagtggatcatctctgcatgcgccgcaacaaacgatgtcttcttgcctaccaccgtgtccgcgctgaaaagctcgaggagctatgctggaacggcgttgatttgctcgaacagcagctaccgacggcagatgaaggggctgcaggtgcatcaggccaggggaacgggggatatgcagcgatgggcactgcgagtggaaaccacagttcgttgagtccggaagaagaagaatacttccgacaatatagcgatcttctggcggcgtataagggacagtggacggatattgatcttacgggaagcctggagcccccgaaggatctcttcatagacgtgagagtcttgaaggatgcgggggagattcagactgagtatgggtatgtgaggcattttctatattttccctcgcgcgtattgttgatcggcgggttggaatgctgacattgcatatagggtgatcaatttgacgaaaaacagtcaactctacgtgcggcaaggggatgtggaacgattaatcgcgcaggggtttctggagcgtctgagttgatggaggatgatgagtttcagatcatgcaatttatgtcttatgataccccaatgattgatgcctctgaacggagtatagtaaaggacggtctagctaggatatgctgtgtagcgttgttttctttttttcaaggatccatttttttttcatctttgtgttcaaaaatcggaccaaaattgcatacgtgtggcgcattagcagaagctattatcgtattgattacgtagagtaatttatatatcaccaaatagatctatctagactatctagcctcgcagtagctgcagcaccgttgacggcggcggcagtgcttacctaatggtgtttgagcagaggggagcatcgggcctatcatcggcactcgtgcatccaagctcctttgctctcgcctgcagcaaagttgtgacactaacgacaaacttcccctctcaaaggtactaactaacccaagaccaattcgtgttcgtccgctagcgaccgctcctagacctctaaggtcctccggttgagatcgggcccgtcagaatggtggaccggcgacagtagtgtcttgtccgtgataaggcttttttagtcacttccgcccgcgagctttgataacgatcctggaagccatgtctgggcctcattgagtccctcccggacctttctggcctgcatcttcaggagtctgcttttcttttcccttctgacatctgactttgaccttcttcccctcatccagctcccccaatcgcaaggcaatgccaacagctgctgtgccgattaaattcttgcgtcatctgctatcatctcccctcctcgcgcctcttttgtcgccaaacgatcacaagcttcacagcctgcgggcttaattccccctcccggtggtgatctggaaaatacagtggtagactgtctgtgtgaggtgatccctcatcacagtcttccttccgtttgcggtcaacgatgggtgtcttccgctcccgagacagcagcgactttcgcatatccgggttatcccctcattgctctcccttgggggacgacctagactcagctagaacagagattccggtggaacatgccaatcatggcagtccacctcggtcatcagggttagattcaatggtatctggtggtaccagcttccgaaccccaagccggtccttttaccaccgatcattccatactccagcaggtacgcagctacagagacctcctcccagactttggatccgcgagaaaagtttgtcatctcttgatgtatccagatctgacctttacaacctagacacggcgcactattcaacccatggcctcagggagcagacggccgaactggcgtcctttgcattatctcatgaatcgaatactcttcccccttccttggatattttccactcctcccaaagtccgaaccgcccatcttctccagcaatcagtttcgcagcgcaaggaaggacgactctagaacccggtccttcctccgtccccaccaccggttcgtcggtcttaacacagctaatgcgcaaacccgacattcccgaagctgatcgagatcaccgggacagagcttcaaactgggatgagttaagcgagagtgcagcgtctgaggatcattccctaggaggtgcaacggggggtgcgcctgctaccgagcagacctctttgttgcccaagacagtacaagcaggaccttttcagagctatggagggactggtgatgttgaaagccaagccattacggggaacaataaaacagatgtacttcctggagctgctcacaagcttaggatgtgtttctgtacgctaacgaatccgaagtcgtgggacggacagactgtatggcgagatgggattgtctatccgctcagctttctgccgtcggtattccttggccttctgctcaatatccttgacgctctttcgtacggcatgattcttttcccgttgagcgagccggtctttgctgatttgggctcggacggtatctcgatgttttacgtcagtaccattatttcacagctggtcttctcatgtgggggctccattttcaaaggaggaattgggagtgagatgatcgaggttgtcccattctttcaccagatggccttcaccattctcaatcgggtgggtcaagacaacccgcaagctgtcttggccacgacaattctctccttctcggtcagctcggttctcacaggtttggttttcttcttgatgggaacttgtaagctgggtgctctgattggtttcttcccacgtcacatcttgattggatgcatcggtggtgtgggattcttcctgctgctcacgggtcttgaagtgtctgctcgactaccgggagctttcgatttcagcttggggacacttgaaaggcttatgcagctggacacggtatttctatggacgacaccgttgttgcttgccgttggtcttcttgttttgaagcgtttcttacgttccaacttcttggttggtggatatttcattggcgtggcgattgtattctatattgtgaagttcagcgccagagtacctatggattctttgcgcggcaaagggtgggtattcgatgctccatcttcgtcaaatccgtggtaccacttctatactctttatggtgagtgatgacttcttgtcttagcgagtgtgcgtcgcactgactgctctagatttctctgctgttgattggtctgcattccttgacacgatacctgccatgtttgcacttacgttcttcggggtacttcacgtgcctatcaatgttccagcattaggcatctctaccggcgaagataacctcaatgtcgaccgtgaactcattgctcacggtgttaccaatgccttgtctggcttcgctggaagtattcaggtgagtgtgctctgactcccaccgaatcaaatgctgacttgttccagaactaccttgtatatacaaacagtctcctgttcattgatagcggtggcaactctcgtgtggcaggggtcatgcttgcagctgctactgcaggaatcatggtcatcggtccagttattgtcgggttcataccagtaatggttgtaggagcgctcatattcctgttgggcatcgagctgatgcaggaggccttggttgatacgtggggcaaattgcaccgacacgagtatctgacggtaagctttatccatatgcctctgacgagcctttggctaatcctgcaggttgtgatcatcgttgcgaccatgggtgcttgggacttcgtagtcggtatacttgtcggaatcattctcgcgtgtctaagctttgtcgtccaaacttcccgcaaatccgccattcgcgccaccttctcgggcagattcaccggctcaacggtcaggcgcccgcctattcagcaaagcttcctgaaggaagcagggcagcagtcactcatcatcaagcttggtggatatctgttctttgggaccatcgtgagtgtggaaaacaccatgaggggacttattgaggaggaagcgttcaacaaacgccccatcaggttcctgattctggacttctcccgtgtttatggcatcgacttctccgcagcagaagcattcactcgcatcaaccgtattctgagaaaacgaaatgtgcagatgacaatctcgggcctcgatgtaggaggagacgttggaaaaagcctccagaatgtggggctattcgagcccgtgaatggagttgagatcttcgaggatctaaactcagcgctcgagttctgtgagaatgactacctgaaggtcttttacagccatagggaagccttgttaaacggcaagaacaagtcgtcagccttcctcgaagtacctacgccccagggtcagtctcatctcggcgatgcggtagtaagttcacctcgtcagcagtacttgcagcaagccgctagaacgactcttcacgagaacgaaatggcggttgttcaaccagctgcatggtccgcaatgcgacagcccctgccgcttctcctacagacgttccagggattgacgtctcgcaacgaggatttttggtttaaggcttgcacgtatttcgtccgcgaaagctacgcggctggcactgtactgtatcacgaaggcgatgttccgaaaggcttttatctgctggaatcgggaatgttacgcgcagagtatgagctgcctcaaggacgatacttcgaaatcattgtcgccggacggccctgtggcgagctaccattcttcagcgaaacgcgacggacagcaaccgtcaaagccgagcaggactgcgtgagctggtgcttgactgcggagaaatggcaaacaatgcgcgagcgtgagccagagattgcgcgagagctgctaacagttagcctcaagctgacgacggagcgaatggacagtattacttcgtaagtgacgccaactatacttgaaacgagcaaaactgaccgcttccagatatgttcttacgacggcagcttgattacctcatgccgtcctgtacttggcaagccacacataatctgtatcgcattttggggtggacatttgttgcatatgtaatgacctaatgtggaatgcgtttgaatattattcttgattacatattcagagatgggattgtattatacaaccactagaagggtaggcgctcacgcaaccctcaagacccatgagaggatctgtcaccagccgacaccacaacgcatgaccgccgacgaggaatgaaccgaaccactagcaaagtcgaaccatatccatcgtcctcgggtccgacaacaccaaccactagcccataagacaccctcaagtggcacggagtacatggaaagcattccgcccaccaataggaaaaagtaattgcgattgcagacaacgatcgatcgaacaatggcgtgacaagcacgagccgatcaatccgtcagtcagacgaccctgctgcccctccactcacaccccatcaacaacagctggaatctatcatcacaaccaaccacggcattcgtagttattatcctcagtagcttggcaaatacctatactgtcgaatgatcaccggcaggtacttccgacatctctctccagctctctctctctttctactgctactcacagccacgaaaatcatccggcgactgaaactgggtggggcttaagtgagggggagatggtcacgttatacattccgctgcttatctgtctaccttgggtatttagcatcaactgcttatagctagatacagtttgtcaattaagtcagtcggtgagtcatgtggctcgctcgggctggatatccgtactcttaagtcactgggaaccaacggttgtcattgattgttcacgctagcagccgttatcagtacgtaatggatcggaagggtgaagaagaaaggtcattctgatacgattaacccaagattaagatacaatgagtcagtgacaaatccgtgtcgtgtgccgtggcggaatattcgtcattattatcttcgattgggaaatgttgcaaatgcggagtatatcggagggatgtatgtagatagatgtggtaagcaagcaagcagtgtggataatttgtcagagagagtatctatttttatgtgtgttgatttgattttggatgatttgggtagtgggcgtgatgataatctactgttactccataagtatgatggtgaggagtagcgagatgcaagatggcgcaatcaatacatgttgctacggagtaccgtctggggggcggaagttgggttgggttggttggtaactagtaggagtctaaccatcttatgtaatttttttatggggataggattattacagtgatgatcttgatagcttttaagattacattaagtactacttactccgtagagtgctgtgtaaatgacaagcattggaatcagcgtcaagtcgagtcgcaatgagatgcgcgcattgcaacgctctctcttcatctcatctttcataaggtggaatcttccaccactgtttaagactgactactaaccctgactgccgacagagaggggaagaggagagaggaaaaaaagcaaagaggacaaatcggccatcattgcaacacgggccaagcctgatcatcagatcgacggtggtctgattggttaatagcggtccgggataagcaagtcgttggtgccgttcaagttgattgtcgcaacggcgaaaaagggggtggtggtggtggtgctacttgcttggtcagttagtggtttagctaggatccacttcttcttacacttgccgtcgcagatacctactgtaagtatctacttttcttctgcaagcttctagttggttggtcggtcggtcgggggcgtttgaactggtgcgggatggatagtaagtaccctgcaggtgctttggtcgattggagctgcgctgctggtacagagtaaattacttactgagctgcctggtagaaattgtaagcagctactctctacagtaggtatatggttagttggttggtagtgctgcgatggaagaagtaactattatggggcggggccccccgagtcacgggcggctctaatgttgaatgaatttcctatttcgggtatgatatgataggcgagtgacaatcatgatttgatggcggatgtgtgtagggaaagcatgcgtgacgatctcgttgtcttcttttccttcgagttgctgatggtgacggtgctttgacatatgatgctcactcggtaatgtaagttagtctgtaactgttggttccgtggttagctatgattgtgtgctgtggtttgggaatgggatgagtttcgttttcatcgggtgcagtatggataggtttgagcccggattgaaatggggttcatcgtcaggagaagcttggtcaaggaatgtgcttgattctgaggtggaactaggcgttttattctagggctggcttgactagtagttatgtaggaggtggttgtttgttcatctggtcagaccttctagggagttgagttgaagtgacttgagacaggggatgatgatagcgttggtacatgtgggtcgctcgtccgcccgccatggcgctatccagtcatcctacccttactaacgtaagtaagtaagtacgaaagtacgagcggaagttgaactgatggaccttgttgggcagggatggaattttcgatcttttttctttttcgcgctagtcaatacttgcaagattctgcttggaaaaaggaaccaaagagagaaaaaaaagttcaaaggtccttgtgagactgtgagataggatgcgacgatgggatcgcaaagccacagatacttgaggcagacctatcaaggttgtcgaattgaaggcgccatgatcagggtattgtcacgcgagtccatctgctaggtactactggccgcagaatcctcacggataaggcaaggcagtaggctgagaaggagggtgtccttggcccctggttggcccccgaattcacaacaatgtcgggctgtcacgagggggttgcctgtcgcatggatggggttgccatgattgccgctgggactggtattccccctcttccatacctgagataaaacaggttcgccgccatcggagcaggaggatggggaaggaggaggatgataatgatgacgacgataataaaaattattgattttccctccagaacagatcctgcacatcgttaaccaaaacgacgactggtcggtaaccgagcgtctaataaattgcaacctacgggcagaatacctcaactagactaaaacacggaattctagcagtagcccggcgcttaacacctgactagctcactaacatgccatagtcggaactaatcgaagactacggagaagtcttgagatctttgtggatcaggttgggcagggaatgtcctgctttcgagacttgtatatgtgaaacatacaatatttgcgttgaacttgatacaccatccatagtcacttgtcttactcctgcctatagtctacaccagggcatgaaaggataaagtgtaaaggaataggagaagcagcgaagatgccacttgtctgaatattggaacagcgaactgactcaaccatggttgtgtaacggcccagctacaagctaaacccaccaggatgatctgaataggagaccatggatcaggaccgaatgggtggcttgggtcccacaaacacggtgagcaggtgatacgggtaaacatagattcttcagaagtggtctaatgaattctttcgagtctaaaacattagaaaaattttaaaaaaatatgataaaatattcctagccttgaaaattctttttgtcgtcccgtctgatctttcagataagtttcgtttcagctgtctggatggggagtccccgatgataaggtaatcatgtcagcagcggttaaggccaactgctcgcgagccgttaatctgcacggcgggtagccagctaagaatggaggggagctggcgacctgtcatcaagaaaggtagttctagcttctcgtaggagctgtctgtcttggggaacgattcaccatggtttcaaccgccctttgacctcatagggggggccaagggttgaggatttattacctattattgggccgatgggagtagttaggagctctcgcaccggcgcaagagccatcgttaagaaaatttttcatccagtgaattacctcccgacggcctgatttatagtttggacccaataaccggccctcttctccatcgatggacaccttttcactcgaacgggattctgattgtgacggagttactccgggcttccttaccatgaaggttgaaccactatggagcagaacttccagtaaggtacgagcgtcgatctgcagactactccggagtactacatatataattcaaccacataaggtgtagatacacagtgaaagatttggattgacagaaccccatagtgaagggggggaagatagtaatgtatctgcgtgtgtgtagtaatttttttttattttatttctattttccttggtcgaatggtctgatgatgggtcaatcgaagtaggtaatggggggggcaacccctgattgttaggtaaaagggcaagggaagaaaaaataaaaatcaaatatgatattcagaaaggaaaaaaaaaaaaaaaaaaaaaaaatcaaaggaaaaaaaggaagagaaaaaaaaaaaaaagtcacagagaacacacacacacaccaccatccaagtgactagacactaaacccaggagagtttagccctggagcggccatcccagtatcaggcccaccctctttcagtctaggctctagtgccgccctgcagctccctgcctgtttgggacgatgcgccaatgaccaggcctcgtcgcccacaccctttcattttcgccctcgccctcgccctcctttcggcccctgctcctgctctccctcccctctttttcttgtcgcttccttcctcttcttcttctgcttctttcttctcttctcctcctcttcttctcctcttcatatacattctaatcgtgactgtccgtcgccgggttcatttcttttcccacccaccttttccccttccttgtgatacccgagctcttctagctttgcgcaaagagagcttttgtttccttctgttgagataccccttaaagagataccctactcgacgcgcgcctttattttcgaagcttcgccagcttctctagctcttatttaatcccatccctactgattataattacccgtctaatcaccacccgacaccatgtccgacgtccagaagcctgtcgaggagactcctgcggctgcccccgccgttgctcctgctactgaagcgcctgctgccaccgagaccccggccaccgagacccccgctgctgaggccccccaggagactcccgctgagaccactgaggctgctgcccccgccgccgcagaggagtccaaggccgatgaaactcccgccgaacagcccaaggaggagcccaagcaggaggaggtgacccccgcttctgagggtgtcctgggctacaaggcccctggtctcgtcaagtaaggctccacttgttgcgacaacccccatagtatgcagtgactaatggtgtgtgacacaaaacaggggcctccgtttcgccaagcgctttttctacttcagcgacgacgctgttgagtctaagcagctgtctgccttccaccagaacgagaaggccgctatcgccaaccctatcgccgcttgggccagccagaccggcaagggtcttctgttcttcaccaagcgcgccgaggacaaggcctcccccgccggtatcttcaacctggtcagtaaacataataggcactcggataaatgttgcgccagttgctaactcgcttgccaggctgatgtttccgacattgccaaggaaggttccaccgagctgcacttcaaggtcaacggccagaagcacaccttccaggccgctagcacttccgagcgtgacagctggattgccgccctcgaggctaaggctgctgaggctaaggctgagaaggaggctgtgacctctagcgagggctacaaggccgagctcgagaagctgagtaagtcgcatccgtagttgaagagcgcgtaatgttcggcgactaacagccaccaggcaagcccgctgttgccgagcccgctaagaaggctgagcctaaggaggaggccgcccccgccgaggacaagaaggaggacaaggctgcctccaagagccgctctcagtctcgcaagagggccagcatcttcggaactctgcttggaaagaaggaagaggccaaggaggagactgcccctgctgaggccaaggaggacaaggccgaggaggctaagcctgctgaggttgccactgaggcccctgctgctgaggcttctgctgccgctgagaccactgagggtatgttaccgtatatgaataccaggagtgttccaaatgctaacgccaacctagctgctcctgctgaagccagtgacaagaaggaagaaaaggaagagaaggaggagaaggaagagaagaaggcggagacccctgctcccaagtctaagcgcgcttctcttttcggcaacttcttccagaaggtcaccagcccctctcacgagaagtcggagaaggaggccactgctcctgccgagaccgctgtcgctagcactgctcctcagctggacaaccccgttgaggaggccgctgtgaagcccatcgagcccgagagcgtgactgctcccgctgaggctgaggctgccaaggacgccactcccgctcagtctcccgctgctgagactcccaaggacaagcgtcgcacctctttcttcggcaacttcggcaagaagaagggtgactccgacaacgagggtgctgatggcgagcccaagcccaagggcaacaagcttggtggcatcttccgcaagcccagcaaggccgtgaagtccgagcccaaggatactaaggaggccgctgaggctgaggctacccccaaggatgctaccgtcgaggagtctcctgaggagagcgctaagcccgctgaggctgctcccgcggaggagtccaagcccgtcgatgtcgccacctctactcctgttcaggctgctgcatgaagtgcttcccgcagggacgtcaagtgtgagaaatggtgggaccagcggtattcgtatccttacccttgaacttctcgatgatcagtcgttctggaaattaaaaagcccagaaaagaaaaaaatacatccaagaaaaccaatgattgttgtttttgtgtctaattgatgtttccactgccaccattctggtatccctctcctgtgcaaggcgaggtctgccaaaacgagtgtcaatgataccctctgctgctttggcggtcatttccgagcccggatgtcaattgcgtgtccggtgctgcgtttcattcctttatgatatgcgttccgcaaggatacccaactggccttgtgtgttcatgttgtgcgccgaccaaactagattgataccacttgttgctgtttattgcttgctctttgatgttctcatgttgctgtttgatgcttttgtcttgataccctactgggaggaagggtgctttttgccagctggatggggaaattccctccactcaaattggcccgaaccgtcgactaccatgactctatggtgacagtgctgatagcgccatgtatacatggcacagcatcatgaggtaatacttaatagaatccacgtattgttagtatatgatccactatatttgtttcagatgccttagtagtagtgtatccgagcagttgggtgattgtcgcactttgtactgggcaacaggtgtaacgtgctggcggtccacttggtgtatggggtggggactcttcaatgtaagcttatcatacaaggtgtgcatggacgtttgagcttgcggctgcaataatagttgctgataagggcataatatgacataccattcaacaagtatccgatatggtgtagtggctaacatcgccgtctctcacacggcagccgggggttcgattccccctatcggagctcaatttcctttttgctttttactttttactcttttatgcattgcaatgcacataatcctgtaagtatttatatggagtcttttcttttttacctcaagtggcagtctacacccaacataatctactatccaaccatggcatgcggcaaaagtcgaaactttgactgttccttttcaataaggttctccgcacgtagatcgaaagctcagcaaagcaccacagatatatatcaacaagaaaatacaattcaccccccagtgcccttattaagcaggttatctatggtgtttataccaccactgtcgattcgaactgtaccccatcaaacccggagaatcgaaacggcatccgtatgtgtacatgtgcatgaacaactgagctttcatgtttgttagtaatagagatgcctaccggtgatttctatcttctgatatgggtgtgtgcggtgtgcgtcttgcttgttgcctagtctctcgtatgtatatatctgtctttcggtgtatgtatgtttggatggctttcaaccttcatatgcacattatcatcgtcatgtgatgaatggtacgctatggagatgccttgaatagatggttctgggcggatattctgctgatgcctgctgggttgtagtggagtacagcgtgtctggactggtcttttcatagattcaatatggttgtgtatattgttgaatgtactatgtgtagtaagacacaagttcggggtttggggttccagtctcttggcagggaagttagttaacctggatgcctgggatgaatggacgtttaggcaccaatgttcctggatgggaggatttacttatcttgactgaaagatatgatggtatagtagtccattgtggcttgctgggctggaggcattgcgtatgttggtgcctggttgtttatctggtggcggcggtactagatccctctcgggaaaagggttatttgtcttagacgataatgggttggtacgactactagctatgtaagtactctgcatgctaattgtgctgtaggcatagaggatggtgaggctgctttagatctgtgctttgggtggattcggtggtcgtgcctaggatgtggggtgcaactagtagtaggtaaggtggtggtgatagtcctatgcttgaaggatgtggaatattatggccagggcaagttcaggcgcttgtatactgctgacaggcggccagagcttatgttgcttgtttgggttggtaatgttggtgattggttccattggtgttgtgctgttatgcattgtgtttcctcggagtatatactcagaagagtgacaggaggtagtagtagtatgtgttcatgcacaatcaatcctccatatagtacatctatacactgcatatcgagtaaagcaccgaatcagatactacatttacctctagatcaaatcaacaagcagggataaccgctaacacacatgtgcacttgacaacccacgcaaccctggctgcctggcgcctgcacggagcccacgggtaattcgcctagcgccggaaccatcgccgtcgccaattcgacaggacgggaagaaagggcattcgcaaggccagactagtaatttgaatggaagggactggttgtacccaggctaggtgtaccctgcagcacgaatcaatttcataagtcaagatgaacacgaaaataaaagcttggttttactcttgcgagtttgtaactagtctactgtgtagtgctgaccaggcatcatcgactccttgacaagacgtcatcgccggcggctgcctggggaggcctgcatacagcagagatgcgcgcgcgccgcggctgatgtatgcatacgcccattggcatccccactcgaagcaggttgcaacggtaggaggcatgtacgtacgtacgtacgatatgtgcgatctagagatattgaattgtccgtctcctggtcaactgagggttgacttcgcaggatatggtaggcaggttttggaggtcggaatcgttgcctagtatcctccattcactccttctagaccccgatattagaaatgccaacttcggatggaaaaggacacaagtgagatttttccttgtttgcaggtaattgacttttaggtttcacatgggccggttggtcccgtgcattactaatggcaatgaggaattccaatagtcttacggatagtctagttatctttatgctccgcccggaatatacgacgcttctccccggagataatacgacctcgaccatataccacccgtgtcgcagagaaaataatctcctgctgaatctgaccggaccgggttcaatctaattccctggtacttgtgtgaattcttcttagggccatagaccgccaagtatcgttttaattaaaaactcatttgtggtcagatgaaggccggaacgtctcggtgtcttgatagagtttgacccaagtggaatttcacgcccttcgagcgactttggcgagggggctgcagggcggggagggaattagggaaaggatcctccgaccgggtaaaaaaccctggtcacaaaccggctctgtcagtgtgtctggtatcccttgggtgcggcatcgtattcctgcggccccaataaaccgggacaggacacggtagccaggaggttgagggcttagatagatagatcctacacatcacaaaggagtgacagtcgcacgggacaagagagtgatggacacaggacaagtctcattcgcagacagttgagacattgaggctcaggctcagccccaatgacacccccgggcgctgcaccaaatgcagaccccgacgggctgtgatggtgcctgctggttggccaatgggtccggtcggcggcacgggtgcgaaccggtttcatcacccacagaagtcgcgcggcctttttctatttttttcattttttttgttcccacactccttcagtagtagtctagtggtggagttgaatgaaggagtcgaagaagggccaggaatccaaggtcgaggggggcctgctgctgctgggccagtgacctgcgagtgacatttccgttgcgggctgaatggaggaaagcccacgtacctgcctggtgctacactgtagaagaggacaatttgagactcgctgcaccaggcacgggaatgcctggggctcctgcaaaccccactttattgggtctgacagccaatcgccggctttgctggccctatgactcacacctgctgaccgcgtaagatagactatgcccaatcaggctagggcactgggcgggggtccggtcaacggtgattggcggcgagatccgggcaagaccgcacacacaaacagttaagaagtgcctggcttcccgtcgctgcctggcgcttcttttctccctcctttttctttctctcccacttcatcttttctcccactccacacatctctctattcatttatcccatctcgtcaccatacagcattatacttataccgcgtctgattctccgtgctttcaaaatggcctgctaaacgcctcccccgcaccagctacgtctttctcgtacgagacagacaccatagatcctcttcggacctcgtctttttctaatctctcctcttccaccccctcagagtctcctgttccaggacctctgaactttagcatcgctttgcgtagctcaagttctccaaacaacgctttcccgttcgacattacgtcgttcaccacggactaccaacagcaatcatggcttcccacgcccccgcctcaacagccatcggctccagtgaattcgattcccagcgacaacaacaacagcaacaacaatcccagtccccttccgcaggactttgtgctctttcccgctccgtgtcccccgccgcaacccagggactcgcgtgctcaagcaccgatcaattctgcccctagattatccgcatatcaaccttctctggtccaaccagggtatcctgttagacgacactcttcagctttgcatcagcagcttccaggctcgcctgcccaggttcctctttcggccagattagccgctcaatcttccggatattcctcgtctccgtcttcttggtctcacccctctctgcgaaagcattttgcgcgtcggttcgcaacacctgccgcttcgaattctactcctgcagtgaacaacactgctcattctaaccgcccacccgtccccctatttaacgacaagacggtcaattattccgcctttgtgaatcagcacaatcaaaacttgttgaagagaaaatacgcttcatatctgaagcatcgccgcatcatgtctaccccgaacatcgctcaaggtaagcctgtcacatgggcagtgcacgcttatgtatacggtgctaagacagtcctagatttccctgagctttttgatctccagtccaaccgctttggggacgatctcagctccccagagtccaacatgctttcgccccagatcaacacttcgttcttcagcccgatgggtgaggtggcccctccgggcaccgtctcgccgaaggacctgttcttcgacgcttcggctcccccatcgacgactttcactgatctcagcactcccccgctggatacgcctggcttcttcagtcagaacacatctcccagatcaataccgagaggatctgaacgctgtgcccgaggagtgggagagtctgttccctcaggatgggttttccctggacctggattcggctgcccttgagcttgctgcttcgcttcaacagcccaaggcaaccggaccccctccgacttcagtgatccgtgccagcgcctcgcccgcgccgtctgcgtctcctgccccatcccgtcagggcaccaagcactccacagtggccggtgtcaatgctcgccagcgcaagccgttgcctccaatcaagtttgactctgccgaccccgccgcaatgaagagggctcgcaataccgaggctgctcgcaaatctcgcgctcgcaagcttgagcgtcaaggcgagatggagcgccgtattgaggagctcgagcggatgcttgaagagtccaagcaacgcgaggagtactggcgaagcatggccaagactggcactaactgatctaaaaagtttcttgggttttcattttgggttatggcatggggttttggtatctgtattgtgctcattgtgctattcatactcctagcgggttctgtgggcgggggcgtcgagcctcctgtcaccacctgtcggaagcatcaatcaatctcttgactgatgcttccgacagttgaaaagtttcctttcgttcttgcccattcattatggagcttacaccgtgtacttttcggtagatcagcatctctgcatctgctgttgtgagttattcatccccagtcatatactgcgggtctgttatatggttgttctgcctttctgtttctatggccggttctgatgtctcccacttatcgggattgactcgtggccactaatctttctacctggtgtacttgacttatccgagtgccttttctgttattattgttgcgcttatgtaccagactgtgaactatggtattctccaattcaaagtatcttatatgcgcatcttgacttctttgtaacaacgtatcctttcaactggagctcttggtcatgacccttggtatctttgaaccgaatacgtaagacaagtaataacacggcccagccctttcaacctttaccgttcacgtagtatgaaatgacactcgatacctagcaccaagtctatgtaggtttcactatcgtacacaaggccactgatcaagccagcgccactcataaactatctacacctctgtgttttatgtatgtgcatctgtatatgtgtgtgcaatcgactcagctcagacttgcctttttatctacttcatggacaaacaacctcttgcttgcccgaaccatccataccctcgcgctcaaccaacaaacggaaaaggcatccagtataccagcacactcatatgaatgctttcgtagaaagcgccaactacagtgcgtgagaagtaccggtcctgtttccatcagtgcttgagatcccgctccgttcacggtgcagggagtcccctagatgatggaaaggcggttgcattcccacgtgagaaaaagaacagatgtggcgacgagtgtgctgtggggattactggagccgtgtctgcctgagggccgaagcgaaagagtggtggatgaagagcatagatcgaagaggcggtctcagaagtatctgatccagagttgtcatcattgctggtctgggttgatttgattgggggaggaggcatgttgttgtacgtcaaaagacgtaccggagggttttggagaggaggcgttgaagggagaaaaagggaaagaaaggaaatctattcaggtaagtgcatcggtccctttcactttgctcttctccatcttggctgtcctggacccaaactggattgctcgcttcttctcccgggcgacgttcgtcatgccgagtcttagtgcgaccaggcgaagggcttttttctccgaatcgagccctgcctctggtgaatccgttggtggggaaggggtgccgaacccgcatttctcccacactgggagctgcaccacccaggacacgaactcttcgtctaggaagggaaacctcgcttcgcgaccccagtgtgcaatgactcgattgtcacggcccaggtttcgctttccaaggcggctgacgtcaaggttgatctcgtcaatgaggcccgtgaaaccatcgcgagaaaatgctgctccatgtctcgagtatcctgcaaatagctcatctgcgccaaggccagacaggagcacccgtgccgaagtggcatattgcgtgggttgagcgtcgatctgtcgactgtcgaacgccagcccttgcccacgcgaagcgaaatataatgcgcaagcgatggacaaatccatctcggtattgtggggtctcatcagacgcttgacagtctcacgatgcgcaagggtttcctcgtacggtacatctaccgcaacaaatcgccaattacggtcggggcaaactctttgcaactctgcaaatgccgcccggccggtgatacgatcgggacagctttcatacacggagccagtggcacctcccttgcccgccgcggcggccgcaacgcgcgggttttcgaatgccacgttgagcaagtcaatgacttcctcctttggcaggatcccatgagagagcctggcgagtaatgtgcagtcgaggccaccggaaaacagtacagccactttcacattgctccctgatgaagcagtcggaggttctcgtacattctgaattcgcaatgctaaggactgacgcaacttatgctcaagttccctgacagcgacagtctcaacggttagtgaaggagcttctccatcgggtgtggatttgttcattggagggacggggtttctctgaacctctgttagctaggtaagatcaggatgaggaagaagtgcatacaggacgaagaggaagatcggatgtgttatgttcccaagaaagtgtctgtatgcaacttgcatcgaacaaaggcgcgccagcactcctcgttgcgatccagttatcctggaatatagcatgttcaaagtcaatcatatacactccgtctgtctcgacctcactaaagtgggtcgaagatgtgccgtcgcagagactgcacagcttaaaggcccctgactcatcaacaccttggagtagagagcgtcttccaagtgaatctctggtgaagaacagttttgagttgatcgcatcatagaacacgaaggcaaaggggccggaaatgctactgatgacatccagaacaccttgaacagcagtcgtacccgagtccgctgacgaagttgttttcgaatggtggtttacagcctgcagtaacagcttaaagatcagctccgcatcgttgccctggataggttcacctgatatcttccaggcgtctccattgtagcataatacggactgcgtagtgagatccaccagtggctggggaacaaggcagcctcctctcatcgacaagactgtggaaacaaaggtaagctgaacagcaatgggttcttcattgcttgaccgtgtattggctatcttctgttcaacattatgaacatggtagttatcaggtcctcttttccgcaacaagcagcaagtctcctcattaggaagcacagctcctgatgcgcttagagaaaagaaaataccacacatggtagcaaacaagccgcaagcgagacgctggcggggcgtagttgaggtgaaagacaaggaagaggaaagagaaacatgatgaagagagccggaggtcgggggaacgatgatcccccgccgctgattgcgggctgacatcctcggcgctgatggagcttactcccctatctggggcccttttttctatatttccgcagtttctccctgacacctactctgattgactctagggccgtaaagtctgttgccaatattagctgaccagacattcgtggcctattacgtggcagccccgggaaccacgtctccgcatattcccctcatgatgatccatgtttctacctaacgaggctcttttgatttctagtttgattttggcgtgcatgcaggttgcttatgtctgcgatagaaccctcggaatccccggctcctagtggtcatggggaggcccagccggccgttcacaacgtttctagttccactgaacaagtgagctcgactgacctcgagcctgccgcgcagccacaggatgatccctcaggagtgccgatgaccagccaagaggcgcaacaagtcgagatgacggagcacgttcagaaagaagcgaaggccacctctacggagtccccaagcacggtgccgacgccgtccgccacagatccctcgaaccccgtgttgcctccacgggaatcgcttccggagcggatgaaggggctttctatcaccacgacagcaagaccggcgcctgctacgttgccaaacgcagaaattcctcctacacccccggcgaaagacgaactttatgtatcctcaaaccctcactccgcaatcacacactcgcccgcgatcgaattgactgataaggaattaccggaggtgcctgaaaacgaccaagacggaaggaagaatactggtggtggtgacaatgactctcaatcggaaattcagagtattatggatcaattccaagactctacgcgcggtgacgggcaggaacagatcatgtctcctcgcctggaactagccgagcagtttctgggtggacagagccactttccacctcgtcagtcaagtttagatcacagtaaatcggcggctgacgacgcgcgcatgcccaagtctgcgacaggggcatcttccatctcagctgagaaacaacccgcaaaagttcccaagagttctgctgccgacgaggccaaattgagccggcgttcgtcgacatcgaccattcccccgccacccgagcctgagccggaccaaccgtttgattttcatcgctttttagagcaactgcgtcaccgtactgcggacccggtcgcgaagtttctacgctcatttctccatgagtttgggaagcgacaatggatggtccatgaacaagtcaagattatcagcgatttcttggtgttcatcacaaacaaaatggctcagtgtgaagtatggcgcgatgtgtccgacagtgaattcgacaatgccaaagaagggatggagaagctcgtaatgaatagactatattcccaaactttttcaccagctattcctggtccgcccacaatcccacgaagtgcgcgtagaagcaaaaggcgcgagatggagaggatgcatggcccatggaggcgagggcagcatcaggaggatatagagcgagatgaagttctcgctcagaagatgcgaatttacagctgggttagagaagagcatctggacataccgccagtgagctctcacggtcgccgtttcttgaatttagctcagcagggtatgtgatgggccctcttttcatcgatcgacgtctatctaaccggttacagaattgttgaagatcaacggctatcgggctcctcgcgataaagttatctgcattttgaactgctgcaaagttatattcggtaggtagcaggcttaatgcaagggctgtggagtgacatatgtgctaattttctcaaggtttgctgaggaactctaaaagatctgacacgtctgccgattcttttgtgccgcttttgatctacgtggtgctgcaggccaatcccgaacatctagtatcgaatatacaatatatcctgcggttccgcaaccaggataagcttggaggggaagctggatactacttatcatcactggtatgctgaatcctgctctagataacgaccatattctgacctctctctagtcgggagcgattcaattcatcgagacactggaccgaacgagcctaacagtgagcgacgaagagtttgagcgaagcgttgaagctgccgtatccgctattgcccagcaaaaccgcgagtccgagaccttggagcgccaaacctcaggccgttccgccgaaggctcccaatccgcgccacgaagctctgctgacacgcaacgcacggccgtgcgcaaagaggcatcacagtctagcgatgaagattcggccccagtagcagggcttctgcggaccattcagaagccattgtcgaccattggaagaatcttctctgatgagccagactcccctcaggatcggcccacgcagtctggggcatcgccacgactgacaccgaacgtgtaccagccgccccgcaatagcagcgaaggccggcgatcggcggagaggccacgcagtgcagcctctccgcaggttcccagggcggatgctcaagatgccgctgcgcgtcaagccagcgctgaggatgcagaagcacggagaatccatcgtgcagagcacaacaacgtcgtagagactctgtgtaatatgttccccaatcttgaccgcgatgtcattgatgatgtggtcaagataaagggtggaaggtaagctgtcccttgcttctacatcaggagcgatgtattgagtagctaacactggtaatgcagggttggattagcagtagacgcgtgccttgctcttagtgctgagtgaacggagtttggtggaagttggtcaaggacaggcaaattacattgagaggattaactttcgggtttttactccttattcatttgcactgtggccgattatgtacttattgcctgggctaattgcatataataatactgctgaatggtagccataccacccagaaatgagtaaactaccgaacagcatctacataaaaatcgagccactgactgagctgcccagagcgtagggtaagcacaaaagtgtgtcccgagccattctgcatgatatgaatgcacgacgctatcagaggagtaaatgctagcaatcatcgaggtattcccctttcaagaaacaactcatcgaaagcacaagcccctaacacatccttgtactcctgtaccaggtcccaaaacttcgcatcagaaggttttaataccttgaacccataacgacctgttctataccaaagaagattatagtcgttataacatccgtcgtgggagaaatccccgtaagccaaaacctgcaggtgcaagtacccttcccgcccaaaagcccattcggcataagaaggcaaaacatcataggctactgaattatctggtatgcgttcgcgtaacatgggtccacttgctctgatatgaagaacttcgatagtggggctgagtccgtgatcgccctgtcccagagaaacatcaagtaagcattcgaggcatttcatctcgatatcaaacatatcaaaaatgaggaaataggatagtgggtaccgtaattgtacacatctcgctgatacttgccgaaattcccaaaaattccaaccctggatcgtgggatatgcggggtcgaaattcaggcgacccaaacaaatctccatcttgctggaagccgacttctgttctccagaggccgtgtgtgatgaggcgcctcagtgtggacttgtgatgcaacatgctttgacacatgccgtcccaagagactgttggaagcataagatagagatctatcaagccggagaaggcctcgaggaaggctttcacggtttcggtgatgttgtcctgcgactcgtcggtaatttgatttagcttttccgggttgaatgtcagttcgagcaatttcagcttaagtggcatgcctgagtggacgatctgtcgaaggaagcggaatgtaccggggcagttgatgagttgcaacgcttgaagttgccctacgttaagagcaccggtcaactggacttccatggggatgaaggatacttgggagagagtcaagcgttgaagagccgtgagaagggtatatggtttttcttcaagtgaaagaccaagcacgcattgcgcaaagaagttctgtggcaatattgcatgtttatcgaccatttttcggaaaacttgtctccaggccaatctagcggtgtcccagccgataaggtcgaggtgcagtgtcttcaattgagcaccgtgagcagcgataaactgtctaaccgactcaaagtcaacatatcgcttaagacctctccaggataggtgttggagctcagaaagttgagcaagatttatggcgcatgatgcatgtctgattctggttacaatgcagtcaccatctgtgaggagagaaattgtcgtaagtttctcttgggtttctaaaatcctgttgatgaggagaaccacttcctcggaaaaacatgtttttagatcccacctatagcgtgttagtgttgactcgccgtagtgcatcagaaatcaatatctgtactggaagctttgaagttgaccccgagggattcctgataccatgcgatacatgttgtgtgtcatgatcggaatgcagtcaaacgtagtggtctgctgatctccgcacagtattaattttgacatgggtccatcaacatcaccgggagcttgaagcctgccatccaagaaatcatgcaaagaacagaattgataggcttctatctcatgatatgaaccccacagcctgaggtgctttgtatgcaccaactgcgagtgatttgacctcgtgattgcatcgttcacggactgagctgatgggtacgttgcttttatgactagtgattcatatagacaaggaaccatctttacatagatgttcttggagacttcacagagatttttgagatcccttcgggtcacctgggatggcgaattagcctgcttcaactgctgctggagaggaacagaggactgcttacatgatcgagcaccatgtgcagtagttcgaggggtaatctgtctagcatcgtgagatcgatagtcactcggaatagtacatgcagatgaatctcgtttttatgttagaaggggaagtatcattgacggatgatgcttgatctgcccgtcggtttcgaggtggggccccactggcatgatatactgggaagtcaagtcacacaatacatgtggtggggtgcacgtgtcttagtggctactagtatagatatgaacacctttcatgttgcccggacctatggatagcctttatctacttcgtgcgatctattccacgataagatattggggcggaggtggaggcacttgcccgtacatagtacaagcaaatagtcttatcaatgtctcttgagaagcacatttcatctttgattcgatacacagaaattggcagaggtcggcagataaatttcattcttatgtaggctgattttatcatgggactctactcgcgataagagctaaatcagtcccagacttgcaaaaggggacgcgagtgtcattgtatccggatagtgccctctagtcttttcagcccatgcccttcaggtgctggcttcactttcaacctcatctagcttagcggtccagggggcagcatcactgcgcttctcgacctcatctagcttggcagtccagggagcagcatcactgcgcttctcgacctcatctagcttggcagtccaaggagcagcatcactgcgcttctcgacctcatctagcttggcagtccaaggagcagcgtcactgcgcttctcgacctcatctagcttggcagtccaaggagcagcgtcactgcgcttctcgatctcatctagcttggcagtccaaggagcagcatcactgcgcttctcgacctcatctagcttggcggtccagggagcagcatcactgcgcttctcgacctcgtctagcttagcagtccagggagcagcatcactgcgcttctcgacctcatctagcttggcagtccaaggagcagcatcgctgcgcttctcaatgccaatgaaccctacagatacaattagttactctggactgcaaagccgtggtaaacactgtacttaccaggggttggagcagcctggaccccaacggtgagaagcgtaatagctagtgcgaagtttcgaaagtgcatctttatgaggaaatgtatttgagttcaattgagaaaatggagcttgagagtagttttaacggagctgcaacaacagaaggaagattgactagcttcgacaaggcccacaacttgtgcaaacccatcagagtgattctgtctcttatttataatggaagatctctagcctttcaagctcattggggatgacgagagatacagactgatacggttactagtttatgaaagatactatactggtcttttccgatacaaccatattgcgttatccatcgcgtgcccttttgcagacatgatgactgcatagaccagatgcctactagactgaaaagagcatgctgacgacctcctggccaagtccggtaggcctgtagtgctctccctgtgtgatacctatatgtctgaactacttgatgacatttggcgcttattacgaaaagttctacatagccccagtcatgataaaattgcgggtctatctagatgcatacgcacgtacctttagccacgtgaatcgccaatgaaaatgggaattaaagtcccatgacgttctggtaacatgtaatccgtgcttttcaccttttaaactctaggataagtaactgggccccgattggagttcttaaaccttggcctatttgtcgatagtagttggtaaagactctgtattggagaaggccgaaagtttcgagtccgtctcccacatgcataatccttctggcctacaaattgaatactacttctcagcgttcgttagcgaccaaaaaaccctggcattggcttttttcaagcacaaagtgcacattctgccttcgtcatgcacccagctgccgtctctttcaaactccccactctacccaaagcctcacaaaaacccgatgaagatgaagaagagtacaacgagggcctacttgctgccagggagagttccgacttggccacggcttctttggcacttagacgcctctcttctgacaagcgacattgcacgagcacttcctcgaggctactgaaacgcataggattgctatctttctacctagtcatcttgcttcttgcgctaaacggtttctaccacctagtaagaccgtatagtggtacggtagcgcaatacatccactggcccggaagcctatcccaagatgatttgtcttgctcctgcggcgattctatagctgaagccttgactcgttcgtgccgctatgacaccctctccgcagcctggctaccaccacactgccgagacgacgaattgactgcacgattcgacgccgcaggcccaggtgatggtgggtcctggacatactacgcagatcaatcgggaaattctacaatgacactggcggagatcgctcaattgccgggaaatgacacccatgagtttttttacatgacctaccgctggcacgtgttccattgtagcttttattggcggaagcttcaccgcatggtgcatggagtagaaggagcagcgaagaggattgagtatcggtctgacagcgagtctcatatcgaccattgtgaggggatatttacgctcaattatccgctggacgctattgcgacagggagtggtgtgagtttaaacgccgataggattcccaacatccatgaatgagagtttattggaggagagtggaggctggggggaaggagagaacgaataagagagattgagcacgatcgatgtttcaataagccacaaaatggcaaatgtatgggctagaagcaaggaatatagcaaacaaacaaatttccactaagccgtcgtacctgctcaacacatcccctgcctcttgctgtaggcaaaccccactaagtcgtattgatactacatgatgactagtattgtctccactaaggctgtatgccaaaggtggggatgggatgatatctgacatacgaatctctgtgacttggctagtgaacaaactagtcgatgcagtaaggcgcacgtgcctaaaagcctcatatgcatgaagcggtaagatcatagtgtctcttgtatcagcatccaatctagggcgccttaggtagtgaatcctccagaaaatgaccgctaggccatgcagtaaaagactagaattctgacagctcagattacgcatctcttataagcttacaggtggatgtgaggtcagaatctcacacgatggtgtcattccccgcgctataatatactgtaaattgcaccattggtgttatattcaatcatcatgtcacttgagagagaatcgtagagagtcatttcaaatcattgacggcaaaagcgcacagacaagggatcaacatcacccggaacgggccggccaatcgtgtccatccagagatgtttcaggcttttcagcatttcgtcattttgagattcacggcatcgacgcacggaaggaaaatacaatgcgagcggggtaggctagaacgtagaccaaggggtattgtctcattggccgcggatagagtatcttggatagaactactagcagtagtagtaaaacatgccgccaagagaaagcgtccggcagggtggacggatgtggaggtgaaaacatcctggccaatgagaatggtggccaagttcaggccaccagtgccacctagtgagatagcttagtgagatagcaaagtgagatagcaaagtgagacaaaatgcttgcagtcggctaaaaagactgatgataaagataatgtacggagcaggatccggactccgcatatgaccgagtcagccattagaccttgagatagccccacaatgggacaccggtctgtatgaaatccgaaactacttactagtatacatggaaattagcgagccgaccaaccagaaatagtcagagcagacgttgtagctctgtaagcgactcattcgaagacatattgtaaaatacccactcatagtagtgttctgtgtcaaattcacaatcttgaatcgtggtatacaccagtgctaggcgtactgagcggatctattacggaacaggaaggtgcacagccaacccgacgtagagactacctacaataggattatgagtacaagtgtagcagtagcaagtgataattacgagtgatgagggttgtgtcatgaaaatgccttgaaatgccccagccattatcatatctgacagacgtaggctgggctagagtctgaaggaggggagacaaggtacctgaaggcccttcaatccttgaaactacacttgatccatagtcgacgaacgttgttcacaataagaaattgcttccgcttcaaaatctacagatgaacccagtagccagcgcggacccaacatgttcaaatattctcgtctccttcaatcctcagaatgcgaagagaaataccacgacccagtgaacgcggccgatgatgatagctttccagaatttcctagagcgcaacgaggaccgaaacatggaatctcctggttcaggagatattggtgctctgtcgctgtgcacatcgccctacttttgctgaatgggcttctagtcacattgtatgcctccatgtttcttatgcccaaaacccatttgggttcttccagtgagtcagcccgttccctcgaaatgcagagatcatggctgaattgtgttcggccttcaaagatactctccaggataacataaagcttgagaagcaccgatttgaacttttggcaatctaccgacatgacggcgatttgaacccccacaaaacgaacaactttagcgggccgccaaggccggagctcgaggaggcgtgggacagactcatgaagagttcgatgcttgaagatctaatccctttggtattgcaagtgttaactgttcccttagatgcagatattaaagtcagccatgccgagctgggtgagtttgctggtgatgatagtgttatcaaactcagtgacggcagcggctattatgtgacagtatccgctttccatgggctgcactgtgtcaaacgactccatatgtacatctatgcggagcactattatgcgggactttctgagttcgagcttttcatgttgcgacgacacacaggcatgttacgacaccatgagaatgtcctttgttggaatatgattgtactaactagacacagaacactgtctagattggctgaggcagcatatccaatgccacgcagatcctactttcattccaatacactggactactaagtaagttaccatgtaggaatgatgtggttgtctgaaactaatgcaaaaatgacagtgatgccagcccagtggcatcggatgacggcaaccatcagtgtgctgactggagtcaagttgaagagtggatggcagagcgctctttcgatccatttgagccgggtcttctcgtacaccccattttcggtaagggaccaccgtccattttccgacactatttaaacccagattgtttataccattttctgcgcaggagacccatatacggagaatcaaacccatcctgatttgggggttactgaaataggcactgggaagttattgaataatgatgggaaagtgtctgcttagtgggacggttcgaccggaggaaggccacgtgtgacacgtgcgatagattagctgctggttcaagagcaagctgagaagtagttaactatcttaaccgagacggtggatatctaggtattcgtcgtcctgtattagaatttcacaaagccacatgacatgattgcttgaaagtccagactccggtctcgtacctcccaagaggctcttgcatatggtggagtatttcaggcccaccgtctcgaaatcaaattgtgaattcaagaggaaaggactagcgttgtttctcatgaatgcttggtgactcctagctgcattactgaaattcacaactgtggccctcgtatttggctttgcaattttccctttcaaatctggcgtaagtcgtgcttcatactatcagagtacaagtggtttttgttactttcctcgtaatatcccccgctgcctgaaagtacccagatacacttagggaggagctacttgctatcccaggatctactccatttatcatatcaccactcacagatggacataaataacctttcaggagaaaacttcatcgccctttccccagtgccatttcacatcaccaagggctcgcatcgttccctaagcccaccgacaaattcatgttccggctgcccagcatatatctttattttactataactaccaaagccagtcatgaatctatctgatgattcaagtgttacggagtccgacagaaccccatttctttctagggaggagtgtgcggtgtcatccacaggtgacaagagcgacctatttgcgaaggcgcggaaaaggcattaccaatgcagcctttcccaagctatcacatacctgctcgcggtgtggggtttcatctcagtctgctataacacataccgtttgatttcgacatctctatctccccacacgccatcgccagacgccgcaaaaacgcaggaggtagactcgaatccacatgatcatcatccggaagcgcttccacacgaacttaatgtttgtgattgcggcaccacaattcaagaggcccttagcctcaactgcatctacgactccctatccgcagcctggcttcctccgtactgccgagatgacgaattaacggcgcaattcgagcgggctggtcccggccccaatggcacatggaactttttctatgatgagaacggcacgatacccatcagcaaggcagaaattgccacgttgggtgagacgggaggttcgttctgggcctctgaggagtggcacgccgcgcactgtctcttttacggcaaaaatactataggatgaaggatacgggcgtgatcctggaagcccgatttgatagtttacatcatgtaaaacactgcactcagcttatcatggatcctggcccgggttattttgtcctgatcgaggtgccagtggttatgaattccagcgctaatgccgtgcggacgacaaaagtttcgggtccgattccaggccaggcacgtttttagcctcggcgatcgataattttggtcccagattgcgacttatctgtcggtcgcctgaatgattacccctcttttgtaattacggagtaaaccgaatgagaactgtgtatagagcactttatagcgcatagtaagcatggtggctttcgggcttactcagactagctcaagacaagcggtgttcatgaggggaaatcgaacttgggcctcgcttgctccaccaggtgagccgcttgtcacatactagcctttaaactatataggattaatactgtattggcatttatttcattctgacgcacatggacatccctctaaagacaaaacataaattaaaccctagtcgagacatatttagcgccttttgggcatgtattgtgtatattcgcaaataaataatactgaaaatgccttcgtataccttatcgggccaatgatcattcgatgttccaatgttcctttcagtttacactcgaagatgtcggaagacgcggcaagtgaaataagaacgcagagaggcacctggcattcgagtatgcttatccctcaggtggcctacaccacagatcacacagtcctacttcttcaaactccaacctcccgtttgaccctaacgaatcgaatcgtgtgagattttgcttttatatcgagtatgtggctattctaccctataaaatgttgaatcatgaaagatcaagggcaaggaataacgaaaagacatagtaacaactgcggaagccagtcaatgttccaatgcatgatcatgatgtttcttcgcaaagcaaatcggagcgaggtgaatatatagctttgaacgaagacgaatctaccgaagaccttgaatctccggtgcctagacgccgggggattttgtccgtctcatttttcaccaaccctcttgtatatgcacctttagcaattgttttcgcgggagcaattgtattcttctggatgacccgtaccggaaatcaatataaatacacagattgtggagtgactcctgacgaagcacgagcacgaggttgcgtgttcgagccgatgcaacgcgcttggatccctccagagtgctattttccggagccaggggaagactacgacacctttcaggacagacagtggtacatggaccccaagatgacgattgacgctgatgtagagaagttggaggctggggaagtgtccgtagcctatacgcgctactggcatgacgagcattgtacctatcttctccgaaagctcgcccttgcggtctctatggggaagaaaatgatcaattcgaaggctttggatattgagcattcaaatcattgcgcactggccatagccgagagactggctagctcgtacaatgtctcctttgtggaaactgaccgttccttcacggagagccatttggggttcgaatggtgcctaccactcaaggtaagttctttctatgcgatcctggaccccttggaaatattactttcctgttaacctttcgtcttgcttcagactgtcgttggcccggataaggctgttccagtctaccccaagggttcagaaaagaattaagttctgccaccatcatagttaagcggggttggcaaagcaacgaggacttatcttcgcaacggattccaatgctggctaccgtctacttccacaaattaaaacgtcatccaatgaaatgggtttgcaatggcaatcccatgccattcatcggcactgtttgccatattatggctcttctcattattgcatcgtaactgaatatctaaaccttgatattcttgtcctagtgcaccgattgggactcgttgatacggcagccctttccatttatgcggaagatacaaagtagataactcaaagatacttattaccagccatttcaagtagtcggcaagtagaattcgctccttctgtgtcgtcctcaccaaagcgatgccatgggatgcaaggagacaccctcccaatagtatccacgtgacataccgaaacgagtcgtaccgcccaacctcgcttaccgctagcgccttccggagtccccacccaatcctatataagcaactcccccccggctcccttttagacttttttcttctttcttttcttcatacttaccttgtttgggtgactgcgatcaagaaggcggttcaccacggattggtccctgcattgcacagcgcggcggaacaatccgttcaacggcctacgggtcattgacaggcgtattctttggcacttctccttttggagcttttattttcttttcatcagttcttgggccagtggctcgagggtggggaagagaacattgtagcagtaggcagctctagtcaagtggtggcactataccagcgaataagatgagtagcagcctgtgacggaagtaactaccgactggaaggcaatcatatccgcgatcttggagctcgtactgcgtacttggttgctaagccacggtggcctatgacgttgcggaaaacatctcgccactccggcgcacataaataagtaaacaacgtctcaaccggcccatcgccgacatagtacctgtctatctatcatacttcaaacaagtccacttctttactcccatctctgaaagcaaattataatccaatcctcctgataatgcctcacaaagacaccagctcggtgcctaaccgcacagacggaacctctgactcttcagtcaaccgcctcgcagccacgggaaacaccctcggcgagtccgcctttggctcaggcatggaccgcaacagtggtacgatacccgaatacttgtccacgggctccgaagatctcaggcctttgagcaaggaggaagcggagagattatacgaggagagaatggaggaggaatacgcaaagcgggaggggggtgcttaattgggttctttgattattatttttaacttctacggagtattgtgtatatatgtatcagattgacctgcacaaccatcatgaaccggaaggaaatactaattgctctgatcgaccaagtaaacataaacgtgcctttcgtagtggatgccactttctgggaaaaaaaagaaaaaggctaagtgaagcattatatataaaaaacaagggagccaacagcgcgattcgaacccggcacctcctcgacggcgtatattgcacgagacacttctaccttcatatgaagcctgtaaaagttacaaaaaaaactggtagcttctctttgattgagcgtgtcatccttagtgcaggggccatgctaatcttctctgtatcgtttcaaattgaccaaatgcccgaaggcaacagtacttctttacgatgaattatataggaagaccgggtactattctacgctcctgattggcccttaagcgagccgccgggaacaccaaagctgccttcaccccgcgctgttgcctgaggacgcacagtgtagtacggtgtcggtcggtcgtcgtgatcgcgatgagcacgttctacatcggtgtcgagcaggttcagtcgataaatcatggacggaggatagcaaggcctgccgtgtatgctcttcgaagatcgtcggagtgctacggagcctctttggcatatgcgcctgaacctggcgtgtcagcaatcatgctcatttggaagcgtagctaggccacaagaagtaaaatcgcaaagctgcaataatggggagacgaaagaagcaaagcaagcataagccaccatttgagatattattagcactcgagactatgctcaaatgcccaagcacaaggtggaatagaagaagaaaagaataaggcgaatagatactcctagtcgcagtcgcccatcggctccggtggcccctcctattcctcttgcggcgagatcggctataggccggcctcaacaacaccccatctagcggagtacttcaggtataatcgaccactctcaatcgcatactgcaaatagagcccaccatgattaagcatatttgcacaacggagtttctataatgctgagtctacgtcattaatgctacgagctggagacctgtgtttgggatcaactcaaccaccctaacggcgcagctgaaccggatctacggagtagatgcctacgatttaccgcgggatggcatatgctttcgtctttcctcttcaatctctatcaatccaattttggggtacaagactaatgtgaagcagattattgggagtgaagtgttcacctcgtttataggtgctatttcctctccagctttgatatgcactgctacaaacccaggtcccggtgtctggacatgacgcagatcgctgctttggctcggaattttctcataaagtacaattgcaggcagtgaggctacctaagtagtccagagaaggcaatgatagatagtagcttgaatatataaattgcttctcccacagcccttttccaactcccccaacatacacttccccctcgcatcaatcaacctaccaatcacactcaaaacaattactataccatactattaccaatcaaaatgcgcttcacaactttctctgtcctacttctatcaactctagcactggcattcccagaatccgacccagccatcgaaaagcgagacgacacgaccgactcagacatgcccaaccccttgagtaacctgtacacctacctacatacctacatatttcttactctcaacccccatccagtatctagctaacgagccatcaaatctcacagagccaacccaaccactacaatgcccaccctcttccccgaagtgcctacctccatcagatccgacctgatcactgaagtcccgacctctgtcatctccgagatgacgaacccgacagcttggtcatcagtcgcgagtgagtggaaaaacggaatcgttccgtcttggtacagtagtttgaatggggatgtgaaatcgtatttttcgacggcttttgaaacggcttcgccttccacctcgtcttcgcatggtggtgctgggcctggggctccgaagccgacgggtatggcggggattatgggtgctgcgggaattttggggatggcgattgttttgtaggtttgcttgggtcacatttacgtgtatatttatgacgtttgagggagggaatggagggattggttgtgagatgatatatccgcctatttcctggtttctagccgaacgcgccagagcagaaggagaaccgatgtttatagacggcctgtgcatattgaaataaaggtataagcacgacttgacacttcggtgcccaaaccattgcatctgcatgcttggcgagatacagtcagattggaaaggttatgagcccggcttcttgctgcaaatctagatatatctcaaagttagtatttgacatcaaatagccactggtaggcctgtaataaacaggaaagactacaggaatcccagaatctgttggaagcagaactagagccagagccagagccagagccagagccaaaagcttcaaaatctcaagctaaggttctggtatcgaagccttcaccattcatttggcatctcaaattatacaaacccactggttcacttgaccacgggcttgctgatctaaaggttcgcatgcaaagaccctcgcaaacgaccttcaaaacggcctctccaacgacctcgcgtacgtctgaatctacgcccgaaacacaggggagccatgtaccatgtcagaatcttgagctgaatcgggctaatcatgcaggccgcgatgccatgcattcattgccttccggtcattggctgtggacggaagaggatgggaaactaactgtaaatgcttagccctagtttcttcccctcaggaaaaagcaaccatgctcgtaatacgtcggagaaatcccacatcgtccccttacccctcaaacacatttgatcattcgtttcatctgaaagagaccaatgccccaggggtctcaagatggttctccggggtctccgggagcgctttcacaagcatcgcctcaggcattcctccgcagattcatctacactggaatccggccgtagctcacagcaatcccagagtaaccagaatccaccaaattcctgtgtggcagccccagatagtcccaaggatctatggcaagaggccttcgacaaactcgaccagcccgcccgagacaaactatgttctatccgaaatgcggacggaggccttcacgcccgtacggaggaactcctccagtccatagtccagaccacacagcggcaatacgatgaggacgaaaagcgaaacggggagagcaagacccgccagctacgggtgtatgcccataagactctcagcgccgccttgtcctttcagagtgtcataagcgcagcggcagcttgcgatccgacgggacatgcgaccacggcatggacgttcgtgtccctggcgctcacggtgagtttcaatcatggcttgggtcagatctattttcgggcctaaacaagaaatccagccgtatatgctaatatggttgtcttctttccagatggccaagaatcgacatgatttacgcgaagccgcattcgagtcttctggattcatcgccgacacgctcgagcgatatgccgttgtggagatgtattgtcgccgttcggtaaacaccaacacgcaggtcccgttggaaagattgttcatcgacacctatgtcgccatcctaaagtatactgcagagatggtgacggttcggcaggcgaacgtcggcaggatgcttcttctaagtattaccgccctgaaggaccagccgctgagcacgctcaagtccgccattgcggagcaagataaacagctcgacagttggatgcggctggaccagtaccgtcgtcgagacgatgaagcggagaagctactcacgcagatcgacgtgatcgctgccgatgtccaaagcttgatccaggattttgaggtcgccaagcttgtggttgccgacggagcagcatatgactcctatgcaaaccaacttaatgaggggtgcctcgaaaacaccagaaccagtctactccggcggatcatggcgtgggcggaatcgccagatgagaagtgcattttctggctgaatggcatggcggggaccggcaaatccacaatctcaaagtctgttgcacggaaattacaagataagaactacctcggggcaagcttcttcttcaagagaggcgaggctgatcgtggaaacgcaagccgattttttgccacgattgttgaacaactgattgtccatgagccccgattgatcccgcgcgttagaaaggcgatacaacgtgactcaaagatcgccgcgaagggccttgtacagcaattcgacgaactcctcctgaagcccctcttggccctgaatgatgatctttcgcagcattcggtgttggttttggtcattgatgcactggatgagtgcgacaagattgaagacgtgcagcagttgatttcccttcttccccggatccaagagtcaaaagcgatccgactccgcgtgttcataaccagtcgtccagaatttattatcaaaacaggattcagaaaattatctagagatgaccatgatgacgtagccctgcacgaaatacctgccgagactgttgagcaggacatctcgttgttcatacgagacagactgttgcagatccggacggaacgacaattgccgagtgaagacgactataactgggctgacgaggacgacgacttctccaaatggccagaggagagcgaggttgcgcagctgattcaaatagccctcccgttattcatctctgccgccaccatgtgccgattcatcgaggatccattgaaagacccaagagacaggctgaggataatcctcgagaatcaacccgcatcccacatatcagtgttaggcaagacataccttcccgtattttcttcaatcttagcatttgaagataaaagtgaacacgcacagacagtgaatgagttcaagagactgatcgggcctattatcatcctcgccagtccactgtcggtcagcgccctggcatgtcttctcgggataccaaaatccacaatcagccgtcaattgagcttccttacctctgtgatcttcgtaccgaaggacaaaggccagcccgtgaggccataccatcaatccttccgagattttctgctcgcggccaagactcgcgaagagaccccgttctgggtagatggtgaagcgatgcatcggcacgtagctctctgctgcatacgagtcatggaacgatcgcggaccggcttgcggaaaaatttgtgcaacataccgagttatggaactttgcgttcggagatcgacagggagaaatgtagtcaaagtatatctgaagagctcagatatgcgtgccgatattggattcatcatctgcaaaggggaaaggttgctctacgagagggtgacgagactcaccagctcctagaaaaacaccttctgcactggtttgaggcgatgagcatcttaggctatatatctgaggttgtggtcaatatcaacattctgcggaagttgttagaggtaggtctcaatctcagacgccgccgaaaaaaacaaaaacaaaaaagaaacgaaagtttttttctgatcaaggttaaacaggtgcaggatgaaccattgctgtccggatttctctatgacgctcaccgattcattctgaagaacttagggattgccgagaaggctccgctgcagctatacgcttctgcacttgtgtttgctccgcaaaagtctctcatcagaaacatatttgcgaggtatatacctccaactatttctcggctgccaaatgtgggattggagtggggcccaggattgcaatcttatgaaggccacaatgggaggagcataataggggtggcatgctcgccagacggcgaagtcattgcttcgatggataaggttggaacgatcatactttggagtacggtcacaggaaccattcgccagagcttcaaagcaatccacgacaaggacgaactgcccaaaatacagccaggtgatagtaagctaacgttctctcccgatggtaaattactggcatcggtgttcaaaaaagaaagcggcatccagctatgggaggcgcccaccgggttactgcacggagagattcccagacatctttggtgccacgatcgaccagcttttacccctgacggtacgacagttctcttacaggacatttccaccaacccccacacattaggcctctggaatatcgcccaacgtgcgttccatcagacactggagggtcaaattgatgagcttttggcatcagcaatctcacatgacggccagatagttgcaactgggtccgatacaggtatattgaggttatggaacccggctttgaatctgacagtgcaatcccaaatcaaagtatgtgatggttctatccaatctttagccttttcacctcgcgacgacctgctagcatcgtgctctggccatgtcggggccaaggtatggaatgtgaaagatggttcgctaattcactctcttgacgatctctctttatcggtggcattctcctacaatggtgaattggtcgcctcttgcagctggtttggcacagctaaactatggaacagtacttcagggaagttagagtacgagctgaatcgtgttcgcactttcgctttctctcccaatggcgaatttgtttctggtacgagcgatggcattgtacgcctgtgggacttacgagtcggcaatcgagactcgactcccttttctaattccaactcggctctttctgtacatgccttacccggttgtgaactaaactcggttctttcgattacttatgacggctcaaaactctgggatatcccctcaggcactccacagcatcagctcgaagctctcgaagatcccatttttgatcctaggttctctgacgacggccgtctcattgcaggtgttgtcaatagaacagtcaaggtctgggatacaagcagtgggaaactaatccgggagttgcagatcacggatattgaggattggggtattgacgattacatcaacgtggagattgccttccggccggatggcaagatcatttcatggtccctggacagcctggagtttcaggtatgggacccattttcggggaaacaaatcgaaactttcaccgactcaattgagctgtgctcttttatagtctcccatgatggtcacctgctagctgtcactgacggtaggaaagtcagcattcgtgaaccttcaacagggaagcacttctacctagagaaatcatttgaatcctgtttgatgatggccctttcgccgaacgacatgatcctggctactctttcactgagccgtggtaacctcattgtggatttgtgggacttgccaacacatgaattgcgtagctctctcaatgtcgctggacgcaaaattcaattttccgaggatggcaaatgtttctgtaccggtcatgaaatatatcacatagaaactgacgctgaggggcatttggtctctgtagctgctgatgttgatccaatacgtgtgaaagatggatgggtgtgcctcggtgaggataaggttctctggcttcctgatgaatatcggccaaagagcgactgcgagaatctttgcatcaaagattctacatttgtgcttggatctcattccggccatctcttatttattggttttgacatgcatgctaaacgatatgcttgatgtatatttgatctatctgatctcaagagggtggttagttgttgaggtggtggtcggagaccacgcaggaagaagaggcgaaggatcagctgacccgggctggagtgaatgtcttaagaattctgctgaatagatcctaatgatgttcctccacgagcttcccctgtgtttcgggcgtagatgtagacgtacgcgaggtcgttggagaggccgttttgggggtcgtttgcgagggtctttgcatgacgagcctttagatcagcaagcacgtggtcaggcgatctagtggttcctaatgatttgagatgccaaatgaatggtgacggcttccactgaagaacatgttttggataatagtgtagaatgttaggctgtttgtttctttagagtggctggggtgcgaggaagtgtgtgatctggattccgagataggtgtagttgatacgatgatgagtttaagtgatagtggtggaagggttgctacgatatagtaataattgcatagcatatagcttggctatgttggatttaggttggttagactggataagtagactgggcagtgtatagaaggatttattattgacatgggatgcttaagactgagatctaggtcttcagatttattaatatcatgggaagccagagaactatacagtacacacaatattcccattcttagtctgacacatgtctaccatcgactagcccgatatgattcaagattaagaggcttagccatagcataagccataaacagccttgcatacttagcacgatggaaataactgaacatcaccattcacttcacgtatatttcaggacgcttgtttctgccatcagctgaagggctctgttgatagttacaagggaacactcccctatatgcaaatgaatgcattttgctttggtttccaattccaaattcaatactaggaggtgcggtgcggagttaaaaaggcttactccactggtaaatcaagcatcacaaagttaatatcgtaaacccgagatgatagcgggcgctcttgctgatcgcggctttcggcccagacctgcccttggtgaaaccgggtcgaaggcgggtcagaacgtttagtgatcttcgttaggtggattcaatgatgttcagggcgaaatcccaaatattgagaatgtctcaaccctcatccgtagttattcagaggagtaggctcaacaacatgttcggcatgcagtctgacgagatatgcctggctgaccctctgtatctctcccaagattttctcaagcccacccatgggacgtagaacccgaatcgtctagctccagcaaagccaagctctgcagacacggcacagctgtgaagatgaggcacctaaaacagatcgccctacaattacgtcaattgctttacagtgcagcaacgacaagtgcacgatggtacacagcgtgccgcgtctcaccctgaaaatttcagactggtgttgagcattggcctcctggtcagatattagctgcatcgccacacctactttgctggtgatttcggtgtattccccctctcggactgctcccaatccgcatcggagaccgacaaatctgcatccaagtgcgtaatcgagcagcaaccttgctgcagctggccagtcagtgtcctggtaaatgtcagcggtgctctctgaaagccaatcaatatcggtgtattggcttaaccccgaggggctgctggagctttgcgccgagatctacacccgctgacaattacgcggcttgtgattggcccacaccaaggcagcctggaagggtctggagaacaatcagaaaaagtcgattctggctgccacaggaggagatttcttataaatatcagtgcttccagaagatttttcttctggctgaaaccgtcatccagatcaaattctcatattctatcaagcttctttctatcactcctggactttgtttgtctcgtccagcttcgctctctcgcgagaatccctcagccttaccggaattgttgagagggtctagattcggccaccgactcggcttctgacgtcaggcctgaggcagcccgcagcagcccagtcaatatacaatggcgctattatttctgaagcagaagctcttcccgagcgaaaagcaaaaacaggcccttccatatggtctgtccgcctgcaaatgaataacttcaaccgaactcgactgaccaaaacaggcaaaccactactttccaatgaagataccgataccctgccgagcgaacaagatctcgaagctcagcggtcttactctaccttccgcgcctcatctcccgtttccgacaccgacagcaccgccgccagcactagcagttcgcgatcacgtatcaacccgcgtattgtatcggatgccattctaggtttatccgatggcttgacggtacctttcgcgctgagcgctggtctctcggcgctgggtaacactaaggtcgttgtgcttggtggattggctgaattgacggcgggtgccatctccatgggcctgggaggatatgtcggtgcgaagagtgaagcgtaagttttccttttcaaataattcatccgttcaattctaacagcaaatagtgaatcgtacgagaccaccgttcgtgaggcaaaagaactcatcgacacatcgccagccgaaaccagttccattgtccaatccatcttcgcttcctaccgtctccccgaagatgtcatcaaccagattaacatgtccctccactcctctgaagaccgcctcctcgacttcctggtcagctttcatcacaaggaatccgagcctgactgcaaccaggcgtggatctccgccatcacactcgcccttggctacttcgtcggtggtttcatcccgctcatcccatacttcatcgtcgaccaggtgatagtggcattgtacatgagcatcggagtcatggcaatcacgcttctggccttcggatacatcaagacatgtgtagtgcgcggctggtccgggcgcgacaacgtcgtcgcaggcatcaagggaggaatacaaatgtgtttcgtgggcggagtcgcagctggagcagccattgccttggtccggttgatcgacaccggcggagcgtgatctcccaactgcaaaagttacccatcccatcatctcatgccataacgattgtacattattagataccaccaccaccaccacttcatagagcgagtctttgaaacccccaaaattctatactctaattcatatccaaaccaatccacaaaccaacaattatatatagtaaaaggaaaagaaacaagacctaagccccattcacagctctagtaaccaactcatgtggcctcccctccatcttcaaccccatcgccaactccttcccccgctccgacatcttcttcaacgtcttcgtcaaaatatccaccaccttgttatcatcataattttcttgaaacttctcgaactgatcatccaaaaataccaaacacgccacatcctccaaaatctgcgcctccgcatcctcaccccccttcaacccttcctttcgaatcaaccggcctacgcgctccgcctctgcctctccaatgccactctccagacacaccttcatcgctatctcagcctggcggcgcgccactgccgtccgccaggaatagtaccctattttaccatcggggtaagtcccccggggtacttcccagcgcttgagatgctgagcgcggatggcgagttggaggaccggggaggggttcggggtgtgtttgtacagatagctggtcattttctcggcgtagtgtagttcgtaggggatgttggtgtcggtgagtttattggggtcttcggagtgaagggcgtcgattttggtgagggcggttgttagggggtccatcatgaatttttttagggaattgaatcgggagggttgtgattgcggtgggtatatatatgtatatatagtatgtatataaagtatgtataagggaggtaaagaatggaattgtacaggggtaatgtgtagagaggcgacgtaggtgatgatttattgattcatggattccgacctcggggttgccgttcagtgcaccgcatcaaataccggttgcgggattggctggcgggtcggcatttgggtgggttcgattcttttctgtatgagggtggggggagtgctgataagcgataaggagtcaccccccacatggtaggttaggttttgggggtgtctaaaattgagttaataaggtgtatatgtggaagatatagggctttaggtgaggccgcggagatgtgccttatctctggggcacaataggcattgttctttgtgtaattatagcccgatgttctaaggttctgactgtctttcctaatttgaatatacgcataagtactggtagacatagtttcagtcgacaggattggaggtgatctttattcgcatagaaatgtataacgacctggctagagtccttgattctaagactgcgttagttcacatatgaaaaggtagattgaggttcttaagacgtcttgtagctcggtggtagattctccacatactattaagagtcgttcagaaagagtgtatgtgcagggggtctttctatcaatgtcatttaataaggctaagatatactttctgcaacatatagtgtctggtagcataccctctcggtctgtctgatgccagggttaagacctggggcactggcggtcaaggcatttctgctactaaatgggaacagtgccgatatctatagagtactatttttgtagaacagccccaacaaatcgagtaaatgtaagaatactatgctaaaaagcaggaccgttcgcacactggtatcgatgcttaatgtataggcgaagcatggagaagcttgtgcacatatatcatgattgtgttgagctgggccccgtagctaccacagcaaacctccatactacgtctacctctaccggtcatttgccatgtcatgcctatatctcacggctgcgatgcagtattgaaagaagttaagataggcacctacccctcccattgacaaagtaccgagacgaagagtcaagtcgacactgcaagtcgaaatgtcttccatcttttagtgcaagaatgcgggataggatcagcggccaaccctcatataatcatcttctatatatactgtgtactgcgtaattcacctttcatcttcatactaacagtgtctcggactctctatagctgcggggttaacgcatggtgggtctttaatatgtagtagagatgtggcaaagtccaataataacatcgttatcaagtcaaccccgcttccacgtaattgatccaacgcagatcttgatattattcaaagccgagtgaggatgctgcaagttcggcttccggaactcccgattgcagttcggaaatacggattgattctcaacttcaacacaatcggtacaacgagcggcagatatgacagaggtatcaacctcggcatcgaacatcacagacataaagtggagcttttgcagtaggaagatagagggcctataaacacccaattcagtatgatgcaactgctactgtgcggggtgtatcccactacggatatagcccatccagtagttactatatagtagacctagtacacacgatgaatgcatatcatgaattgcaagtccataaaacaccccagcataataaccacactcaatataccaccaccaattgaaaatgatccaaacccaccaccgcaccgccaccccgaaaggcctctcctccatcaccaccctcctcacgacccccggcgcatccctcctcatcgaccaccctttcctcctcgcagatgcccagtccaccatacactggataaaatccctaactccccacgcccccactgccatcttcctcacccaccaccacccagaccacttcttctccgcgaatcccattctggccgccttcccagacgccaaattctacgccgctccctacgtctgctcccgcatcaacgccgaatacgatcagaaagccaaatactggcccgcggtgctcggcaccgacgccgttcccgctgcgccccgcaagccggacccgtacttgtcgagcttcttcctgctggacgggtctcccgttgtgctgctgggtccggtgcagggcgattgtgtggatcagacggttttttgggtccccgagagtaggacggttgttgcgggtgatgtcgtgtttgggaggagtgtgcatgtttggtatgtttctcttatttcctgtctctttcttcagaaagttccccttcttggttaaactttcggaaagggaggcccaaattaagaccaattggctggcttatatctacaatatctacgcatacatctacttactgaattatactaatatacagggtcgaagaactcgaatcacccgctctcgtgcattcatggctcaaaaccctcgacatgatcgaccacctacacccgcagaagatcatcccaggtcatatggaagaaggatgggagttggatgtcaaggcggatctagaccacacgaggcgctatctacggttgtttgcggagaaagtcacctatgcgtctggcagtggtggtggcaaaccttctgtgcaagagctatatgataccttccgggaggcgttccctgagtgtcgggagaatctggaattctttttgggacatatggcgaatcggtttggccagggggaaaggtatgggaggagaatcggcatgaggatgtcggggagaggacttttgaggatttgaatgggtactggtttggctgaattccttttctccctttctattctcggcttgggttatagagggaggagttggtggaaggtatgtgtatgtatctactactactactactactactactactactactactactactactactaagcgagggggagtaaatacggggtaagggagggtgtctgggctgtgtcggtgtcaaggtgattgtagtggtttgcttctatgcctccagctcttatttagtatccacgatgggaactgaactacccacgtttaacgtagatgtcattcctatccatctagtattgtatcacacaagcatcgtcgatgctaagctagaattctgtactgtcacgcccaagcaatccgccgcacgtcaacagactcaaaaaaagaaatacatgctcttccagtggcgggcgatgtccatctggcacaagagagaagaaaagctcaaaagacggcatcggagtctgtcgagatagccagcaggaaacacagcgaataaaaaaattgtcattacaactccagctcccagtctgtctgggagcacaaagacagaaaagagtgcaggcaaagaaacaggcaaaaaccgtgccgcaacaaatcatagctcctccaacgccgtcccattgtgaaagccgggtatatccagcaccgtgatgcaaaatttgtacggagaattaacagatatggcgaggacatgactataggtcaaccgaatctgtccagcatttggcaatgccagatacagatccaacagagtctagccctcgccttcagaacaaggaccctatgcatgaagcaaagccaagaaggcagagaaaagaaacgaacaagccacaaagcttttcatcccatcaagtttccgtcccgttcgtttacctggccccgatcccaaacataccaaccccgtaacttccacctcggtcaggtagaggggtagatatcttcgaaacgtggtccttttcgaaaaataagcgaatgtgatcagtatgttagaatgccatttcaccgtccgaacgccctaccttcttccgttttttcttccccatgccttcactgtttgaataaaatgccccatcgtcatcatcgtctgcgtaaccttcgccgtaaccaacaaaactgttgtcgtcgtaatgccgtttacgtcccctgctgggtcgggatcgctcttggtctgaaacaggcgctggggttccattcggttggggaatccggactccgttgggagggggtgcgacgccctttttgctggcgtcgccaccggcgtgcttagatggcttctcgtgccccagcacgtcttcccaatactcattgttcggtaccgtgcccggctccatcttcatggccctcatctgcaagctgtgcagcgcagagtccatgtccgctaccttgatctccttcccgaacactttttggttttgccattcttcctctggccacatggtcatgtgcctgaggcttccgggcgcaccaggctcggtcttcactggcttgttcctgcctgcgagtcccaagcccttcagctttccttcataggatttcctgagcctgttgatcttctcgcctgtcacaggatccatccgagcaacagactttgccactggacctaatccgtacagtgagatgagatctagcgatggatccggtccagtcgcaatatgggctgcattttcataaagccacgtgtgttaacaaagctcaatccaaatataagatgggagagagtgcattgcaaattgtggcaacagccatgccaaggactggggagctcttacagcttttgcaaacatgaaaggcagacgaaaagttcttctgcaaggattccaagcttggctcactgcgactggatgaagccggcgcctcactatcgatatccatagcgtcgcctccgtggttcacagcaaaatcgcggactccaacttccatttttataccttctgtatgccggtcatgatctgtccgtctgtgttctgcctgctgtatggccgcggcattcatgttcgctgtttgcgcacctgtgtctggaactgtcgagcccattggcttatctgtattttcaggatcatcgaaggaagtcgcacccgggaagtgcccgctcacgctgctggccggcgtcggaaacgaattcgccgtacctaccgtcggttgttgcgaggcttgggtggacatcggagcagaggacgggggtgatgagagggttgcggattgagaggtcgcctggttaggtgatgcttgcgaggatacaaagttggtggcatagttctgagcgcttaccgacatcaacggaggtgatgtcggagtctgtggaattcgatcggataagggagctggtaactggttttgcttgagagtccctgcggcgggagatgatggtgatggaggtcctgctcgaaatgatgccgaggaggcgcgatcagacatcgaggacggagtgcagggtgaaggaagaggaggttggcctaagcctgggcagcccgagcctcgcgaaagggagacctgaatcgaagatctccaacacagcagcagatcacagcagattcagactagtatgaagacgaggagatggggggaaacgccggtcgaggtgcgctcaagcgggcgagcaggacgttccacgaccgtctcaaaagtcacacattccaatgagccgacacagcactgaagtgaaatatcgagcagcaccagatagtgaagaaaagaccagcgaaagagtgaagggcgtggtctgtgggttaagtcgaaagccggcggggtgggtaggagttcgagaaagcgctgggatgggaaacccttggtccgcaactggaggagaaacggacggcgagatgttggatgacggcaagagccccgggctgggcacgtgacgcgccctcatttcttcgattttccctctttcggcctccgcgcccgtatttcggtatcaatacacgtgaacaataccgatactcgggcgtatcgtcgggtaaattacggagtatgcatcggtaacggatattccctctttttctccttcactctttctgtctctctggacaaggtacttcctgcttatcgtgttcaccccgttgaccatcgcaggtttggtcatctagacattacttcccgtggttgtgatctatgtatgccacgacacgcatgggcacgaagcgctttactagcggctctcacgccccctgttgggcgcttgtctaaacctggagggaatagcccctcggaaagtatcacctggggttattgcatagtttcttccggagatttccttgcttctagacctagagctagatagacttgtcccatctatagaatttgcagttggcttgttggggaagtgatgcattctctcggacccctaagccatgtcaaacacccaaagacattgaattaagctcatactcttctaccaaaaccatcgattgaacccataaatcccgaacctagtgatcggaaccgactcgctccaaacacccagatgaacctcattaacttcccagcacgatgacccttgggtatattgagatccatgaatccaaaataattatggtaacacaataaaaagaagcacaccaaaatagagacaacaatggcccatgcaataaaaaagctcaacaaacacgctgatttgaccgaatcaaagagagcgaagcgccctcgtagaaaactttcaaacgaccaacatgtcacgattggtagaatgtcgcagattcttgcactaataactgcgccgaaacgtcaggaatgttgtcttctaacgtttccatcagctccatctgctcttgatggctgagcgttcttcctcgccacgggggcattgggtaagcgccgttggtgtattgggaatattgatctcctatcgtctcgatccagttcatgggatcgactgtcgcatcgacataggctagatggctagccgtggtggaggctagattgaaattgggatcccagcctggcaagccaggaacgacggatggaaatgggttgtatggagttgtcgggtcgaacgataagtctgcgtaggaaggtgtcggtacattgtaggattggggggaactatacgagggttgtgtggtggttgatatggattgcggagtaagttgagcatcccaggatggatgctgcgcggccttcaatgattcagtggcaataggtgatgagattgacccttgggagaaagagaatgaggggtctgcagaaggcccccttgaaaacgtgccacccgatgcgctactaccaggaacagaagaattcgctgcacgagctccatgtgagtgaaacgatgctgacgtacttgcagggctagagacggatagcggtgtcgtgacatcctgcgaagacgacggagttgcatgattggaaggcgaatggacgacgaaggaatcttcggtagcatatgcgcgaaggcaagcagcaactaggctcctataaagtaccagggccgattcgacaccgggccatctctgtgcagcaagaacgatagcctccagtgccacgccaaggtggcctttgacttcgtcaatagggtgctccttgcgaatatcgggataagagagagaccaaaggatagtgttcaaggccataaaaagtgactgggtgaaaatccatgtcaagtcaacagatcccgttgcgatttgttctctctgcattgctacgttgaacacagacgcatcatagcattttcgcgcagcatcaacagaaggctccggcacttggggagaaggccggaacatgaagacaatcatcgtgtttcgtcttccatgaaacctatgaaaagccacatacagataagcaccctgaaacagagctagttaggtcatcgtccttaccatttttcgctcaagccactacccccatcattcttggggcatgaagctacccagtaatcgatcttctgaagcatttgtgaaaaccatgggtcttggtcatcgactggtacatcgcgtttattcaggtagagcgtgcgtcgaatttctgcttggaggagccgcatcttcaggaagtgaatagctatgcacttcggtaggattattttcgctcctggtaggaagccatcccgagtgataaatttgtcctccactggctcaaagaacttgacgttgatgtgatcgtgacaaacggagtaacaatttggacgaccaagactatgggaaagaccgtactccatggatataacaatccagaaaagtcttcttcgcatatcaatctctaaagggtccaatgtttgcccgctgggagattgggtaatagtcgcttcatcggtaagccctaggtcttgacatagcttgactgccattcccaccacccagtatgctgctgtcctcgttggcgtgagcattgagtattgagcaatcagggcaaggcattgcaaagatcggaggtccattcgttttaacgacggttccaagaatggcagcgctgcaagataataactatccgccaagcctgcatagacggtgctcatcttttgcatgctgatggctatgaccatgcgtaattggaaattatggcagggatcatcagacccgttgagcacctcttcggcttcttcgcgaaaggtaggctcatgcaatgtcggaagcattgcctgggctaaacggcaagtcaaccatgagtgtacagctgtataggataggatgcggacgtacccttgactacaaagacatcaataagtctgtacgtcatgtgttttggcggtaaagtaggctgtggcgtcgaactgatcatggggtacacctttgatgttggctttgagctctcttgtgcaaaggcatcttttatctcctgcgccgtcatttcagggacaacatcttttatgcttttggaatctgtgttctgtttggccatttccatgacgaggcgcgtgattgcaataccgctggatggtcccaaatatctcgactcgtcattctccttgaagcgaatgcggcctgccccgcgcaccatgagctccgcgtccgctgcatgttgaaactctctctcgacttcagcaagctcactctctaattggcgagctctttctcggagtaagacaatatagttccttgatatcgtgcttttacgcgccgaatcgtaatagacacacttggcgttgctgcgttcgcatggcgagcatcgagggataccgggatcacacctagatttacgctgtataaaaattaggatcactttctcgagccgccgaggaacaagttaagagtacatcgtaacagaacacggattcacgaataaacaaggacagcgatagagtaagagtaactacgtacctgtctgcaccgcgtacaagcagtcaaagtgtgcgcgatgcggctatcaggggtataatcagatggttctgagatttttgatggagagtctgaccaggggttggtgaattgtgggcgggagcttgaagagtttaaatgtgtggccattgtggtatgtcgtgcaggagcacccctatattaggttgaccgaaggtttgtaggtttagccggaggaatcatcaacgttgcattctatgtatcgcattcagccttgaaaattccagagctttggggaggtctgatccgagcgtcaggcacacgcgactgtggaagtttgaaggggcacttgagaaacgagcacgttcgacatgttcggggttcgctctgacatgcaccagctgctaggagtagacgggcaataactgtacagatctaggggggttgtacaggttgaaaagctcagctagcacctaacatgaactccgactcaaggtacccattcagacattggaaagaaacacaagatatgcagttgcgaatttggaatggggcgcaaaggagggggtgaggtggaaactgaagtgaagcaggcctcggtccacctcccgcctggatcgacggcacgctaaagagcgccccgatgaccgacgtcgcacttaccaggactacggacacccacagctgccgcttgtgaagactggcctcgaaattgacgggtgggacatccaacgcggtgggcccccctccgtaccggacaaatttcatggaatgggcttcgcggtccgatcagtcaggctattcgaatttccgggtgggcatgaaaagaaagagagcttacagtaggtcggagctttcaggaacacgaggatactactacatatactggtgacctagcacacatgaaactatgcataacctttctcggagatctgcggtggcggatgatctagtctcaattactgggattacctcaataataactattactgagaagggggcagtagattcaccactcagtactactgctagtagtttcacacactgctttcatctttgaaattaactccatgaaaggaggtagcactgtatgagcctcgaagtcattaaactggaagagccgcgcttttcaagggcgcacaaaacggacagtgcggatgaggtactaaactacgtactatcacgctcgagataagcctcacatcgattggttgcctgctttggtcgtacatggcatcgatactacgtactatgacataagttcctgctctgtgtcagtcaaaatctcacagcaacgtactgaagtacactagtaagcccttgctaagtctactcgtcaacactctctgcataactagtagctttgattgaaggtgtagttcggatcagagccgacaagtccttgccaacaaatcatggggagcctcaggagataatccgcgggattaagttccagagagcctagccctctctagagatatagatagccgggaaaaataacgtgccatggatgcagagtcgcgaaaatgaaggaagagacgaagaggatctcagtgccatggtcggaaccagtttgttggttcatctgatccaagcttcggaaagctatcccaaaagggtatatgggtaagcacgggcgggtgtctgcaaatgcctctaatgaattaggacctctgctagttatggattggtggtgatcaactagtcattccctagtgaatagttaagtattgtcttgaataagtccttgaatgaggacctcgaagacttacaacctcgtaataagagcagccatatcatggagtgctctacaggacgacaaatatgataatagtaatactgcctagtctttcaggaccgacacccgactctgttggaagattgactggcctacggtgtacaacgttgataagtggacaaaagagggtgtaaaactagtagtttagcgccccgagcaacaaaatttgatgcaaggcttttggttgcataattccagccactgcgacatcggcaggtattgctacagacagatatcctgttgcgacgcattttaacactgacgagctcatacgatctgaactacttatccccttcacgaactctgggacgtcggtgtcgacattctttttaccccttggtcaatcagcacctttcttggggggaggaagggggaaggggaagagtgggcactacctacagtaaatactcggaatgctgattcctgttctggaccggccaagtgccgggtgttgcagcatgaagatcactaatacggacaccgtactagcaccggctgaccgaagctttttcgctagattatgcataacacttcaagcgggcgccccaagtaaaatgtagtttataggctgatataacggatggaagagatagacataaaatgagcacaaggctgaatttctggttcgacaagctcactctcatgtcgactcgtttcatgagagtcgcgtagggggaggatttcagcccccattgcgcgtgggggaaggaggggtccacttggggggcaatgaaaggaggggcgtgagcaggagccagccttgagccagccttgaccgggaaatgtttgtgtggcacccaatgacagtagccgcccacaagcaaaaccgttcgagcccagatgtcggtggtggtgctggtggtgctggtgcccgggcgggtggttaccttacaaatgttttgataagaaaggactaccaacccctcctctcccattcaccattcaatcttcaaccacatgtagttcaatttgtcgacaatattgcggctctatcgactgctagtacagactagaatacccagaagtccttcctcttcgacagcgcgatcagtgaacaacgagaacgaaagctaataggggaaggctcgccaaacagttaggtactttctttttgcttgactctagtacttactaggtatacggggctgacgggtacggtacgaacccccctgcttttgcactagctcgtgaccctaattgcgtaccagagcttgcggtacttgccttttcctcccttccaccctctacgactggctcatttgcttccagtccagacttagtagcaccactactatttcctgggattttgatacccctcgctaaacggtgatttgtctcttcccttttcttttcagtggtttttcttctgttccgaccattatacccacaacggttgtactgcttggggaactttaaccccccgtcagccctctctgtgtcggggcagttgaacccctctcgctactttgcccgttcagccagcctccccccgccaggtttcgggctaaattgatagcgctagtgcctggtgagtaatctgcctcttgagttctagtccttaaagccatatacatacctaggcaggggcagaaaccaaatatccagaaataaggaaacatggcgttagaacttctgctttccccaactaccctgccaacgtttatttgattagatgactacgatacgtgcgacggaaccaatgcgaggaactctcattgatatcactgagtgccttcctgcatgctaatagatcctgaacagaaccacgtcttgagtctctctttctacaaatacacttgcgcttctcgtcccctctcctttctttcgagggtaagtgcctatcacgacctgtccgtctgaagctgtcatgagtttaacagggtggtcgacagggcaagacgcaagcttataactagcatatcttctactcaatagcgttccatctctagtacaacatagagattatgtataattagcatgtcggctacttcatttctggacaaaccactcctcaaagtcagtcgaccagtggctgcttgctcaagatgccgaacagccaaaatcaaatgtgacgggaagcttccggcctgctccgcgtgcgaaagggtcggaaaagcgagcacctgctccggcgcaagtgacgaattcgccagaggaaaggaaagaagctatgtcgcctctttggaaggttactgcgaacgactcaaaacgaagattgacgatcttcgccgcctcaaaacatcattatctgtggacgaaaggggtgtcgcccatcaaagctcgatcacctccatctcctcggcaggtactgttgcacaggaaggtggcaaagaagtgactgacatcgatgacctcgttggtgattttggcttcttgtaagttctcgctgaaattagcacgatgttcctcggactgacaccaatcaggtccgtcaatgcgacttcgagagacttccatgggattacttcgaatacgtctttcgccaatcttcttctgtccctgtctcaagctgagtcgataccaagaacgacggcgcagtcaataccgccacgccatgagataatgcccgtgctacaacactatttcgacaacatctacatacagcttccatttttcgccgaaacgagcttctggacatctgtggatgcggtctaccaagctggggggcgctttgccaagccctttgacaagtggattgtgcatatggtcttagccactgcgtctgcgtctatctccctcgagatcggtgatagaagtcatcacagagcgttgtctcatgtttcaatggcaatgaatcaagccgaggacgtcgtccgtcccggtactatagccggtatccagtcaatcctcctgcttgcccaatattccttattcgacccgcaacactttcgcagctggtacttagtagggatggctgtcagggtaatggtcgatctaggcctacaccaggacccgcctttggatgttcagtcagcctcggtgcagctggacctgcgccgccgtgttttccattgtgtctattgcttggacaggtgtgttaaacttctttttgtcccggacacatacttgctacttgatacttgagctaacgaaagaaactccatttcacttttaaagaggaataagcactgcctttgaaagaaccttctcgttctcagacgattccgtcgatgttgctttgccgtcttctgccacgtccctaggggcttcgctaaccgaaaagagccatatatttttacgaagctcggagcctgcgtggcacatcgtcagaattcgccaaatactgtcggagggttaccagagaagatattttcatgaacacgagacttctcttcaagctccggcctcgacgtgggctctctgctcaaaagcatacgagtggtttgataaaatcccgagtaatataccaaaccacttccccatcctgtaccgattggagctatcatacacgatagtcgtgattctctctgctggcgacgaacagaccacactatgtgattacagcaagattgttctgttccattgctgcatgcggtacatcaaagaactctatgaggtgctgaagaaccctgcctggctgcctttgatgaccttcctggatattcagaggacgtatcaagttggccgacgattcatacgagatgtgacagaaaaccaggaccttctgttgaacccgtcgatacccgcattgccctcaattcctccggagaccccggaacagctgattttgaatggtgaggattgtatgagcttccacgcgcgcgcctcggaatgtctttctcagatcaacaatctcctccaatatggtgcaagcaagtggggagcgaccagcatacttggagacttccagcaaatgtgcgagcccgcccggagccgtctattacatgcatcgaatccatatctggcaggttctggggcctatatggctggctacgcttcattggtgcctgcaggaacaggatacctaggctttgacattggatgatctagccctcggcgagggccaaggcaagggatgcctgcttcatgaatcttcaataatgccttagttcatgcccctgtgttgtggtaatattgtatatgtttttttttttttttttttttttttttctggttgcacatgttatatgtgagcgatgtgaagttggataacgataatactcggagaaaaagtgtccttatcttgatgtgtatcgtatcttgatttcctttcttcttcttttcttactctgtggaatgcctccagagattgcatgtatttgaatgacagtcgtgagcagggagaattcctgggcaggtcctacgagagagtctcccggttgcggctaatgctgcaagggctgcgagcagccacaccagaaggccgatcgcgtcgggccatgtgggctagcatctctccattttctctctccccccccccaaaaccgatgagcattcgagaaactgcacgggaacatcaatcctccgtactcggtaaatgtaggtcgggatttgaacctgaacgtaagcgatgctggtgccttttagtgatctaccggccaatcgttggccaagagtgtggctggtcaagatcggagccagttgaccgcaccataagcttggggtagtacaactagctagttcgtcacaatatactccgcaatggagaggaaaggaaagactacatgggctgaaagacacgcgtcaagtacacgcttgacatactgaacttctcgagcctccttggaaacccgtcccttttcccatggaaacctgtccccaatatagcaccaggcaccgcactcataccgtagcagcgagtgagtacagagatacataagtagagtgcccaattgaagggcagagaaagagagagagagagagagaagcgagactaaactcgtgacgtcacagtgatgcgtcgcggatggtcaagcaatcgactttttgcactgcatgatacagtaataattttcctacgaagtccagtgtagtagcagcagtatttacttttactagggaaatactagtcctttgcactaagtcgcaatggagggtggacaattacccacagtcaccccataaggcagaagaagcttaagcttgcttttttcctcaaggcccgccgatgagtaaaagtatttccgctttgctttgaacgaaagattttccttctgatatcaggcccacggacgggatccgctttctttcttgtgtcttttatgaattggatttcgggtctgccgcttctgtccaaatctactgttgatgggattgaattgttgcgcgcccgtaaaagtcaagctgccagcaccccagggatgggatgaggttgtccgagaactgcatctgttacacacctgagccggagcctagtcctacctatctatagcactaagttactgggctctcctgacgtggatggatcacatgttccggtcgatcgtttccatggctctcgagtctcaatgctccttctctcgcgtgcatgcaaacactctagtactgttgagtgaatccattagctaagacaccagctggcccagctcgacgactcgccagaagggctaaagtagggagtcgtagggatgatccgcgcaacatccaggctcgtagcgccgatcctgagtggatggcgggccagatcttgagctggcgcgtccgcccttgacttcatcgctctcggcgcgatgatgatctcatcgtcgtacaaactcaatcctccttctttcccctccccccctaaaccaccctatgccgtgtatctcgacgaaatctcttttttttccctccaggaaccagacacaaacccggaacttcacctttgcctgttctgctcgtcaccacgacaccatgacgtcaagcaggtgcgctggcccaaactggcaggcaccaccgcgccattacgctcctgccctttcgctgcatgcggcagttgtatttaaatccgtagagaacttcgtagtagttccttccttccctcgatccacttgtcgttttgattgataccacaatttctttcggcgtacattcttcccccttcctactacaactactacacttacgctgtcaacctaataccccatccgtcctcggcgtccttcattccggagatacccagcgacgcgcttttttttctatcccttgtttgcagccccaagagaagatcagccttgtcgtctgcttatcgtcgtgccgtgcactttatcttaccttgtttaatctctgttcggtctatcttccttgccagatacctaaccccggatcttggccagacgcccgaatctgctggccagtggtcccccttgcgactgcatactgcttactttcccacatacatacatttaaaaaaacaagaaaaagtttcttgcttggctttcgagcctctgtagacgtcaattcttgccagtcaatctggtaatcctgccgcaatgtcgtccaaagcagtcaaccatccgctgaacaccaagcagaaggaacaggtatttcatcaacctagtctcctcaaaagctggacgcagagcctctaacccgaatatcgctccaggatatcaaccagaagctgcagctttatggaatctatcaaggtaaattcaacacaagtcatcatgttccagcgtatttgtgctaatgggccatgtagccttcaaaaatggcaagcttccatcggtgagtgaagtgattcaaccatcaatcgtgttgcatactaacgtgaaatcaattatcatagaacaaacaatgcgacgttgctctgaacagtgctctcaaatccaaggccctctcgtcgccgtcccaggagctgtctggtgaaggccaggccctcgtgcaggatcttcggaacgttatcgaacatgttaagaagcttatgctgagcaagaatgagggtcagctcttgcaggaattcctgtgggaggcacagactgtttcttcgggtgatacagagaagccaggtctgcctgtgacgagggatgcggcccaacaagacggccaagaagccttggagggtctcaagacccttggaagactcctgatcacgaatggtgaattcagaaagctatgtaagttgaccgccatctgggcagggaaccccaaaactgacattagtgtctagtaaacgatgctatgacgcttgcgcgtgatatggctggtgacgtctctcagaaggccgcaaacaggctgagaccatcggaggaacaactttcccagattgatgagccagctgaagagaacgtgtggcacgagcagcctgatttctccaagcacaaggaaacattcaaatcccgcttcaagagaaacaaagacgtgagtttttctgagccgatagtgctataccaagtgacttacatatggacaggagggtaagcaggaagtcgctggtactgcagcacaggctgccaccggtggccaagagccttcatcagtctccgatgtcgacgcgcgcgctggtgttgctgcaggtgcaggaagagcccaggagaagatttcggagaatgtccctgaagaggcaaagagccgtactcgtgaatacaaggacaggaccaagagctacttgtcagaaaaggtgccccaagagcgacgggatcagacgatttggcgcttgaagaagatggtcattgagattcaaggccattctgattgtaagttatcagccaacgatatgcacccatagacggtcgactgactgcgaaacagaccaacaggcgatccgaacccttctttcgatggctgaaaagtatggttcccatggacggaacttgtctcagcagggcgccggttcagtccagggcttccgaagcggcgataagatccagagaatggaggccaatcttcgggtacgtctgtcaattttgtcggataagcagtgactaaccccttctgaccagactttgattgaacgttttgccaaccacacgtccctggataatctattcgactctctggacaacatctaccgagatgcagacagggaccctgagctgaaaggatggttcagaaacatggacaccttcatccggtgagtatgaaagttcttacgggacctaggcggtgtactaatcatttcacaggaaaaccctaacagagcaaggctatattatggatgatgattgcaatcgccagtgggaccaactcactgatcatggccgttacctcctgcgtgagcgctacagggatcataccgatcgaattcttgatgagctcaagttccttggcgatcagttcaaccaggaccctcagaacaaggcgtttggggatgcgatgcagaagctcttcgatgaccttggacgcgacaacagcggcaatatggccttcaagaagcatctcgtcagggacattcgggatgttattctaccagaggttcttgaaaatgtccgctatgtccccgttcctcgtatcgaagtgtctgatcccgcggccgatgttgtaagtatacctgagttgtcctttgctgagtttcgtggctaactattcaaggttgtggaaaacctcgtgattgagagcgataatttgatgccgaatgtcgtggaatttggcagcgacaactacttccgatggggacgcaagaagatcagcagcaagagggacaacaaggttagtttatttcctgtagtgatcatttcaagtgaataatgctgacgatatgcctgaagattatgatttcggtgtctggaatccaagccgatctccgaggtaagtgaaatgcccttaaggtcatcgttcgatctgcatcgtttactgacactacctctccagatgtgagctactatatcaacaggaagcaaggattccctgctatcacggacactggtatcatggatatcttcttgggtggcgaaggcttcggtttcaagattgcagcctcgactgcccaaaaagaagaccggcagaacttcatcaaattggacaaggtgactgtcaagattgactctctcaacgtcaaattgaagaagtcgaagcacaagactctattcacgattttcaagccattgttgttccgagttgtccgtccaaccctggaaaaggtactcgagcagcagatccgggacgcttttgccaagggagatgcctttgcctacgaaatccacagtgaggcgaagaaggcacaggaagctagtagccaggatcccgcaaacgcgcccaacatctactcccgctatctcgatgccttccgtgccagaaatgaggacaagaagcgaaaggcacaggaaattgccaaacgagacactaaggtgcagacggctacaactctgcatgattccctcttccccgagatcaagcttcctggcggcatcagtactaaggccactgagtacaaggaactcgcgatgaagggtgaacgctgggaatctcccatcttcagcattggcagcgcctcagagtcttctgatattcccaaggcgggcgacatttctcgcaaacgggaatcccctgccgaaaagggtggtgttgatggagtaactaatggcggggccacaaacggcagagttacgaacgttaatcagacaactggaggagtcactaatgggactaccgctatcacccagaatgaaaaagtgaccaacggaggtgcacagcccatggatggtcgagtgaccaatggcaagcacgctgtttccgggaccaatggacacaccaatggacatactaatggacattccaagacatatgaccatgcagctgcgtcccagaaattctccgatgaagtcagccaagcgttcagtgatggaaacgttggcggaggtgctcgcaccacagtcccaggcgtcgaaactgccttcaacccccagactgcgtaggtcaatcgcgtggagggatcatagggttcagcaatgctcatacacgctagccaagtatcgcttttgttattgatttatcctgcctgtactgtttttgataccttgtgacgttgtcgacttgaccatttcatttgttatacgaacttaatgctttacttatcagcataagtgtgttagtagttaatgattaattcattgtgatatcctgcgatatgtctgggcaataataagaacagctgcgatagaaagctgtatattttataagacatcagtaatagcctggctcattacagtgaaacagacaagcatgaggcattaaattcaggaaaccaaaatcattacccctcgtatttgaaacttgcttctagactctatatactttcaacatttttaacttgacccattcaatcataacatccattacatttgctcaaaatacttctcccaaccgagctcgcgcagcttagtacccttcagctccatgttctcagcccgagcgctctccgcataagcctcaaccttgcgctggatagccggatcgaaagcaccgaggatacgagcagccaggagggcagcattgatgctgttgttgatgccgacggtggcgacaggtacacctgtaaaacatgttgtcagctcggatgtaacgtaacccggtatatgatatgcaggaaatgatgtgtgtgactgtcatcctacgtgcatgtatgcatgcatgcagcaacagtgcatgtgaaggaagacggaaacaggatctaggtgatgaacaaggaagaaaagaatatggagaagactcacccctaggcatctgcacaatgctgtacaaactatcaactccatccaaagagctacccttaactgggacaccgatcacgggcagcgcggtatgagcagccgacataccggggaggtgagcagcacctcctgcggcagcaatgatgaccttgatgccacgggccgcggcattggcagagtactcggccatgtaggtgggtgtgcgatgagcggaggtgatttccacgtcgggctcaacgccgaagtagtcccgcaggagcttgagaccgggaaccagggtcttgaggtcactgtcggagcccatgatgaccgcaacggaaggggcgggcttggagacgccggacttttggggcttggagcggacgtcgctgcgctgggagcggatttcgtcgacgacgtcgatgaggggctggatgtgggattcggcttcgtgcatggtcggggcggtgacggtgacgtggcccatcttgcggccgggtttggcggcgcccttgctgtagaggtggatgctggcgttagggatggagagggcgctttcggcagccttgaggtgggtgtctggggcggagccaccgatgatgttcagcatgatggagggttggcggatttcgaggctctgaggggggatggggaggtcgaggatggcgcggatgtgggcttcgaattgagacatggggcagccttcgatggtgtagtgaccggagttgtggatacggctggcgatctcgcagaggagaaggctgtcgtcttccaggaggaacatctccacgccgaagacacccttgccttcgaaggcggagacggctttccgggcgagttcttgcgctttgcggttgatggcatcggagacgttgcgggcgggggcgtagacgagcttgcagatggagtcttcttggacggtttcaacggtggggtaggagaggacttcgtccttggtcttcacgaccatcacggcgagttcctggggtatgggtgttagatggtgatgtgggtcatttggcgtggagggtggaggggtatataccatcttgaagtaggcccatttctcggcatacagaggacgacccttgaggaactcaagggcttcgggaatatcgtgagcaccgcgcacatggaagtttcctggtgattgagggactaagttagtggtggttgctggtggatagtaaagaacagcaattggcgcaacaccggtgactcaccacgtccatcgtaggccatggtcttcgacttcagcatcaaggggtagccaagctcctcgccaaccttggccaatgcctcgggggtattctcagcgagctcgcggtgctcagccatggggatgccatatttgcggagatgttccttctggttgtacttgttctggatggtgcggatggcctgccaactgggctcgatgcggacctgggaggcgatctcctccagggcataggtatcgacgtgctcaatctcggcggtcacgacgtcgcagttcttcgccaattcgcggacggcttcgcgctccttgaaggagccggtgacatggtcatcgtgggagctaatctgcttagccggggagttctccgcatcaaggacgttgcactggatgttgaggcggttggccgattcgaccagcatacggcccaattggcctccaccgaggattcccaccttgcgggagttccacatattgatttaagggaatataggaaaagagggaggaaaaacagagatggacaggcaccagctcgcaccaagcagagggggaaagatctggggaagagaaaagcagcccctccacggcggagcaaaaaatccgcccgataaccatcacgtgcgccagtgataagcggctggcgggcccaatcagagcctgcggttgccgggggagccgccgtccccgcgtgtccagatcgagccatgtcaattccgcccgtcatttgctgctctccctctgcatttatcccctgtggccttgtcgcatctcacttcgctgggcgcagaagtgctggatcatgtcgctgggtatgtttgaatctatagccaatgccggaacctaactgcaatgttgctttcgtccatcttgtgacctgcgctctttgctttgattcataatgagcttgtcaggcacaacttcaagctccattcagctaacccatcatgcgatcgtagacgaagaaagcctccagacagtcgccaatggcggcacgatggactagtatgtcaactcgcgccccaaccaagcacctgcagtacaatctgagctgacattctccgtttcctccagtgagaaatggcccagcatggtcgaacccctgctaggacgattggaatatgtgcgcaaatcccgtaccacccacgaaaccaatcaccgactaatgcacctcgcgtccagatcatatacaacgtcttcccaatgccgcggattcctcccgaccttcatgaacagtctgctaatcccaccgtccccacaaccacaccatccacgactctccagacctccacacagcccgagccatcatctcagcaatcctccgcaactgagcgtatcgacacccaagccccgtcctcgcaaggctcctctcttcccgaacccctccaacaccacctaaactccatcaaatccaccttgcgatccctcttcgcctcaaaacccccacacactatccaacgtctcgcagaactaatcgtccgccccactgcccactaccgcactcttcccgcatatcttcgcgccgtcgaccgcgtcgtctgcgtcaccagcagcgcggaaatcttccccctccactcgacacatcatggcgctgctccccagcccaacggcgcggtcatcaacggcgccgataccggcctcttgttcccggaccatgcgctcggtagcgatgagtctctaggcggagctcttctcactccgataccgtggttgagtaatgatccctcatcgccagaacacgaaggggaaagcggtacacttatgggggatactgggttccctacccagggggtggagcatactggcgctgagcaaggagatcaacagatgggatctgttcctactgcggagacgatgacggtggtgacatcagacacaaatggaaacgaaggcacgggtgaagctccgccggctgaagcactggaggatattccgcatgcaagaggtccctctgtagtcggggtggaggatctagggttacaagacggtaggggtgtggagatggatctctcgagtggaggggagggggcgccggaactgcaggcttctggacaggagaattctcagccgcagcaggagcaagagcaagggaaccagcagcagcaggctactggccaggatggagaacaaggtgctaagtcgacagcagatggagatggagatatttctctagatgatgtcaaagctccggaggagaacgcttccgtaactgaaacggcgaataaagatcagcagcaagcgtagcttttgggacgtcgcatgatatgatattcataatctattagcgtgtcgtgctttgtcttgtcgcgcattacgtttcttcttggactctctctctctgtctgcctgccagctagcttacattgttaaatcatgattgatgacttgactttgactatcgttgtcatgaaccgtgttcccttggcgttatctatcaattactacttactacaactaacagtgagcaagcatgcataaatactcaagtgcgcgactgtgattcatcatccgaacttgatccagttgattttcatatactgtgcagcgcaattataaacacggcacatcacaatccatcgtcaacaaaacccagtcaacagatttagatagaacgcatatagtcgtcattagggggtcataacatccaaacaccaatcatgccaatatagacagatatatagtaactccaatagatagatcaaccattataaaaaccgaaagataaatgaaatagacagtatagatcatacaggcggctccaccgtctgaagaggaacatagagcccctcatcggcattcgagcctcttctcttcctacccgtcatgaacgaccaagtatcagagacgaattcccggacccaggaggacgaggacgagcgtctgtgagaactagatccagttactgatagcgtggcctcccaccagctcttcttggaggcattgaagctgccgtcggatgacaactcgatatccttttgtagcttctcggcatccatccagcccggtctctgccaaaatttgaggagcaggctgctcacgacgacggagacgctggatagagccattgcggcgccggcggccatcgggggtagcatgaaaccgaatgggaggaagagacccattgcgaaagggagaccgatgacattgtatagacaggcccacatgaggttgagcttgatgcggttgaagaccgagcgggagagagacagacttgcgggtacggagaggaggtcgtcgggccgcatcagaacgatgtctgctgcttcgacggccacgtcggtgcctgaggctagggcgatacctacggatgcagtggcgagggcgggagagtcgttgatgccgtcgccgaccatggcgactcggtcgccggagtcttgcattgaggcgacgatggattgtttgtcggagggggagacagaggcgtggactgcctctgttgggatccccactgcagaggcgatggatacagcggtggcatgggcatctcctgtgataagggaggttgtgatccccatacggtgtagggcggcgacggctgctggtgcggtcaccttcacggtgtcccgaagcaagatggatcctgcgtattggccatcgatggcgacgtgaatttgggttatgccggcagggaccttagacttgggggcgatgtcggagtcgtctgattcagctgtttcagggacgaggacgtcccttgatcgcaggaaagcaaggtttccaaccaggacacggtaccggatgcgctctgcactggacgtgggctcgactaaggcggagatacccttgccgacgcaagcttcaaggtcacccaagctgccgggcaacccgccctctcctggatggccggattcggactgagcagccgagaaaatggctctgccgatggggtgttcgctgctcatttctgcaagaccaacgatcagccaccagagtctgcggcgccagtcgtttgacgtccaatgtggttcaattttagcttcagcaacgctcattttacccgtggtcaaggttccggtcttatcaaacacgacgtggttgatctttgtagcagcttcgaggacagcgccacccttgacaagaataccctgttgggcacccacgccggtgccgaccatgacagctgtaggggtgctaagaccgagagcacatggacaggcgaagacaatgaccgagatgcaaagtttgagacagaccatgaatttgcctccgttgttttcagacaagaagatcttcggagggtgaggtaggatatgactcatgaacatccagccgaagaatgtgacaagaccaagactgatgatagctggaacaaagtagcctgcaacaacatcggccatccgttggatcggagcccggctagtttgagcatcttgaaccaatttgacaatctggctcagctgagtgtccttgccagctcgagtaaccttgaagtccatagaactagtgccgttgaccgtaccagcgatgacaacactacccttggccttgtggatcggcatagcttcaccagtgatcatactctcatcgacatagctctcgccacgaatgataatgccatcagccgaaaccttatcaccggggtgaaggagcacaacatcccctacttcaatgagctccgttgggatgagtttgtgccctggccctgcgcgctcctcggtggtcgaggatgagtgctcctttggcttttcgttaggatttccccattcttcggcgagcttctccgccgctatcggatcgtcgtaaatggtggtcatggacggtgcaagagacatgagccgggagagagcagcagaggtttggcccttggcccggttctccagccatcttccgagagtaataaaggttataagcatcgtgcttgtatcgaagactgtacttggccggatatcattatccgacaaaagagaaacaaccatggtaaacacgctgtagaaaaatgcagcagaggtaccaagcataacgaggacatccatggttggtgagcgatgtttcaaagacttgtaactggctacgtagaacctctttccaatgccaaattgtaccgggatagtgagcagaagacaggcgacatcgccaaggtagagaccggaacatagtcgaacacggccaaaatcaagaaccggaagatacatcggcagtaacatattgatcaagaagacggggactgcaaatgaagcagaaaataggaatgagcgcttccattcccggacctccttagttttggacagcgactccagctgtgcgttggtatcatcggactgcgacaagagggcattgtatccggccttttcgatcagttcgacgatcgaacgaataccaatcttcgaggattcgtacgacaatgtgatttgagagttggccatttttacagacgccgatgaaatcccgggattctgcagcagagtgtcttccaaggccgaggccgaggctgcgtcgcgcaagccgtggaggctgagagtgacacggctgaggcctctggacatgggcgcctgtgcttccgatgaaaggacggtagtatcgaacccggcatcgtcgattatgctgactatttgtttcgaggtgagtgtagtagggtcgtgggtgataatcgcacgctcggctagcaagctgatgttgaattgcactacaccgtccaccccgctgaaggcattctgtatactcgacgtacaggcaccacatgtcataccatctatagacacagtcgtgaccatcagccccgatgtagagcctggcaagtcctccgaggtgcggacagcgctctcctccgttgaggtttccagcacctttgcgccaaacccgcggtcctcgataatctctgcaatctggtcgggcgcaacgagagacggatcatgctccacgactgctcgttcggaaagcaaagacacattaactgaatgcacaccaggtgtatccttcaatcctccctccaccgcggaggtgcaagcaccgcatgtcatgccctcaaccgccaacgtcgtggttgacagctgaaacactttatccctggccccgcgggaaccatccgccggcgtagaagcactatccgtagagacaaccgtcgcatcgaagccacaatcgtcaataatttcggcgactttttccgcaggaagcagggttgggtcatgatggaccacagcccggcccatcatcaagctgacggtcacctcgccagcaccctccacccccttgaaggcgccctcgacggcggaggtgcaagcaccgcacgtcattccctcgacgttgactgttgtggtcgccatatgggctgctgatcggtcggaagaagcgccatggttgccggcgcctagcagagcggaggatgaggccgccatgttgcgccgatttgctgcagaagccggacaaggacggtcgggacgcgcggtgtgtgttaatgcatgcgttcgtctgggaggaagagggggacgaggaggtcggggagataataaaggaagggaggggaaaggataagcaagaaaatgctagtaacacgcaagggtcgttcgattaagagacattcggaccggatgcgacggaaggatacgccgagcctttttaaacatgcagcaattaattacatcaagacactaagacaagaagaactattactacggatggtacgggagctgaatgggttattgcacgggaagaaacctaatcttagaccagacacactcgcacacaaagagcgtgggatggaaagaatggtaaacagcagtaaaaccaagacattccaggccgagggaatcccattcagcaacggactaagattagatcgagtcgggaggaatgatgccaggcgcatcccaacccaccgagacgatggcgctaacagaaaaatacgcagtgcatggcgtcaggctgtctccgccgccccgcggacttacgtgagtttttcttccccaaatcgggcaacattgccgcttcagggcatttggaaggctgggaccacttggttgctctcgggggaccactgctagtatacaaagtagtactgtagtatacataggtaaggtattgaactccagtaccgggttcatggttcatcttcggatgcatttttcggtaggtgtaaggccagctatgcagtaatattgtcaataagatcgcatagggatcagctgaactgtccgatccagctcaataagccacccacgaatgcgctagcacttatctggcctgtaactactacccatctaacggtgcttatctgcctgcacacggtctccggtatgacctcccgatggagggatcaactcagacccctagcccagactgagagggaaatgaccacgtctgatgctgcgacacgagaagcatcatgcttattatatgctccatcctagtagcagctgtcatgggacatcaaactcagacaaggactgaagggtctggaggtgaaacacttggcaccgaaccggcttcgtttcgactatatggagagtagccgaataagtgacttggaaagccggatttgtctgtagaatatcagctgtaatacaactagttagcagcgagacaattagttcatcgtagctatcatgagcggactaattatcagaaacggaagttgacaatgtcattgacttcagaagacgagatcaccgtccggacatgcatcccattgtttgcatcaggtgcaaacaccacgagggacatcatcgctgcctctcataccatcatcatcactatcaataacatcaacatcagcaccactttcatccctccacagtattacaatcgatggagcacgcatcaccgcaacccacacagtgatacatttacctacctaccacctcaatccaccctaccaatccaagcaccctaaactcaccactcaccactcaccccctcatcctcacaacaacaaccacaaaatggaccaaatacacacccgggccctcgaagccctccaaccattcatccacctcgccacctcgaacagcgcgacatccccgcgcttcatcacaaacttaatcacaaacgcaacctccaacccgaacacctacgtattcgccgaactcctcaccaccccagccatccaatccctccgcgaccccaacacacccgctgagtatgcaagctacctgactctccttgagatcttcgcctggggaacatggcaagactatcaatgtacaaccccctcacccagtacacccaagaaacatagctaactaaaaacagcaacacccaaccttccccccctcaacgacgcccaaacgctcaaactccgcctcctctccctcctctctctctccacaacaaccaaccccctaacctacaacacactcatgaccgccctatccatcacgcaaccctcggagctcgaatccctcgtcacaaaagccatctacgcttcgctcattacagcccgtctatcgcccgcttccaacccgccaaccgtgaatgtcacctccgtggcgccccttcgggatgtgaagcccgagtcgctgggcaagatgatcgacatcctgacggcgtgggagacgcgctgcggggacgtgattggggatattgaggccgagattattcggatcaagacggagtcggcgagacggagggcagaggagcgggagaaggaggtgttgtttgagaaggcgcttgccgggtggggggctaagatggatgagaagaaggtgggaggtggtggtgggtggcagcagggtggtaggggtggtggggtgattggtgggaataagagggagttcgctgcggatgaacttgatgatgatgggtattgggagtatgggcttgaaggaggggatgggatggggggcgggggctctaggatggatattgatgatggggctggagcgaggttgggtggtgcttcgtcggggccggctagacatcctaagcgggtgttggggaagaagtcatagttaccttcggtagtaaacagttaaactagtactagattttactactatggacctgagtcccattatagcgaatagcatcatgatggtagcgtttcgagtcttcgataggttctcctatgaatggtacgagtaatgggaagctgggaatggaagttactatcgagctaatgctcacaggtcagacacatatatggcatcagtatatcataatagaatctaattaccgtggactatccacaacaccaaagcctcagagaaatcgtttaacgtacatgcaaatccagcagatgaggggtattatgtaagaaaggtaaataaacaatgaaaggaacccaatatacacaaggtgtagggtgtgtgaaatgaacgtcgtgacccgacggacctggtgtgtcacgccagtccatggatagttggttggcagatgtaaatcccacttgctatgggaccaggggcatggatgctctacagcagccatctctggagctccaagcactgggtatctgccccttctcacattaagagaatcccgaggccattcggggaggcaaaagctctctttatatccatgcgctgaattggacccaagaagcaagatacgctggctaacgctcagaaagaatcaagatgcacatatatgctgcccaaaagcggtatcacgcggccgtagaaattgaaacagatttcgaattgaaatcggcaggggtatacgcaatattacggagattagagcatagtaccgggcacaaagatgaacagtatactcaacgctgcggcgacaaagaaggcgatcatggcagtggcagtggcccgcttgttcagtagtttgcgcacgtatggctcgcgaatcggcgaccaattcatgaacgtgtactcgctgtagccgaggaaagccatgaccgggtcaatcttgtactggtacgagacgatgaagtaagaggcaatggcaaaaggcaagatcaactggtcagatgttagtaaaatatcaggcctgcgaacgaggattggctccttacccagcaacggatatgccggggtttgtcccggagaaccacgtagaatgcgccccagaagcctccaccgaagctgataagggcaaacgccagtcgtgcgaggatcgtcaaggggactagatttcccaaagctttggcctgcaagaaccctggaaaagcgtcgcgctccattgcctgaaaaacatagtctttcgccggatcaaatacttcaggatcatctctgccgtcgtcctcgatcagattgatgatgccggataccatctcctcgggcagaacgatttctctctctgcccccggaagcaggtacgtatacagaatcttctctgcgctggcgcgaatatcggcacgtgccaccgtgtggcctggagaaggtgagtcattccgtgttccagaactgtcccgaggcggctgctcattcgaggtgacgcgagcaacattctgcgaaccaagactgctttgaggcgagtgtccggatgtttgaccttcagagcggagaaacgccgacagtctctggtcagcattccggtcgcccacatcgtttaatccatggcgcgagttggacggtcctgcttccacaagcgggatgtcattgtaatgctcgatattatccaatgcgccggaagagcctttgctgtcggccttctcaagatcaggcgtagctaccaaaacggaccgacgtagttcccgaacgtaatgacgacagagggacatgtgttgcgagacatcgagcctaagagacatgggttattaatagcccaacagcaagtaacacattgtttcccaagcataccagaagtccagataatccaccgagcgctgctggtcccgcatatagatatagaaggaaaacaggtcgacgggagcgagggtccggcgactgaggacttcgaagagcgtggggaggcgattgcgctgctccaagctggaaagagacggcgacgccatggtggaacgagtgttgggaatctctcttgctgaagggtaaatgttggatgtatattttttttctctctctttctgagtcaagctcgaaggagctgcgccgcgatgaggggccaaaaaggggaacgagcgaacgtcggatttgagttagggacgggggtggacaaaggagtcgaaagagcaattgggaagggatccggcgcgtgttttgtctgtagctgatcgaggaaaaggctggcgagacacgacgataaaaaaagaacgacggtcaaacagttggagttcagcactcgggcatgagattgcagcgatacggggacgaattgaggcttatgtgcaagccaggaggccctgcagagggtcgtaaggtaatccgaggcagtaaacaaaacagccgaccgactgcaggagaggtcaggaagttgcgacacaagccatccaggagaggctcgggaagtggattcacaggcagcagcaagagcaagagccagaagaagaagaagagaaggaggggaaaagagattgacgaagccaagggtaaaagcgagggaaagggtgtggatggccagcccgcagacacgcagcgacgggcgaaaagactagtttggaggccaaccagttcgtgattcgtgatgcctgagggaggtgcctgagtccccactcttttccagcaatggttcttcgcattaatgtttccccgaaatgacttcgctccactcgcggccgatcttttgacactcgccaaggggtaaacctttttctttgcgagccgatgatgatgatgattgcttttgtgtaaagcgcggatgaattcctcctggtcttgattctcgtaactataagagcaaggttacattattccttttcagtatttctcatctgcaacgtaggaaaagaactccgccccagtcaccccaattacggtacatcctctatgcagcccttatgttggtcctcatctaatagttactaactgcatctgtccaaccgacaggctccatccattcatcccacccaaaaaaagcaacccacggcggatccgcaccgttggttctcggtcggtccataataataagtgattattgcagggccgtggctggcaaagacgagacagaattttcgtaccttcgattctgcatctgtgccctatttttaataataattataatctcgaacattaaccatttgccgggggcgggtcatggactggaccgtttttctgcaagccaccccaaaaacgagtgttttgctttgtgcactgggcaaataattagattaaaacgggacggcaaataatgaaaatcgtgccgatgataagccagtgacccccccgtttttaacttcgttttaaggttactcaatgatatcattgtttatggtgcattttctagtgtacaccgaactatctagatagcacagaacagcaagtctgttgagtaggacaaaataatcagaagatatcgaaaacacccacctacctttcaccgccatctcctgtatcctgcttaacttcaggagatatgctagatggcttcttcgacacctttaagctaacgccaaggctaaggtttcagttccaactctctaacatgtcagacctccattgtttgaaagggaactttgtcatggtcagctgaatccggtttccaacaattctctgcagtcgctggacttgacctcctatttacggaggcttaactcgaccagtcttatctctgatgcatcctcgactgaatccattagaagagaaatgcagctcctgtgtccaagccgattatggcgcatccagcgactgagtcacttgagaaacccaatagaaggattatactagtactgccactatacatccaaccatcaaggaatggagtgatacaaaataggcttcacaatatcatctaacgaatcagcgtttcttcttctaaccagacagtaacagtagaatgcagcggcgataagaaggacaatcgggcaattagtgcttattgtagaggtcttaagaaggacgtaacggagttaacggattcggggttcggacttctacggagtataataactatatcaagggccccaaaccccattggattcagatataatctgctctcgcagatatcatctcagctgtttcatgcgaaatgacgacctccaaagtcctcgttctcatcaccggcgccaacaaaggcatcggcttcgccgcggcacggcaactagctagctcaagcaagttccatgtgctagtcggcgcgcgcacgacacccaaggccgaagctgcaattaaggagctgtcatcggatgcagtggacaaatcagctctcacacccatcaccatcgatgtgacagatgacgcatctatcgctgcagctgcccagaccgtatcggaatcattcggacgtctggacatcctgatcaacaatgcgggcattgcgcagacacctgctactaccctgcgcgagcaataccggcaagttttcgatgtcaacgtgtttggcatcgtggttgtcatggatacattcctcccattgctgcgtgcgtcgacgttttccgatcgccgcattgtcaatgtcacgtccggacagggtctgatcagcagagccggccacaaggatcacccggctaacgcaaagacctatttcatacctgactaccgcagtagcaaagcagcggtcaatatgatcaccgtcgctcatgcggtaaagctggctgaggagaaaatcaccgtcattgcggctgctccgggctactgccgcaccagtatcaacggaggccaaggggtcaaggaagcaagcgacggggccagggtcattgtgcgcgctgccaccgaaggagacccggagaaactgaatgggacgttcgtcgctgacgaacaatggacccttggttggtgaaatagcgcgcaatggagcaaacgaacaaacaaacgtttctgaacaaggctgcaaccgatcaatgtgtctaatattgtcggaaattatcaaacacgaaatcaacagaagagacaggctaaaagctaagatgcgccatgttctccacacctgggtatttgttcatgccacggaaacgcctttcaagaactccaacaacacacagagagtacgccattatcagtgaccatcggccaagtgctgcgtcatgttagcgatcgggtataggcatttcaagaaggagaatcaagtcctaatactcaccgaccactccggaatatttcgtatctgttgccacatgaatttctctaatttattggcactctttgcatagggcgtgttctcgttgttgtacctccggcagttatcaaatatcaacatagcgtctttaataaaatcttgcggcgtagggtacatgtccttctcatgcttctcttccatggtggacaagtccatgggctccttaatgacttcgtaatagtcaggaacctcgtcgcgattgactggctgagtaaagggccatgccgcgctgtggttctgcatgtcgttgagtagatgcagcagctgattgtagttgggtccgtggcgtggttgacgtgctagttcatccatgtccggcgaccatcccgactctttgatagctggtatacttaatgggtcgatcttgcacggaccattcttccattcctttgggggcacgtgaattatatgtgagcgactgaaggcccggattttcgcgtgtacagcttctttttgctttaaaagcatgcggccaacctcgaggtaccgtatcttagggagcatggtgcactgcatgattgtaccaccctcgtaatctttgatgtatcccatccacacggacttgtcgagagtaatctctttggtgaacccttgttttttgaagtaaccaatggcgtaattgtcggcgtaggtcaggaaatgcatgatgtccgatgtggctttcacataatccttgagatgggacatcaagtgcgcaccgtatcctttaacctgctggtcggacgaaatggcacagaaaacgatctcggcgaacctgcggctgttgaacggccggtatgtgatccctcccacaacttctaaagggtgtttgacgatggccaaggaaagatgcgacctgtcgtaaaccaatcgcgcgatataatctttgggcatcttcgggagctgtttttgaaagatacatttgagacctgtaaggacaacaaaactgtcgcgcgaaccatcgttgttgactacacgaaactcgatatcgccgcgacgttcctccagtactgcaggctaccatggagtcagcgtcatcggagctcgggcgggtctgcgggctgtctgagggcttaccttctccgggaagggaacgattctcggtggcttatccaggaggtcatcttcggtctaatgcagaacaaggtacattagtgtcatacttcatacaaagatatgatgcaacataccttgggttccctctcgggagagtcagtgcgcgccttcttatgggaatctggggagagcgcctcctccgatgctttccgcttggcacctgaacctgacatgagcaaatagaccaggacagtcgcgaagacgcgtgatccagcatcagacacttactatccgtgattgatggcatgttgcgcgatgattattgatgacttctagacgaatgcgtcttgaacctcagcctctctctccacacgagctgcggccgcgatacggggagcggaacgggaggatgttgatccgcggccgtcaagccagataaccaattactagttcgggctccatggcattacgacgacagcttgagggaagctccctctccttcttctcctcatttcctctctttaactgtcttctctcctttatacacaagccattgaaattaagcgcacctcacaagccctcatgtctctgaacgaagtctggcaggcagcttctgcaagcccgtatactcctccggtctctaaggacagccagttccttgtcggcttcagtctactacttgctggtgagccggatccgacctctcacactccaaacaatcaactaacttacaacagctttcatccttactggacttttcgggttgagtcagtacaccgcaccagagatcttttcaacttctgaaatgtctcgcactaagatcacaaacgcatacttacaacttgagcagatcgttccttcctcagcatcgcttccttcggagtcccggcatctttggcgtttgggtaagccgcagaccctaatagcagccactctatcaaccatcgctaacaaatgccacctttagcttcggagccgtattcatgatctgtgccgttggggtctacgtttaaaaattccagttgtttcccagatacccatgtaccatacactggagagtttgaaacgaagcaaatcgttacctttataatcaccaaagttctcttcgcactccagctctctatcttaacatagctctcgactctataccctgtcgtgtttaagccaatcccactccaaatcatcatgacggacacggaacccattttcactgctgtctccagcaatgcccaccacctctacaccctccttcagtgcatcggcttcgcacccagagccaccgtgcaaataaccccggatggaatccgcttctccgcagaagagatgcgagtcatccaagggctcgccttcctcgacaaagccctcttcaccagctacaccttcaacccaccagccgcgccaaaccaagggacgacaacggacgacaacgacgacgactcaacttccgacccctccacctattacccatgcttcgtcgtctccttgtccgctctcctagaaaccctaaagatcttcggcaccaacgactcctccaccaaccccaacgccggtcgagcatccagcgtccaaccaacccacccatctggacccggcgccttctccgcccccagtttactcctagaccgctcctgcacaatccgctacaccagcgaaggctcgcccctcagcatcacgctatcggagacgggggtcaaaaccacctgcgaattaacaacctacgaaacagaaggcagcgaagtcgacatcccccttcaacgagatgccatcatcatgaagattatcatgcgctctgcctggctccataacgccgtcgcagaattagccgctacaagtccatcggtgttgaagatctccgcgtccgcgacccacgaaccgttcttcgctctctccggcacgggaggctcgttcagcgagtcgtctgtagaattctccgtcgagaatggcggggctaatgggcagggaggcgatgcaagaggctcaattgatgaaggttcccgtgcgaagaaagccaaacttgcaccgactgtcacggagacgtttcttgtcagtccgccgtcgtcgatggggtctcgcctcaagcagaattacaagtttgcgctgatccagaaggcggcgcgtgctatggcggtggctaataaggtgagcattcgtggagatcggcagggtgtcttgagtctccagttcatgattgagtttgatgttaatggagctggtggtgtacggcctctgaaggggggtccgccacctgttgtgacgtttgtggatttccggtttgtgccgttactgaatgatgaggatggtgatgatctggagtaagtcgtacatgatatcatacggattgggtttgaaaatagtgggacatcatggtgtatgtcaaaaagcaataaagtcttgttttctgattccccaacgccgcctcatgctcggtaaccatatcaaataccaggtaattttacatagaacgtaaccataagattgctgataaaaccgccctttcttccatagggggagacttgcagttcatagcatgttcggaaactcgaagagtgaccacatcacataacctgaacaagaaaacgttagtctttgactttcactcaatcctagatatatatcacactgagggatagcagagaagggagcaaagatacctcagcaatagactgcctctcaataatcgacttctgcttctcattcctcgaaacccggtaatagtagtcactaaagtcaccgcactgcatatgccgcaagaattcctcgtcatgggtaatgacaataagctggaagttcgcctgctgctgtctagtcctgataatatcatgaagcgattccgcaagcgagcgaatgttatcgcggtcaagattcgtcgtaggttcatcaagagcaatcagaccgcagttaacaccgaagcactccgcaagagcgagccggatgatgatacttgctagcaccttttgaccggcactgcagcggccgcgcatatccatttctgcgccttgtttgaccatgcagacgcggtagttgtaagaacgattacccttggcgttttcgttgtcggagcggatgagaatcgtgtcgacgtctgtgcctcggtaggtcttttgccagagctcgctgatgatggcattgatttcttccattttgagcccgtggtatttcatgatggctttgtcgagggcgccgccataccgcgctaggtcgtccactgcggctttggttgtttccactttgatgtgagcttctttgtacttgcttgctgcgtctttatagtcggtgttccagtctgcgaggagctgcatcagttggtcgtctttggatttcatctcgcccattttgctggcttgtttggcggcgagcgcgttgtgctctcgtgccctgcgctcggattcttctttaaagcggcttcggtcaacttcagcgttttgggccgccagctgttcgatctcttcggtcacttcgtcaagtgagcgggtcgcctggcggtatgtcaggttatctgcgtattgacgcttggtgttttcgctgtccttgagttgggcggaaatcttgttaatgtctttagtaatattggcctgctcgacttcgagattgctgatctcgttctcgatgctttgcagttcacgcttgctgcgctctagttgatgagggccgcctcgctcgttgtaggcgtcgatctcctcgttagccagttcaagttggtgtatattctcgtagaggtgtgagatctcctgctgcatgtccctttcacgcgcttcagcacgctggctgatatcgtcgtacttggcttgaaccttgaggagttcaggcgttagatcttcaatctccttgtccgcctttgcaattgcttcgcgttgttggttgttaaggtttttgtactcctcaatgcgagccaggaggtctgccttccgctcaagcttgaatttcacgttgtcgaggttactcttgacgtccctgagctgtagctccagtttgttcatctcagacaatgtttgctccttctcatgagtgagtttcgacaaagtcttcttcaaggcccgggacttttcgccaattcccgcaatttcgtcctggatatcttccagtgtgcgagaggcgtttgtatcttgctgtttcgtagacaattcctggacttgagagcgtatggccttgatttcactgtcgtatctgacaatagtgttgaccgtctttgacaacgactcgacgtctttctttttatcggccttttcgctgactatcttgtcgttctcttccaattggctcaagagcttgtcttgttgagcaatatactcttcttcctctttctccagatctgggatttctgtctgcttcagccgacaccaggcatcgtaggctgtgctggcctcgcgggcagtattaaggtcctcttcaagacggggtatatcgtcatcctccatcacccttttcgctcttttcactaacccctctaatttgttcctgaaggtctgtagctcgttttcggttcgaaatgtccgcatgcacaatctgcacatgtttgctgacttcactgtttcgagacagtcagccatgtacttgctgactccagcatattgttcagcgtccttcctggctaggtcaagctgagcttgacgctcttttaggatctcggggtattcttccggttcgtcatcgacggcatcgcggatctctttaatgcactccttgagctccttctgtcgctgacttagtgtcttcctgacgcccttcattttgaactccacctgctcgagttctctgctgactccatcacgctcgcgctctgcccttgagacatgtctggattcctcctctatgacgtgctggtaatcctgctctaaagattcggggctccagttggcgttcacaaatttcattagtcgttcaccatgggctcctttcatcgtctccaaactgcgctcccgttccttcaactccttcttgaggtggtctagtcgagccaaatcaccagccttctttgtcgcctcaatgagctcggaattcaagcgcgagctctcatcctcaaggtcgcggatctgtgagttcacattctggatctccttgtcccacgatgcggatcgtgcgcgctgtttggcttggtctaaacgagatccgatgtcttcaatgttcgactccagtgcagcctggactccttcgtccacgttgatctcgttgagctttccttggtaggtagctgcttctcgatcgttcgaggcaatctgtcgcttggctgcgtttttactttcctgtagcgccgacttctgttgtccgatctggttaagggttgcctggacgtcgcgtagttcactttgggcctctttcttcactcgttccaatacctgattctgatctttcaggatctttcgcactctccgcataaactcatcaacgtccgcctgatcctcgacattgtcaaacccacgaatattgtgcgctcgagcgacctctttcgtcatcctttgtcgccgctcaacctggcgctcgaagttggctttgtcgttctcaaacttgccgtactcagcttgtttgacacccagcctttggcgagtttgctcgatctgctccttgagctccatatagttctcctttttggcttcttcttgctgctggtactgaagttgccttgactcaaattgctccaagttcgactgaagccactcatcggagtcgtctagctcaaccaggtgtctcttgaggttatcaatagtcgtctgaatactctttgcctcaatgcgctttccttcaagcgcacccagaacctgagagtaactttccgattccttccaagctttatcagcaagctcggccactcggcgcatttcctgggagagctggtgcgtctcttcgcgcagagcttcaatttcatcctggagtttgatcgatcttttctctgcacggtcggccttctccttatcctccttggcgtgttgctccattatcttgtacttagcaagctcctcattctgcttcttccgcaatgctttgatattgtcgatcgccttcgtgtacttcatggcttcaaagatctcatcaaatttctttttcaggactgacggttcactcatcggccacaagctctcgtcctgatggcagaatataacggagtccaggatggccttcgacacgccgagatactgaggcataatctgatccaactccgccacccgggaggagatagatgtccgctcaccgtccttaaccatcaacaactggccctctagcgtcttctgctgtcgtgttgttttcttcaccgtgagttgtagactcctcgtagcgaccatctttgcacccgacgtgcccttaaaggacagtttcacctgggccaggacttccttctcgccacatagctgccattatatatcaacatgtctgtccatcctactcaataccatatgttataagtcgcttactttcgggtcgtggatgaacgcgccacccttgctattgggtggtaaatcgccggtagtcgcatatttaagacactcgatgatagtctgcccccaactccattagcccgacgacttccatagtaccatcatactccattcatcataccgtctttccagatccattatacccaacaatcaacgtaagaggagtgtgaaactgaatcgtctcgctgcgcgtattatcgaacgaccgaacactagaacccatcgccagcaacccagtcagcaactcactctcataattattctcatccgaataatatctaaggaaatcactcaccccaatatcgacaacttatctatcttcgctgcgacaagcaaaccccagatagtcagtaacctcagcgttcatccattcgatctttcacacgaccctccgcggaacttacacctgcggacgggctgattagtaaagaatgtttgtggccggatgcagaacaaaagctcacattttggaagacgtcacttcactatggaaggggggaaagaaagaaaaaaaaggcccggtccgtttccacggatgcgtaagggtaggtagcaggcctgcaaatcacaccttccccgtgattctccactcgggatagacaaagcgtgccggattgatagcgagcagctgggcttgggatcggcgcgtcggacgacgcggggagactgcgcgaggtcacgtgtatgggcggtcagctggaggtattggatattggtttagtatagatgctttctaggtatcaccactgggataggatggaatgggggggtatgttgttgggcagacgcttttgtgaaatagtaggaaagtttgtggtttgctaatgttttctttcggggcatgctttcccttccttggaggcactctgtacttcgtgaaactatggggatgaacggcccattcttggaagagcgacgggtggtaagttgactacatgagctacgggagatatcctgctggttcgtctgtatacaagtaagcagatgagattcctgcgcaggatgcctgcgttaagctgtttgatatcggactgcaacaggtaatcactggcatttctctccggggggtttcgtcttattagacaacatcaaatcgcccaatgcaatgactagtggatttgtagattgatattcctatatcttcgctgtgtcccgtgttgcacgtactcttaggttcaaaaggctgtgtctcaggagtaagcaatgagcatgacagatatgatgatattgactgtagattttggctagagcggttactcaagtgcacctaggattgatgttgcgaacactaggtgtcacatataaaatgctcaccttccctcccagccttctcacgttcaattctctctcaaacccaatcttctcatcgaaccacccttaccctactcagctcacattcagatactgtgcccattgacctccagtcaggatgttttacttcaagaagatcatcacccacttattcctgtcctgtctcttcttcaaggctagcctggccactccttttgccaaaccaaccgacgttgccaacgccgatgatgtagttgctgagaacattggcactgcaaccgtcaacaaccctaatgaggccttcgacgatgtcgacggtaacggcatgtccgcagcttccacggatgtcgagaaagagttgaaccctgcaagtgccatcctgattgactggtgcagccagcgctaaccgagattctcagaacgatcgtttctgcgaaagcaggtgcagcgtcttgaatttgtgcaattgcaacgatgaagattatcatagctgtagttgtcactaccatggactgaggtgcaggtgcaaatactagttgtgaatcaacagtaagtaagatattccagccgagtggtgcatcatcaaagctgatgttctctttggaaaatagcggctgccaagcttccgttaccttatgtgcatgctgtagtttgcttctgacgtgtcggacaaggtagacggtggggcttggccagtcaaggcctcggtctcagaaaatggggaaggatcctggaatagtgatggcagtaattgtggttctcaatttccttgggaggaccttcacactgaattttacttgccaaaataatagctctttttcaaacgaagcagatgaaccttgctaatgaaccttgagatactgtagcacatgagttcatttgagatatatagagagagctattgtagtcagccatttctgaccatctcatggctctgcgtacctcgtcatcagtagtagcctgagtgggaaatgcattcatccttcgtaaggctggaaggatgaatatcgcacgagcatagtattagactccccaagataggggatcatcccgccggtaggacattccgggtttggtctgcgcctgggctcgcttattactctgggccatctccaccggcgcctaagaaagtccaacatacccgttcgcgtggatgcggtgtggtctgacatctgcaattgcacagacgggtgaccgttagcagctgcagcttcccagctgcgcatgcttgttcagggtggaatggcagatatcgtaacgggtgttcggtgtgaatatcccacggagtgataagagaaggcaaacgtggattgcaggctcctcgagggacgatagctaaaacagtcgatggtcgataattacatatattattgatgcctgatatcagcccacgaaaataaaattagcagatggcggcgctacgcaatgcacgtccctagcggatctaacggaagccagatagttcaacccgtggttgacaagataatcccacaccataccacgcaggatgatgtatgcttcagggatgaggtgatcgtgacaggaaaggagtaggagtagagagccagtcaagggggatataatcaaggataacccatgggggcatcgcaagtgtaatccaagcgaagcagcaagaatacccaaccttgaagcaatgaagcatcgactgggatgccccctgcagcaatcatacagacataccgacctgtatcgtacaaccgtacctgagggtttcccgaggccgcaacaacccaccaatcagcatcctgaaatgtgtggaaatccccgggaagccccatcggcggatttgattggcagccgcagtggatcccgcgtgtcggtgcgataccaatgacgatgtggccggccaaaagtacaagaattgacagctctactggattcaccaccgcggtcatgtccagaaaaagtccaagaaacactgctcacttaccctctcttccttctacctctatcccctcccaatttctttctgtatcatatcctatatagggcacctaaaggagattcttatcccgggaagaggcgtccccaccaccccggcgatcgatcgatttgatccccgcgcagcccagcgatggaactcgaattccatcgaggacgaagagtggcgcagaaccaaattccgtcccaggcatacggtctccgagccccagtgtcgaactcaaaaccaccggggccccagtatagcatggacgcgcggagtattcctcgctcgatgagccgcggtgccgctaatctgctccaactctccgcttctgctaccatctcttcttccactgctactgctgctaccacttcaacaactcctgccactatcacaaccacagtccctgctcttgcttccatacctacaactactacagcgccagcagggaccaacaacctccagcaccccacccccgacataggccttgccggcaccaacaatgacggctggtctgcacgggtactagacgaactaaaggacctgctccttcttctcagtcacgatgggcaggttctatacgcgtcaccatcatgctctgaggtgacagggattgaatcgcacatgctagaacaaagcgatttctcccgtttcgtccatgaagacgacaagcctatcctcggccacgaattggacgagtgcatcaagactggacgcgaaatacgatgtcacttccggctctgtaggcctgacagtagctcctgtttattagaagcacatggacatccacacctgatgacgaccggaactgctccttctgcgaccgcagattcatcccaacaaccgcaacggaagacagtctgtaaagggatatttctcgtctgtcggccatacccaacacgagggtcacagttgctcgattcgtttttggaacacaaaattgagaacatccggctgaaccagcgcatagcccaactaaaggaagaggaagaagaggagttgaattcgagaccagggcagacgtcaacgacaacgacgaccagcaccactaccacgacgacaacgcgccagacgtatgtctcaacgacacagacgtcgtttgcgcaacgagatacatcagtatctggagaggagaatgaatcatccgatacagtcaccaatacggacgacgccgattcacgatcgtttctggagcaggttggggatcggttgccgcagactgaagacatgtctcatattgacgggattgaggtcatgacgggtttgtactacggagaaggagaacgatcacagggtttgagtacgggagtccgtcatggccgtctgattcgttgtaatacggagcagccgaatgccgttgctgccggttctgctgctactgccgctgctccgagcgaccaacaacagcagcagcagcagcaaccgtcgcaggtgcaaccgcaatcacagcccaagaatcctgcagaggccgtggacaggaagaaaaggatgaaaggggagtatatgtgcacggattgcgggacgtcggattcacccgagtggaggaaaggcccggaagggccgaagaccctgtgtaacgcttgtggatgtgagttcttcccctccttgatcatctgactatataaattctgtatcagtattaacagtgaaatgtgaacagtacgttgggccaagaaagagaaaaaacgccaggatttggggccgtagtgagggaaaacgcaaagaaaagaaaagaaagggtggggcttgcatttgtatgaattgtcatttactatctactgctttgctgctgttgcatttgccagaaggggccaatttagccctgcgaggatacccctgcttatgtacctttgtgcatcgtgcttttttttgttctcctcggtggcccgcgaggggtcagaacattttcttagcggctgcgctgtcacagcatttgcacttcttggcctactactatcacattatgccccttatcctctgaagtgaacagatatcatgactttatgcccgatttacttgaactatacttttctcagattgcaattttaacttcaattgaaactaaaaatgaactccacatggtacccagtacgaactaaagatggtatgtaacccaaagctggagggtgtaggtgcagggatggtgggggaggatctggtacttgacagggtagagagatacgtagagatatataacaaagcgtcggcgaaacaccatgtttagggaagactaaagtagcctttcagataagaccacctagaaccctaccctagtccgtttagatgaacatatagtacctactgatatgtaaatcatcccttctattaactaatccgtctaagcaaaatgatatctaaactagaactatgccctctggtgcgtatatgctgaagtgatctatatctaacagcatgaaaagatgaaatcttgacttagctgcaacgcatcagttcttgttggcccccttgtggaccgcctccagtccatcttgagcaacgtccttaaccgaaacgttgccactcaagatatccttagttgtagcgagaatagactcccaactctcgaaaagcgtgaacggaatcttctcgcgctcgcagaatgtcaccaaatctggaagagtcagtaactacagaatgcaaatctcaatgtcggaacttggtaaacgcacccttgccctttttggcaaacagaagatcagtctctgcagcggctgacaaatcagacacgccatctcctgcgtacaacaaggtcgggcgcacactgtccggcagtgcggcatacggcttgatttccagcgacttgtcgtggccgaagtggctagcagtatgacgtcagttctggcccagcgaccggttcaagaagttttccttacctgtcgtcatggtacttgatctgccagcctccctcagagttgatatccttgccatcacggctctcgacctggttggcaacgatgtaaaggtggtcgtctggttcgccgcctagaagcgtctcgaagagggcgctgatgactggaaccatcccggaagacaacaccacgatcgggacattgttctctctggaccatttgtagaattccacaaagtagggatccagcttcatgttcttcttgaggtactcgatgcactcgttgtagggggtcttgatgctgtccaacatgtcgcgaaaagcgtcacttcgcaaggaaggttagtaaggtgcgtacacatgctgcctgtacccacataccggaagctcatggtgccctcgagaacggcctcgtttccttgacggcgctttatgcgcccgtagccaaggttatcaatcttgcgactaagtgtcagtggcatgcaggttcactgggtgcttgtaggttataaagggtagataccatagcatcattgcctgcatagagtacttagctagtggacttgctgtgcgaatttcgtctgtacctactgtcttcgagggtgatcgttccatcgaaatccgtgaagaatatgagcttggggttcgttttcatgtacggtagcgtagtaacagtcatggtgaaggtctggttgctattgtttcgcggaaatagttctgcagtttcggtgtcagtcccagcaccagctgacatatagcgcctctgatcgcgagaatttgggtgatactcgaaaagtaaacgacggcaacaactccgtctttgggagatggaacagggggaacaaacctaaatcaaggacagcagatgaagatgcgcgggaccgatagaagtaaaccagtcggacaactgggtaacggaaaaaaagaaatagaaagatgtgcttgacggacttggaggactaaggaagaaagagagagacggagcgactcaaactagagaagcaaagagagaagagaagaaccccgcggtgagaaagcagagactagactcgatcaagtgcaaagagggacaatcaccagcaatgatggatccatgcggagttccccataatttccagcgcgacactaaaaggtgaattgtcctttctcttgtggagccagtctagcatttcccttgtctaatcttgtctaatgctaattttctgactattctgggtctagccgaaccgagtatcttcccggaggtctccaaaccaagtcccgaatttttgatgctcgatcttttcggcgccgatactttctcggacacttgaaggcatcactccctcgaatcttcacacgccatggctcgtctactgcaatcattgcgtcgagccctaggtttaacctcttcgactccggtccctcgctatgcccgctcaatcgacaccaatttctccgtctttcggggtatgtcacacaccttaattcgactgaacgctgttcgctcgttcacagttgcgcgccatcgcacactaacagattaaatccaccactcagagggagatagagttgtggtccatggcaagtcgccgctcctaagcaagcctttgcggaagggtcataaatccgatactcgtcgcggacaattggagcacgacaacatcatcggccggagggtacgggatctggttcaggcgcggaaaggtcagcatcttcaaatcattcttcaattaacccagccggtcgcgctctaatcatctccggtaactacaggccctgaataccgactctccctccctacgctcgaagaatatgttgccatgaccccccgtctcgtcacgccggtacggacctaaccacaccgtcaacgagcaccaccaccctcattaacgcatgccaatagatctactcagcagacgccaacctaatcgtctccctccttgacattcacatcgcacccccagccgaaggaacagacacaccgccccttgaaatcctcgaatccggcaccggccacggctccctgacccttcacctagcgcgcgccatccaaggcgccaactctactcctccacccctcccaccaagctcccaagtcacatacctgcccacaaaacccggcgaggtctcgacccgcaagttacagacacccgcagatggcgccccaacaccgacggtcgacccagaccaggagaactgggacgcctggcgctcccaacgcaaagcaatcatccacagcgtcgacgtgacacctaaatcctccgtccacgccgaaggcatcgttcggggtttccgtcgcggcatctacgcaggcaatgtggacttctatgccggacacgtggaggactggatcgcagagcagaagagacaacgcgcaccgacgggcctcctttcttcgctcaaaaaagatgatgttgagccgttcctctcctacgcgatcctggatatgccctccgcgcatctacggatccctcacgtcgcctcgatactgaagcgggacggcattctggctgtattcatgccgagcgtgacgcagatcggcgactgtgtggagcttattcgtcgacagagacttcctcttgttcaggataaggttgttgagctcggaaacggtatcagcagtggtcggttgtgggatatccggcacgcggtgaagaagtcccgtgacagtgtgtcggtggcttcctcgtccaccgaggagggtttggaagagtccgtcgagacgagtgccgttgagactgagtccctggacgtcgctgaagagaagacgcccaaggaggaagacagtgtgcttgtgtgccggccaaaggttggctcgcggattgtgggcggtggctttgttggaatctggagaaagatagaagaggatgcgcggagaagctgagctgagctgagctttgttcggtcacgcgatttttctacctacctaccgtattcttggatacccatttgtaccataacatgcatatcatagaagaaagacctaatgtactactaccaacattcttttactgttctataaccatccacccaaatacaatgagatcagacaacacgctctatcaatcaaagcacgcatatgcatttaccagaatacgatttacaacttaaataagtggtataggaggtaaaaaggccctcaagtaaaaaaaagataagagaaaaattaacgaaccagataagaacagggcttattgaaatatactaaacgcactgcaccattccgctttccccataccaaatagaagtcaagcaaccacccgctctctctttctacatcaaagaaaaatcaacaacaacaacaagctcagcttatagacgtcaagcgattccaatcaacgaagccaaaccaacaggcacgtatgtagagagaaccgccgaccagtagtagtcgcctaaggatacaacgagcacatacaccacacacacacacacacgtacacgtaagaccgattcgcccgcctaagtgcaaaaatgagatgagatgaagacggtaggaaaggagagagaatcccgtccctgagattcaatctacaacagatggaggaagcagatgagacttcggtgaaaggagaaacgttggaaaagtgaagaaaaagtatcgtcgttaagaagaaaaggcataatcagatcctaacacataccaaagctgagaggaacgacgtagtagaaagagagcgtgagagagtgtgtgcgtgagagaaaaaaagcaaagctgctgcgccggtgtgactacattccaaagatgatgcatggatacgcaggttccatttgaacgagagtccgctgggcggcagcagtaagcaggaagtaaactcacaagaatggaaggaaaagaagaaaaggaaacaagatgcaacaagagcatgatagcgtaagaaggaagaaaaaaagagtaaaaaaaagttaacaccacagacacgcgaaaggcccccaaagattccgagataacaagatgaaccggctacacaaacaccagtctcgtaagattcaacatgcaccgtcccttcaattccgttgcggcccaaaatccgcttccacaacctttccctttttccctttaactgtaaactccgcaaataatgcgacatgatcacttggaaaatgaaaattggggaacccgggcaccttctgcagatactccttgtccacctccccaagtaacgccgagacatgaagtgtgttggaagtataccaaatatagtcaagaatatctttgaagtccggagtgtagttcgtgaagctcagctcgccaatcgagttgtatgccgacttcagcttgaacgggtgcgtcataccgacccgactaaggttgccgtagagcctcttctccaggtccggatgggactccgtgagccggccgtgtgcgaccaggttgtacgctgccgacccaggcgctgagttgaaatctccgcacatgaaaagcggaatctgatcaccactggcatactccactgatggcgcaggttcaggtggaggagtgtccgactcaccttctgcttccgagaagcggaaggcagtcttgtcggtacacggcgggaatttcgcgtacttctcggagagtttggtgatttcctccatcaaaatggcggtctgaatcaacttcacgtccttgaaagcgggatcccagtagagatgcgcgttcacgacgataaagcgggagcctgtcagcctgttctccaggaagataaccaccgcaatatgatccttctgccagagtctgttgtagatgtcatcttgacccttggcatccggtcgccgcactgctgtttgaccgaagttgatcatctgcttatcgaggaggatgaacttgcttcccttgaagaaggtggcacagccatcgaccgacttcgcttcctcctcctgcatacccatggctctgcctctgggccagtatacacccttgtaatcgttataagccagctgctcccggaagaatccattgtaactgccttggtcgatctcctggagacatataatgtccgagtcgtgcgacctcagctcgctcaggataagctcgcgtctgaattcccaagaaagaacacgggacggggtataaccgaagtgactcggggttgcggaagagtcgcagagggcattgtgggaaaggacggtaatcttctcggtgggactgtttgaggagctagcggtctcgtccaggatgatccaatctctatccgggggaggaagatgaactttttggagacgaagttagtctgaggtgcatagtgagagctttaagtcgtgagcacaaacctggcatttcttccctcaaataccggaccagggccttggttccttccttaatgatctgagacttcaaaacatcgttcaaaggattcccttcaattcccagcatctctaatctataaagataacccatttcgaacggaagcgtgcgaatgttgttatcgaagagaagcagctgcttcaagcttgtgagcataccgatctcttcagggagctccgaaatatcattgctcgacaaatccaagtgggttagcttccgcagttgaccaattgccggaggaagcgtcttcaacttgttgtggttgaggtacaatttctctaggaaggtatagtggaacaaagatgtcgcaagcgcgcggagaccctgtccgccgaaatcaagagcatgccagccttgccgaggagcaggcttggacttcaccaggccattgcgatcgccgctcccgttctcttgtgactcaggctggctgggcgcaatctggatgcccttggtttgctgtgcgacggtacgggcgtaataatgcggggagctcgcttgccgtgactctgcagccaactggagttgctgctgccaatgttcgttcatggtctcgtcgatatcttcgtccacattaacatgagcgccattttggagggggccgggagtgaagtgcggagtggcggcagccaatgccccactggagaagttgtgctgatgattgatgctatgagaagcttggttatgatgggcatggtgatgggcctgctgtgcggggtgggggtgatggctctgcgattggaacttggggatctgcatgccaaatcgctggtgggcctggccgccattcatcatgacatgctgcccttggtgggtttgtgtgtacattgtgaagggattcaaggcagcagcttggctgatcggaggtgagcgtgagggagaaggagtgtcgtgactaaattttagtcttccagtgggggagttggtcccgttgcgtacgagatgacgttggtgagagtgctgttgcgtttgtgtttggaagaagaactgcccggccccaggctgctggaacctgtaggtaccatctgccatttaacgtggcagacgagaccgtaggtcgattggttgaatgttcctagggtaggttgaggctggcagggttgggctcggggaggcggcggtggcaggagagagaggagtcggggatcggatgcgttctctccttctcttcaacatggggtcctgaagcggaaccaccccaatctaaggatacgctggaatcacaaccgcagcaatttcgccaatactggttgctcacggtttcgagatgcactcctggggaggtggagatcgggagagcgatcgagagtcgaacgatacggcgggcgtcgggcgaccgagacacaagaggacggacgacgaaagtctgttgagaatcctggggtcaaggtcaggttgaactcccagagacaagctcgctgaaggagagtggacaatgcgcacttgaaaataggtctgaagacgtagcaaaggcgccggcagcttgttgggatgagacacagtcgccttgacgctgcgaagtggtttgcatcgaaggcgggaggtcgccggtgtcacgtgatgtcacatccggcgggcgtgattcgccgccaatggcaaagccaagaccagccttgacaagcacacctccagacttgggtcttcttcccttaacaaggatatctcccagcgagcagaggatgctttggaagtcaataggcgcagagacacttcagattatctatccaacatttattcgtcacttgaatatcgctaccttcttaacatctcccagcagaacggcaaccggacaagatctcagcatcagtccttcactgccccatattcccaattattgaggggactaggcgatccgcgggggtcactgcacaagtaaggaggtccctcagcagtcacagcccacacgcattcagaagtatcgaagatatgctacatcttgccttttgcatgaagaatatccgattaagaaagcatttgctctttacttttaaaatcacgattttccctgccatttcatactacaaaggcttccactggccatggagggacctggctcactatcttatctatattaaactgcccatatcgcctgtgccaacacactcccgttaccctatgacggagcccatatcaaggccacaattccttgcactgacaccacagtggctcactcgctcggttggttccgatacgcaatgcaagaaatattacggagtagtcaggagggctatatgttactattatgctatataccacccctttattgttttcggtcactgaccacttggcacttaatcgagcaaggtaccaactaactctggacacatttcagctaacctttggtttggcgcgaaaggggcccatgtttccagaactgtctaaagcgttctttttactcctttgtagcacagaacccctggtagacgagcacccatccccttgcaaacccaaaatgatgccaaatgtaaatgtctcacgtgaaaaatacgaggtcgtgggataattaaggtgtcttggtgggtaatgatcctcgtatagccccggccaagcagtgtctcagcaatcaggacgtgctctgagcatttactacctaagaaaatccaacgttgcctgctttctgccaatggacgcttggcatcgaagaacgggtagatatgtgtcactggaagttatttcatacacaacttgccacttctacattttatagccagccatcacagtttcagcaaatcccctacttgggggtaatgcagaactcatctcagacacgacttgtaagggaaaatagtcccgcgttcgactaccatcatattcgactgttgtgcagggcctatctgtcaataatgacaggagtatctaaccgttgcaaacaaaccctccccttgccggaccccaggtgcaggaatgcatagaaacatgccacatacacctgccacatacctgcacaccggactcgttctccgggcgaatgcctatggcatcaatctgggggccaatggatacctactcaccccttgctatgtttcgaatgcataggaagtatgtccagagcaggtcgatctcccgtaatatcacaatattatacagtctcactcaccgtaagcaagcgattgagcccgagcagaataatgatagtaagatctcagtcaaatcatcattgcttggcctccgcatgccaagaactagactctacaatttttacccagcacctctgctagatattcgctaaaagcagagcagcttggtttgtgatcaacgttagctcgggaggttacgataactagtatctatagacatagcattgatttgatatacttgaatagtagcctcgtctagcctattttactaattcgtataatcgtatttaagtcgatttagttgcgctgctatgcgagctaacatctgatcgtcaccttcggtcatgggatcatgtgagggttttagcaaagtagtagtcacatagttggtagaacttaattgcttacaaagggactagttatggtaagtcgggggtttctaacatcattttccattcattggataactacgcttacgaggtatgaatgcagtggtgagaaacaacatgcactaggttgaaactgtcacacattgttaagtttcccgaaggtagtacgacagtatggacgaatactgaagcatgtgtacaaggcagcaggggatagacttccagagaaaatcacatcatcatcatcatcactaccattgctgacagccataggcagtctcaaacccaacaacaccccgaaacagctcaacatcagaaacctccgactggaggaatgaaaaaccgatgttacagaatctgacaccctaatagttgcagatatgacaatccataagctgacagcaccacaacaacatagaaattaatccgtaacagtcatcgacaaaaggggaaagaaaagggggggagggaggagaaattggcgcctagaaagaaaaccaccagaaggaccaccgaaaaagcccagacagacctgaactcgggaagaatgcctaactagtccacttactactacggagtactactagtaagatggatagtattaagaagcaaatccctgacagggcaacaagtgacccgtgcctgcacgtgtcttttcaggccgaaagtggccccggcatgcataatcatcctgggtgggcggcggagcgttgcggcggcggccagaatccaaccaacaattggattattattcattctccattgtaggcagtaactaagtaaacagttatctgtcctaagtctcctggttggtggttcacgtatgcaattccccttcctccctgcctgtcaagtgtggaagggtagaattattccagccaacagatacttgcttggtcaagggatttaatcctggtttgatggaacaggatctggccttcgttaacaaatctgttacgatgtaatttacccgtttattgttcttactccgagatccatcggattagagtagattgggttggtctggatgggaagtcaacgattgagtggtcgcgtctgcagcgccatcgttacaccaaatcattgctaggattcttcagtcccacacggctatccaaatttgttcgttaactaatattgttataattatttattcgctaacgccaaaacaatcatgatgtcaaggagtcagtcactagtctactgtaagagaaagcctgggattaggctagacgggacgtagaatctttctttccgtctccctaaggagagggggggaaaaagaaaaagaaacatttccttcagattaataaaccaatatgttaatatcggttttgacttttcttgatcaacaactgcttccttctcccgccccttagtctaacggacggattccgtcaaaaaggcaatttttctgccttgtgtcatcaggagacttgcaatgacccatctaggaagctcatcagcatctgccgcggttcttccgtgggttgtcggcatgtccggacagggctctatgtgggctggcctgtggattcgggcgtcagaacttgagtgggtgacccgtgaacttgggtaagggatgaagcagggtactctcgcagtggacgtgcccagtttcatcatattactccgattatcgttatcagtcctttctttttgttagcagctccagccggccggaatttggattgcaacgagaaccacggatggcacttctttcgctgcaaccttgattcttgtttggaccattgaactttttcagttccagacaaggggcccagttttgggcggttcacagatagccgagaccactcgaaaacggatctggaatacggattcagctcaaccttcgctcggtagcctcttcaaatgtactgattctgattctgcataagagagatcagatggcacccgggcgtcgcaacgaacgcaaataatcgagccaataacccgtagctcgggctgttgatcttggatgcagctgcaggagaaatcagcagtcattggtatcagatcagcagggcttatgcaggcgggttggttagtatttgtgtttggtttgaggagtactccgttatgtatgctttgctgctctggtggtgggagcttttccgccaccaccaagtgggcgcattcgttcagctccatcgtccggagtctttcggtagagacaatttgtaccgagcaccgaagattttggtacagcaaaaatcaaatccaagatcgtaattagaagtaactatttagtcgttgtaggtattgttgtatctacggagcaaaactacccaaaacgaaggatgtgaaatcacttagttcgggggggtcgccgtccggaatcccgccagatggatttcgcagtcatagtggagtggccctaaggggggttcatttaatcgagccggggcgatttcgttttcggtcacgatgtggtttttgccccccctccatcgtcctctccgtctctcctctcactcataattattattccccttcctcttcctcctcttcttcttctcctccccgttctcgcttcccatgggtcgaggccacctggaactgtatccggattgcctcactttcgctttcctcctccccgccccctccgactagcgcttgtttcacgtcgcctcctacgctctttccctctcgattacattaccatgtccataataatcgcgtctcttccccgtccgtgatcgatctgcgtcgccattgtcgtatgcaagcatgcaaatcgttgttgctagctgtaccagatcgatgacaacccaatcttcgctgccaaaatggatatgatgtcaaacgggcctgcgacttttgcgcctgccgcaacttcaggctccgatcttcattcgactaccagctcgaccggcccaaccctcgctgcgacatctacctcttccctaacctccctcaatgactactccaactttcccctgattcgccagggcgatcgcacatatcttagagaccccgagaataactaccctctccccagcgatcttcaggagattcatcgtcaaaccctgcgctcgctcatgctcatgcgcgtgttcggaggtccgttctgcaatccccacctcactgaccggcccccaaagcgggttctggagatcgcatgtggttcaggcctttggtccagtatgagccatgaatatttcgctcgtcgcggtcaccgtaacgtgtctttccacggtattgacatcgtctctgtcgcccccgatctgcgcaagaaaggtgtccattggcaatatcgcaggcacgaccttcggaagccccgcctacctttccccgacgactatttcgactttgtcttcattaaggacgcaggaatgtgtccagctagcccggcgctgcaagcgtccggcttaagcgagccactgagggtgctcaaatccggcgggattctggaaatttgggactcggattgggtatttcggtccttgcttcccaaccctgcacccgctcgcaaattggcttcaagggaacaagagacggccgatgcgaccgcgacttacaccttttcctccgcaacccccttcacacgagtccagaacaagtttctgcaagactataactcctgggtcgaaaaggcctttgaccgacgcaaattgacagcgttgccgtgtgcgaccattggtttgtctttcaactcagaggtcgacgtactagagaacgtcgatagtcgccgcattgctatcccgctaggcgaactacggtgggagcgtgaaggtcatgggaaggatccggtcggcgcgtcacgcagacagttgaccgcagatcaattgtctattcggcgcacggcccttttgaccgtagttcagatgattgagggcatggagcatatcctcatggaagctagcggtaagaccagagatgaatgggacaggtggtgggctgccatgattgccgatctgttccaaaagggaagcctcgcgaatggggagtgcttggaagtaagcgcttggtggggacgaaagaaatgaacggtctttcggcgaagaggatacaagctcgattgccggtaatctggtgaacgcgggaaagaaaagaaaaaaagacacggaaagagtcgtgaccattgctctctctctcatatattggtgataccccacttttctcctttcagttttcgcatatatatattccttggtgtaatattcttgagaacgtgttattaaggttccatggtattctgaacggccgggatcatttaattttcatagcgctgtttcaaggtgcgatatcgcttcagatagtacctgggcgctttcggtcagcattggcgctgacattgtcgagcatgcattatctcgataattatgagacgatgaatattcggatgtacatggttgataggcaggattaatatagatgaaccagtatcaagccttgcaggcctaggccttggactttcgcatgcttcgccgtctgtagacaaggacttgtctggtgccggcgtgatttgggtaagggagagaaggcgcaagggaactcacaatgcttcgatttctgtagaatgcagctgattatcagatcaatctgactttttgacaattaaatggagagtatcgtcaaacatacccttcttaacaaattccgccctagcaatacctttccggatctgttcctcattatccagatgtgcctggctcgaaaacgctttatgtaacctgttccggtaatattcataacctagtggatagttgcgaccaaggaaaagcaactctaccgatgacagaagtcagctttttggtgggggacactcgacactgcaaaggaatgactgggggaattgtgaagtcctggtgatgcacatacccttgtatatatgtatgacctgcgcgcgaagttctggattcgtcatattggatggtgttgctaggcaatgagatagtggccaggactctccagaggaggtgggaatgtggaggaagtaagttgtttgtctctcagctcgaggaagaagttagccggaacacaactaccggtgacgtcgcacgggcggaatccttacttgttgcctcggaggggtaaccgtccaggtaaacacttctgtgctagctggtgtatagtccagggctttatgatgccaggattgtatgtatgaatttcattggatgatttttaaaagagaattgaagtttcaagatgtcttttgaaccctttgtggttacctctgatgattgtaacgggtggagatatatccgagtgtcttagattacccgagaactcatgttataagatgatgacgttgtagtataacatatcgaaatcaactgcaactttttagttatgttggctaccaggaaggcgcatgaattactaaatgatattcattcaactgtgaaatcataagttgctgagcggtcatattgatggaagtcagacgaactcgttctactagcttcattccatccatggcccggagctgaaacagctagcgtagatggtaaacagtaatgccttataataatacagactaagcatctagatagactatcacagataaagtatccgtttcaccatagggctcgtcgtacaaggcaggcattaggggtaataaataagcaagcaaccggccatgtcagcgcgcggagagagggaagcaatgcgcggggctagccgaagctccaaccgccccggacaactagccgaagtgagaagctcctcggcgggaatcaacacatcctgacaattgacaatcactatcttcacctatttccgaagaatgatgttgtcgcttcagagacttggaaggcgaccactggctggggttgccgctcaatatccaccacttaccactcgactcttctccgtctcaaccgctttccgaaatggccccgtttccgcccccggaacaacaccaaggaagcctcacaccattgatccgcgatggctgaccctgaccaagcgaagaatcggtagatgtatgatgttcggcttgaaacccccgcagattaaagaggcaggggaaatactacagcaaattgcaagggactggcgagaattgatcgctggcagcgaaggctatttgacagatgagacccgaagggggctatttcaacaaagcgtcgcgtggggagagatggtatgataaatagtcacctggtgcatggcagcttacatatagcatgatgcatagatgctaatgtaggcgcttgcatcaaacaggacagcatggtaagtcaggaacttcaagcaacaagtgatgtcgattaactcatgagtctagggtgtgtatatctctttccaagcagcatcagagcactggattgttgcaaggggtctaacattcatgaacgtctaattaggacatgtgaacaacgtcacatacccccgatatgcagagacggcgcgcgtgtactatacccgcaactttgccatgcatatagacccggcccataagacagagtggttgaaccttgtcagctctaagggcatcggacttattcttcgaagtatcacaatcgactacaaatttgtacggtcatctcagctgagatataggactgatcgctaataccccatctctctttgcagcctatgacttaccccgataaagttacggtatatcataagctggttcacgatccgacatcccctgatgcacctcgtcatgggttctatctacatgcgatgatagtctccgaggctcgccaacggcccgctgcccgtgtttccgaggatctggtcatgtatgactacaaggcaatcaagaaggcggagcttccgccgtttgtcatggaacagttcaaatccacctgggatctccaagagcaagccaagaaatactggcaggagcgcatccttgatatagaaacaagggtccgcacattggaaacagagagctgggaccgggaagatgcggtcgaggataccggatctgcgaagcagtgatggagcaggctggtttcccgctttggggcaactttgcagaccgacagatctaagatcgacaatgtacatagtaaatgaggaggatcgagcgtagggcactggcatagattctgctaccaagtgtgtactgtaagcacagggctgctgtaacgtatggaagcttactggtaatatacctggtctaaacggcatactgtatgtgtaatgatactagctgtaatccatcacttcaaactttgagtaaagtgctgatgaggagcttttgtatcgcatattggacataatgctctttgtatatccttacttttatatttttgatccgatataacttgagacctcctcatcacttcccgtctccccccacactctttaaactggcaatttgtctctctagacatctggaatgaggtcaattaacgccactacctgacccaggagaaaactatgacgatcaagatccaaacacaatgcaaatagtctaggttattctgagcacggcggacgtgctgtcctcatgatttcgctaatcattattcttgctataacatcccctccaactgcatcgtccagcctcatgtcagattttaggctgaatcaaggcgacgccgtcaattgctcattatacttcagtatggtcaatagtggcatagacctcggctcaagtagccaagacagaagaacacgtcttgagaggcctatattcaacatggtctctgcaagacgatagagcacagcgagaacatggccattcgggttgacccaagcctgcttgcgactcatgaagcaataatactgacgccaaatctcttcatgctgctgttaatttgcctggagaggatatctgccggtacacctctcagctcgtgcattggccatcctatttagcttcatcaaccatagggaacagccctagcgcaacttacgttgactgcgagaaagttttacacttgtctacaaatcggtcaatcccagattttctatgaaggtgtagcattgatgtttcaagaattggtctgtcgattgaagagcccggttgactcggctcggttgtcggcagctgaaaactactttgcacttgaggccgaagctcaggtccacaaccgccatgtgatgcttggccgagctctttttacaatgaaaactggtacgcaggcacaacgcttgaatgctctaaatcctcgggctacaagcatacgaatgaataaatagcttctctagccatctcgagaagttacacacatagttggtgcagtgatacaggatcatggttgccgtggaatccgattacaatttgttggttcgtcacggcttgacccgctccatttgcgccacagagtctcttctagaccctcccgcctagtgcctctgatcggaagctttcccggatcggtatcagttccagtgtcccagctaattgcttggttttccaagctttgacgccggtcttggatgatgaggctcacgacaggcaaaaacactcacctacgaaaagacacaagtgtatctacatcttgtgtcacactgtaatactactagcaatcaagggtccaataccctgtgttacagccacaacgacacgacaaatggacgggatatccctggtaatcatctgacaaggcttgcggggctcgaccggcaaacccttcaatttagtcaacgcgtctgtccactttagggtagaaacggtcgatcatccatccgattccaaggctagtcgatctctgtccgtgaaaacggcattcaggttaggatacttgcctatcaagctgcagccagcctgataaccagcatatgacgaacattccaattagcctgtgattctagacaaattgcctgagcagtggcacttgagaacatcaaacgtccctacgggacagagtaggagagaagagtgatgattttgctagtgtggagatctttcggtgaattaccgctgtttggtatgatacagtatttcccatatatagttgggcaacagctacgtattggagcttatctaatctcatactcactgccttaaccacaagatgatgtcgtcgtcagtcttcgacaatattccgatggagatgggcaatcccccagattgtcggtgtcaacttgcttctttcttcaggtctcgtgaattggaatttcgatccctttattctcctttgagcagggaaccactggtatgacaatgggtctccttacagcgtgctgtttcggacttggcaggtataagcattacgagcatcatctatcggctgtacaagctcccacgcaagtgtcaactgacaagtccaacgggcaccccatatgactagagagctgggcaggatatgcttatcttgacttgcaagtcacgagccagaagacatatgggcttcttcatatgctcactttgaaatctacgcaatccacctgacagaaagaagataaccaccccgaattatgcaatatagacggcacatatgactatctacagcctagtagctgccaatgagttgttgttgatgatgatgatgatgatgttgaccatggtgagtttgcacagctctgtccagggaatcacccacgcggacaacaaaaagccatcccatgaaggatgggatcgccagatcgtcctgtctagtttgggccctaaagtcctggattacccgataaagcacaaccccgggtcttgtcagtggttagcgggtaagacgtgatatgtagggtgagtgcgtgagaaggaggggtaaacggacattaaatggcgctgatttctgcgagcctatgaatgatggctgcattaggagggtaaggtcaaaatgaacacgtagtccacccccggcttacgaggccggcgttcagcaaccatcagtccataagtgctttagagccggaaacttaagggctgtattgtagatgatcggattgttgctaggcgatggggtattacagctagcctacatgggcagattggttgacatagtttattccattgttctgttgggaaagtcaagtgaagatttgcttttgttgcttgcgagcgtgctaagggaaagagcagcactaactacatgaaaacgggcgtaagttgccttacgctgacaggaggcttagatcccagcagcctgtgtcaggtcgtcgaagaaaggaatactagctgttcgaagcaactagtggctgatattggcccccatatcgatgcctcgagccggtgtcggtgccaggaagcaagcttactcttgaatgatgtggctgaagagccaggtgtcaatttatgcccgtaatagtcctgtttttatggacacggtggtttgagaatccaagcaacttcaacctttccacctagagaagaggtccaattggtccctttagcatccacgatctccgtggctggtctcaacctccagatcgccccaaaaatcggtcgagcgaaagggtatctgggtagccaaccagccaaccggaagacagcgcagtgaagggtacgtcatgtaccgtatgataaatgtcagtaaggaaccgtctgtatctgacatggtatgtatggtaccgtgacaggaaaggggtattttatagaatgcctaaggcatacacggccggattggctggaggttggccgccttgctgccttagcgggattccctctcgacgatccgtttccaacctttcgtcgtttcgtctttttcccgcctcgtctatccagacccaaaagtctaccaaacctcattcatttttcccttctctttcctcccactcccctccccgccaccctctcttactcaccctctcccatatccaatccgattcattctgactttccttttctcaacctagtccttacctctaccgactttctatcccctcttgtcattccttttcccgttcgcttcctgggtgctacctcccctccctttcctttcccactctcaccaccccttcttctcccctctcctccccccccaactcttctatttccccgacgctgtcttcgtcctcaattatcgcctggtccaagtccttggctcctccctgccaagctgactcggacctgggtgttaggctccctcatccatgccacgttcatcggccacggctaggaagagtcatagcaatcggcatgagaatggtctcgtcggccccggaaagaaagtgaacaagcaaaagtccaatggaaatttgaatgggaacaccaacggcgcctctgccccgaattctggtccctccactcaagtcgactggcccgcatctcgctcttccagcgattcagccttaacctcatcggcaaccacggcaagcaaggtcaacggctcggcggacacctcgaaggcggatggcaacgggcgcggcttgctgaatgggtatgctaagggtaacgcggacatgtcttatggccagacgaatggcgccgtgccccagaatggcggacttgccgggcaggcgtcgcggcgaacggagaagccggcgaccggttccaagaagtcgggctctatcaatcccctccagctcgcatcgacgatccttaagtcctgcccgatgtacgacacgatcgccattctgatcttccttttgcagctgccgcctatggttctcactctggttcagttcctctttgcttccctgacgttcatgcctcctagcggtgcatcgtctggctccttgacctccaacttcgacatctttcagggtcccgcaggaacgccttctcttggcacaatgatcgccatggatggattctgcttactcttctggggccttttcatgtggacatgggcgcagaactttgcgctcgatctagctcacgttcaagttgccatcacgctaggtggaggagggtcgggaaagaatggaggggtcaatgccctctgcgttggcattgttctcgtattacatcttatccgcagtaaaggtatacaggattttgttataggtcatctgctctccgccaaaatcgtctcgcctgatttcttatcgcaatattcgcatctcatgccccccgagtttcgccgcacggaaccgcaaagctccccaagttggatgcgcagtctccttgccgttcacatcttggctcaagcaggcaccgctatggcaagaagatcgatggcgaaaaaccggtcaccggctccccctcgcaacggcaagcgcgttgataccgaagcctctgccgggtcgcagacacaaattgattctgcgttcgagtccggggctagcgtatcttcctacatcggtgccgacggtcaactcgttacgccagcaactcataaggatggcagagatagactcatgtcggcaaagaaacgcagaaggcaagccaatcaggtccggagccgtcaaccgttctgggctgcactcgcgagcacgaaggtgacggtgatgagggaatacgagcattctagggccctcaacaaaaccggcagggggcttatgatgacagaggaggatcttcagggcatttcgttggatgatggacttgtttggataaccgaagtcgatagctctactatcaagtttgccgcgggtgacttttcctccgtcgatgatcccgcgcttgccggagtctgtgaaactgctcgtctgggaaatgacgaaacggaacctttctacgtctgtgttaacggcgccttgtgggcaacggcaacgattaccaaggtgcaggatgccccgaaggggtccaacacggtacactggcggggcgaggtctcggggcttgctcctaactgtgcctacacttgctccttcgtgcggagcgatactgatgaagagatctgtgtcatgagcgtcaagacacctgctgcaactgacgcggaacaaggtaagggaatacctcgtttggccttcggtacattcgaaacagttggctcacattggccaccagcagtctcttcgatcccaactcctccgcaaccgtcttatcgtccgtcatcaccaaccactacgctcaagaactcgatcgttaacgccgaggtcaaactaaatgagaaacgcgcccggttaaggaaagccaaaaacgaccacaaacttgtcatctccaagatcaggaaggaactggataactacaaccatcgtctgcagagtggtaccgatgagaaccgacagaagcagcgctcgttacaacttgagagaaacattaagcaaaccgaggaaatcaccgccgctcttgaaagccaactcgacaatttggagaacattcctgaggaagaactcgaagaatggtcgacccagaaatccaagtacgaacaggagttggaacaactcaatttggctaaggaagagctcgtttctgctcgggccgctgttgctcgcgaagtgtcgtcgttggagtcggagctgaactcggccatccagagaaaggaacgtcttcaaggccgccgtaccagggtcaatgagcaatacgagcggattgtctctgccaacgcccagggcttgaatgagcgagagcgtcgtgctgcggaacagttcgctcgggagcaggaccaggcgaagttggaggccaatttccacgagcagtttgcgagcatcagccagtccgtacaggaataccaggtgcgcaccaaccaattgtggcagcaagctgctgctattgagcaagccatccagcagcagcaacagcagatgcttttggattctgccccgcttactcccgaaggtaacctgcctggcacaaaccctctgactgaggcacctggcatgtctttgggagcattgacaacgactgcgcccaacactcgatctctcctgggacttagcttcccgtcgctgaagtctagtccgctgcagcatgcctcgtcccctgttggtgctgcttcgtctcatccgactagtccgacacagccaccgtcttacttgcaacacttcccgacttctccgcttggtaataccggcaactacttcgatatggattttacctaccgtgaccggtctttttccaaccgatctgcgcacagcagtctctacggtgctgatttcttggactctaatcgtcggggtcccttccaacttgacctgtccgatacggtcattgagaagcggatggattcgggctccgagggagtgactccaaacccgatcatgagacccatttccaccccttttcagcgggccgatagtcgtggtagcggaagtggaagcggaagtagcggtgcaagcggtagtggaagtggcagtcccagctcgacgggtggtaagggcaactaggcgaggtgaagggacaagtctgtgggttctccccacgagctccatttggcttgttcccggttgcgttatggttccaattcctgcttggtcgtattcatcttcagacgtgatgctcaaggttgcatggtggtttacctgcttcggggttccttggcccagacaattccacggtcaccgtgcgtctttcgtcttggtattccatcgcctgtgaacaaagaaatcttgtgtcatatgtagagcctattcataatttgccgaaaagcctgtttctgcacatgtcgtggttccagtgtagatgttccttatatggattcgtagataacataactcaccagttactcgtaactagtatctaaaagcgcctaagttgtgttgtcaccggtagacactctgaatgctccgtatatatatgtctgagcgtcaacgtagtccttgactcaataagtgtcatatgataggtatcattgtacatgaatggtagacaacgacccggccaaatcccacagtcccgcagcgcaccttcaatcaagcccgtcgccgactgctcagaaacgacagacaggataaggagaaagaaaccctccaagcaagcaggacaccaccgaatcattaaaaccgcaaaaaaaggcagtagacgatagacgtctatcagcaaaaagaagatacgcgacacctctgggactcgaacccaggcgggcgaacccacaggctaaacagctagtacaggtatgtagtagcaggcctgcgccttaaaccactcggccaaagtgtctgattggtagattccgttctaggagtttgtattatggatagaaagacattgtcaccctacattcaggtattaaatctatagtatataaatctggacgtatatttatacaggtatagttatgaaaagctcgtccttagagcatcaaagatgctggaagagatatgccgtttcaagccttcatacattctgacaaaaccacagtagatgtcatcagttcaacggttgtgggagtttggtaggctccaaaagcaggcattaactactccgtgctatgcccaataattatacaaacaacactttccagctcccttctagattattgacaaagacaaaaagataaaacttatggcacgtgttaccaaagcagacactttctacacaaaaaaaattaaacgacacctctgggactcgaacccaggcgggcgaacccacaggctaatcaactagtacaggtatgtagtagcaggcctgcgccttaaaccactcggccaaagtgtctgattggcagattttgtccttctatagctatatcacacacaaggtattttccttacttttccgaggcgttaactctatgacatattagatgtgaaggcaacttccatggatgcctatctaaaaacccttatttgggaaaaggcatcctagacgctgtaagcgatgtacaatgtcgagtcttcatctattatgagaaacctatagtagtagaatagctggggaggggggtgttgggggtttgacaagccctgaaagcaggcagtagctccttcgtaggtacctcaagaactacctcttctacaagaggaacgaaaaaagttagcacatagcatacatgcgcaaaggtacacatttgccacacaaaaagaaaatcgacacctctgggactcgaacccaggcgggcgaacccacaggctaaacagctagtacggtaaggtagtagcaggcctgcgccttaaaccactcggccaaagtgtccagatctgataatttggtgtcttgaagcgatttggagctgtacgggcggagcgagcagtagcatgggagttcaaactagttgggggtaaactttaattgatcttcccctgggacgttcatgtaagtgacctttatctcgtagttttcagattatttgaatgacacgttctatatatccatctctcttgcagattgtgggagaagagcactgactaattgggtcgataattccacctggtaggccgataactgcctatttatgtgggcttgtttgtacttccggagtagagtaccatggcacatgcatcccgcatacactcaatcatcgctgctagggtcatcacgtacatatatgtgcagttagctccaacacatgtaggtatatgtaagaggttaatataagccaagagtaactagctactcccttccagtgagtgcaaaattagtcccattcccactatcgctcacgccatgcacttatttaccttcaggatagagagtcactactgacggcctcgccaccatccaaccagacactttggccgagtggtttaaggcgcaggcctgctactaccttaccgtactagctgtttagcctgtgggttcgcccgcctgggttcgagtcccagaggtgtcgcatctcatatcttttttttagcctttggcgttgatctgtcattgaatgcctgctgatcttttgctcttggggcatttggttatatatgaaaggcctcgaaggaccagccaggtattaattgtagcaacccgatttcggaggtcaatgatctcctcgtgctttgaaactacgctaagggaaatgaagtattgctaatcttcaggtaaagagctttattgaacgacggtgatgcgagtgttaaatcttcaagtatctaggtccagaataacagtttatgagccaagtgttcgtactacttgatgcctggcatgttagagagagctataagaagacaaactggagacagcaattggataacctgatgacactcgaccaaaaagacttccttggaactcatactaaacgcacaagagcctccacgatctctgccattgcacgagtatcatacgatgcgttgtgataatttcgggaagccatgttttctttgcctcttacgaggtactccttgactgactcgagtcgccttgagggaaggttgggcaagagctttctacatagatcaccaatgttgattgcttggaaattcctagatgtcagatgagagatcttgccgtggattaactcatctttccctgtaagtatcctgaggaaacattgcatgtcttgagcggaaaaccaggatagtagctgtacatcactttgactatagccacggacgtttttgataaattcgcttattctggaagggggttcgccattcgttgtcagaccgccataacacctcaaaaagagcgtccccatcatcttatgcttattagagacgtggggagagacggcttccaggagttctctcatagacatgttgtaatccacgtttcccgcataaagtagttttccattaagctgtctaactgcaagttgcagcggaattggtgagtatttagctggcatcgagataaactcgaagtcaattatccaggttctctcgggacgcgaataaaatcttttgagctgtagcaaagctccccgcgtatcgtctgtaatagatacctctcgcttaaaggcgctatctgcaagtagattgccaccagacgttgagccagacagattgtaagcatgtctgatgagcgctctggagtgataaagacagtaatatgaagcaacagaagcctgagactctggacaggtatagaacttgcatcttcgctcctcatcaacgaactccattgattcctccaggctcagcttcagtgcatgcatgattttgctgcgaaagttccgtccagaggtggcagtgatatcttcatgtttgaatgacttttcaatatcttcaagtcccagtttcggtggtaaatgaataccagaagcgtcaagatggtgtgaggatcgagctaggatttgctcatcagtgactctattttcgagtatgaaatggctgagcttgatcagctggaaaggttgcactggcatctcagagcaggacactcgaggtgccttctctaaaattgcatttatcatgaacctgacatttgtatacctgccatacattgggcttagtggcaatccaaatcggtagctggaatgtaagattgtgctgtataacgtccaggttggagcaaaacggcgcggcctccaggaagatgtctgtaagaagagcatctcaacgtctgttatgtgaaggaccggactcaacctaaatttcgagtatataggctgtgagtctctgtaaaacttttgcatatactcaaccacctgctctctgctgtcaacgcgcttcctctttcgtcctttgcactttaacaattcgtgatctattgtccagccttggaggtacagggtgtcaggggccatctcatttactactgcaccctttagagaaattgacaacggcagtaatattgtgataccatcttcgaaaacaagccagatggcccaatgttgtggtgcgcctcgaaatggttcgttgtaatcaaatccgacccgaactggaattgcggattcaatctgagtcaaaagcatgagtataagtgaggactttagtataaaagctcttgatacttactctaccgtcttgattgatcatctgctgacatatgaatgtgacacaagaccctattccagcataacatggatcatgcgatggtgagccgagtcttctgctgtcataactaggagcaagtttatacaaccttgagttaatgtattgcacccttggattttctatagtcggatggtgcatttgtgacgtaatgatatgggtaacaccaccgccagcacctgaaacctgtgatggttgtttcatgctgtcaaccgtggctggtacacttggatgacctgggtgtgatccttcttcccctaggccgagaaaatggtaagcctctgcgaagctcttgagccggccaaggcgtcccccttctatcccaataaagggaactggatgctcgtgagggtgtaactaagatgataagtaatagttcgacaagtcgagtgacaaggatacgtaccctataaaattcgcttcgctgtatgaaatgatgttgaaagagctgttgtggcaacagcctaaggaaggcataattatctgttccatattgatctgatagtatcgagggtggggccctgtgcctttctgctcttgatgatccatgtttcatgtttgtaattttctgcgtctccgtaatccatctctgcagtgtgcctctagaaatgtggaggatttctgatgcggtagatattgagattggcctttcctgaccagtaatgggatcaatgtgtttccgtgtttgacagaactcgatcgcatgcagtctgtcttctctcgagtatatcttaaaagtccgtttgtaaagacgacgtgccagccttttgtttcctacactctcaagcagagaccgctgggagtcatcaagtggtttccaaagaacagaatcactctcctgtttacaatcagaggttcctatcaagcctggtgcttgtggtgcttgtggtgcttgtggtgcttgtggtgcttgtggtgcttgtggtgcttgtggtgcttgtggtgcttgtggtgcttgtggtgcttgtggtgcttgtggtgcttgtggtgcttgtggtgcttgtggtgcttggaagtcagacatgatgagataaagtgatcctgcacttccctgataatgaatcattaaacagatagtttataggctctgaaggataacaccataacaccaaaacacgcaatgaaaacacaatagtcatgtgactggcccacgcagtgaagggaaggccacaaaccccttctatgactatgacatctgcttagagcgtcgatcacttgcttggtagtcagacatctgccttaatctccgttcatcagctttcaaggcttagatgcagcgcctggcgcataacccttatcaccattcaatagattactaagctcttcctgatgaattacatattctattcttgatcaatgcttgaaaagatatagataggctcgtagctgtagctaaacctattgatgagattttctcgctctgttaattagtctgcctcttaggaaagcttgttttcttgtatatctctgcccaaaatccaacccgtaactgatataatcccgcccacataaaggttcatacttatcggggaaagccaaaagacagttatattcattatcgtcacagtcggtgccatctctgatacacacaatcttatcctgcatgattgtttccaacttagccattgttccattgcagaagaacccgtcttgcgatgaaatttttgtgcgaagttgttcggttgatagtatgctttgaagaagcaaatcggttatgtcacagatctgccaagtatcaccgtcggccacaattttcttgccgttgaaaatgtaggaaacattgtcgtttccctcgagtagctgtgggaaagcgagcacgcctttcttaatccagtcatgcttgccgggctccacaacaggatcgaactccatgcggaaggatactgtttggtaaaagcggaaatcaggtcggatccttgggtcaacgccgaacttgatcaatgccttcttccatggaccattggtgaacatgtaaccgcaaaacggcagagcttcttgaaggtcgctctgaagacgaagctggagttggcctttgatgaccctgactgtcactatcggccggcgctccaggatttcatggatatggcgtaccgtttctctaacagactcattcaggactgatgatccaatcttgtcaacctggtggctgccgtctggtatcttcgcggcgttcatattgacggtgatacctgtaaacgctacttccctattgaatttgacgctagcctctatatcattgccggcttgattgggtccatccatgagattctcatcggtcgtgctgccgtcattgtcgtcatcgttgttgtcgtagtttgcgtttccttcaaaagccatccagcccgatgtctcataataataatcggctccaaccttgttgtctccgtactcttgtttgcttccaatctggtattggcgaataagctcctcgccattgctctcgccaaggctattgttgaccacatgagacgatcttctaaagctcatggtgaacagtattgttcgtcaaggattgttggaggccctggcaaaagctgttttccaacgcaaggagcattgcaatacacaaggtggctcaatgggattagtggataggatggtaggacttgaaaaaaacagtcgtttggcttgtgagttaatgggaagcgtaagacaaccctagagaggtgtaaatacgaagtgaatagtagggcaatccgatagcctacgcgctgccactcaatcaacatatggagcctccctcatgcgccaatacgaactcgtagaggagtaatggtgattatcataaactatacaaaatatatacacaaaatcggtcatattgcttaacatgtctatctatatctacgcaaagtgaacatctcaggtgctccgagaccttctgtgaggctacgcgactgtctttacccgataccaaagaggtagtcttatgtatgatgctcacatgcatatggtaagactgagatcaatggtgaaataaatctatgtacatataatggagatattgcttgcgagattccgacgaaacccaggatatcaggtatggataatatacagaggtaactcctcgagaagcttccttcactctaacagtatggtgtgtatggcccgtctctagagcattgggtgatttatggggagagatgcttgagtctcacgaattccacatgccgtctttcatatctcgtggcccatttcccagaagtgggtattggcgtacgtgaggcaaaggtctccagccttagtctccaagtcaaggctcaacaactcccctgaaagtgcccgaacaacagttcccacgacgatcgtatggtcttggacctgtatactctgtggatggagctgacactccaatacgaacggaaagtcctccgatcctgtagacgtagcatcctgcttcctccgcaacagcggaagaggcctgccggaagtttcattaccagaaagggaatgttcatgcgcaacgaactcatattcactcttcccctccaagagggacaaattgtggttgcccttggaaaagtcccgcgcaagggtagcggttgcctgtcgaggagccaggaggtgcacaaggaagcgcttggacaattggagtgcgctaagcgtctcggagggccggcgcacgttaaacgatatgacgggttccggactgagtgtaacggtgttgaaggaggagacggtcattccgcggaaggccttatctgccgggccattgggatcagtggccgtgatgatggcgacagggtaggggactcgtctcatcaagagacggacttgatcggataaagaggcgacatcagtatttgcatgccgagcccctttcaagtcagattgagggtttctagcggctgcggcgactttcgtgaccgttcgggattgcagttgaccgaaccggagagctggtccgatagatggtacatattgccctttacatgaaaacaattgattagcgaatgcaatttgcaggcatggaaagcagcgcagctaacctgtgaattggcccaccgtccgacaggccgcaagtatagatctagtataaggaagcattattatcccgcggcggacggagctcgcagctcacggaaagacgggcagaagaacagaggagaggaaagcaacagaaagactctcggagccctccaaagtcatcatgaagacgcagacagaaatccctcagcggttcaataggcaaccatgctagccaccagaccgtagcacgttaatcggtggttcaaatagagtcgagttgaaacaccgcgacaagaaaaagagcaacccacgggatgctgacataatccccgtcgttccgccccgaataatttgtctttggccagagacagactggaagatcaccgcagcgtcgcagtctccagtccaattctcccacccaggccggtatattaaatcacttcgcggacgtcctctcacttcctaatttctctcccggccgcggaaaaaaaccatgtccctcagcactcccctccgccgcaccgcggccaccacctcccgtgtccagacctccaccaccttcatctgctcgcaatgccgacatgctactctccttcgtcgtcctagacgcccttaccaattcacccagctgattaccctgaccgacggcagcaccttcacccaccgtacctcttctcctcttcccgtttaccgctcgactcgtgacacgcgcaacactctgctctggaacccgacttcaagcaagctcaagagcgtcgaggatgatgaggctggtcgattggcggctttcagagctaagttcggtcgcagctgggatgtgaacacgcctctggaggactcttcgaagacgacggacaagtcggcacaaagtaaggaggcagctgctgcggaggccgctgccgctgctgaagaagaggacgacaacctgctggatttgatcagttcgtttggtcaggaggagcaggaggcttctcagaagaagaagaaggattgattggtgggattggatcgtgctagggtgtatgtatgatgggtagtgagggcgatttatggactatttcccgtttttattttcgatgttgttgttatacgatacagatcttgttcggctttatgtacagtacatcataccatttgaatggagtttcagcatcggtggttcaagacttctctttgtctgagtgtagccattgcggtgtctataagttgttgtggataaacgaggttgaagcgattactatactacattggaggagccattgatatcagggcgctgctatagtgatccatcccattgaatacgtatgaacgactcgccctaagaaaatgaacaaacgtgcgccgctcctctcagtaagcaggcaaagtgataattaacgttgggtaataccgcaaagcggagggtggaggggacatcaacaagtcgtcgcttttcttttgtacagtcagactggtaaaagaaccgcctatgcctcctctgctggagtagcttcggcggtgtcctcgaccgcagggggtgcagaagcatcgctcactcccgcggtgccgtagagagggtttccttcttcacccgcatccagctgcaagaggaatgtttcccaaagctcaatcaactgcgagatctctattagcaaacatttgtgacgattggaatacctggcatgtagctgctcacctccttttgcgcttccactgcactctccaagaaggtctcaacgccagatttgaagtcctccaccttctccttctcgaatcgttggagctcatttcgcataagtcgacccatatcctcgaagaggagtcgtgcctgatgaaccttcctctcggcatcggccacatcggcattgacttgggtcagacgatcctgctgcgtcttaccctgtctgagaagcttctcttgggtatgtttgcgcttctgcatttccgcttccgccgcgtgccagctgtggaaagccttctggcgctgagagaaggccgtcttcacacttccaatcaaacgaagatactcgtcgattgtgattcccagggtgagaacatcctgttgagcttggcgttcgtatagctcccttatccgtagttgtaggtcggaaagaccgtccagaggggtagaaagtgcaggagacagctcgacagctgccaatgcatggagggaagccgaaaagtcgccagcagcctcggccagccccttgcgctgcgccaccactgtgtcaaccgacttcatcaatgccttgagttgattctctagggcgtccaggtagatcttgcggtcatgaaaccactggagttgtcagcactgctacccgcttgcacttgtagacaaacttacatcatcatgctcgacgaactttccaccgccaccgacgctaatgccaaaggaactgaacatgcccttgttctggccaaggtccggttccctgttttccttgttcttcacgtccatggtaaaggtttcgctctcgaggaagattttaagatcgccgtcatgctggagaatagggtgcgccgcaatcttgttcagcatccgctcaagggcagccctcctagactcgacgaagttcgtatcgaaacggcccaccgcttgcttctctggaggaggggggacaacaacaccggggttattgttgtgcatcgaattatagagccaaaggaaatcacggtatctgcggctgacagtaaactccggttgtcggtaggctttggaggtcgtctatatatagcatgagcggagtcctacggcatcccaccgaaatgacataccttggttctcacttggtacacaatatgactgctggtgagatctccgaccttgtgcggatcgccgacagtgatatcgaaggtcgggttcgcagctttctccacgctaatactgggttcggattgccgtttcgccccttctgcgtcactcgggggttgtaccggcggaggccctcggaaccctgcaccatcctcttccagattcacggaatccgccaagccagttcctgtggacgcttgggaggcagatgatgtgggacgaacattgcgccctgagaagacctccttctgcggcggggcaggtgcctgctcaagtggactagtttccgccttgtctccgagcggaccaagaggatcaaacgagtcatccaccgcctctagcttcgtcgcttgcgcattgatccttcgggtgcctcgtgggcctcgtcgtacaggggaacggggggcactggggctagcttgttgtgtcgattgatcgggagctgaggagtgtcgtcatcgggttagaaagctcggataagaggtacagggatgcaagatgctcatttaggaacatacacgtttcttctacttcggatcgggatgcttgatgggtggtggtcgattgtgaaggcacgtctgcatacctgcgttagacgaagcacgatgcgattgtatccgtgactgcctggttgcttaccgccccacggggagtcgccagcgtcgagatccatgacagacgttggtatcaaactgggataggttggaaatcaagaggtatcaattaaggatagaaattagcaggagaaattgaaagacagcgtgaggggttggggagtggccgcagtcgggggagttggagggagcgaccaggttgccgtagtccgatgatccgcgccgttgtccaactacggattagggttcccccgccaagctcgatggaggaccttcaggctgacctccattcgaacttgcaactcttcccattgtttaactaaaaagacgtccttcctgcctatacaaacacatctgagattctgttcaatgcttacagtccggtgacttgagcacttggcgaagaacacactggcctggtggatgaataccaatcccaagccagtacattccccaagatatatactaggcactcaaattccccgtccccatttcttacaaaaaagtactagactatagtatttcacgtgaatcagttgtttatttcatatgtatcgtcatcatagccgtgcggcccaagacagaagacctccaactgccggactccaaagaattgagcgtttcagcgaacaattccttcaaactacgtttctttcacccacggaaggccaagcttgtgcatctcaacagcaagctggaacaggtagtctagactctcgcactgagtcttggctttgacgacgtcgtctccccacacataactatacacacacatgagcccgccgtcactcgaaagttaagggttaaaaaaatgaaacttacattccgtgtctccgcacaaggacagcataggtgtcagggtactcctccatcgccttctccaagcttcccgtgagatcttcctcaaacgcggtgttatcaataatcgggatacgaagagtatcgtagaaacccatcatgcccttgccctttccacggggaatacccttaatctgttcaatgttgctaatttcgaagtaggcgttcgggcccttctcgcgctcaaccaggagggtcaccaggaccgcccactgagaatgagtgtggatgcagcagccagccccgcgctcaaaagcggcaaggaacagtggcgtgcatgccgagggcttcaggtcgagcggcttgcgaatatatttgcgatcggacggaggatacttgggcgtagggaattccaagacaaagatgttgtcggatttcatcatctccttctgcacgccagaaggagcaatgaatatatgattatcgcgacgaatggaagtctaatgcagaaataaatagtgatcgattagcgattactcatgatcgtcctggaggtgcaacagtgcttaccccgccaccagtaccggtgacccagccccaattgtagaaccggcgacagagatcagggatcaagttggcgggatgctcggggtcagacgactggaccaaatggtcattgttctctttttggatttcctgggccatggcgatggatattgcgcgtggttggaagatcgattagataggcacagacagctcggggcgatcggctttagggtgattgtcacgtattctcaagcactaatcctgcagtagatcttccctaaatctgaagataggagaaatagatctatatattgaaaatacagcgacagtgccttggacgtcgtacaggtgaggcaagaggaggtttgacaaaaaaaaataaaaaactgtcaggcggcggggaggggaaagcagaagcaaatcacctcactaacgcctttgggtggattaaggtagcggggggagtgtgttcgcgccatcgccgaccattggtggacaagcaacggaagaggaagtaatctatctaaacagcgtgaatctgtgtaaatcacaatccccagggaaaggaatgaccggatcttttatgtggtcatttgcaatgggccacaaggtccttacttgagttactcatgcctactgcagagattatgagctgctgagaaagagattacatatgttcactggaattcaattccatgaactgcaattcttctagactttgggtctactgactaaattaaatacatcccgaggaacggacaaataccagcagccgatttgcacccgcagaacattggagaagcgcgactagccagatcgggcaggcgggacctttccacaaggagcagcggcagcggaagaggccaccttgaacttcccagcttcatgcatcgccttgcgtcttcttatataaccactgctccaacggttcccttcttcctcttctccctctccctttaccttccccgtgcagctacttgactgttgagcttgccttcctctccctctttgatccacccttaccctctccggaggttcaattgctggtgcgctctgttcgcctttgtttgttttccttcccttcctctctcggacgttctggttttaagagcgccggtcgctatccaccatgcgtttcaacgctgctttgacttctgccctggtctcctcggcttccatcatgggctatgcccatgctgaggagaccgagaagaagcccgagaccacctccttggccgagaagcctaccttcaccgtgagtaattctgcagaatgatatgaggtgctgcccgcgccctgctaactgcgtgcttccagcccacctccatcgaggctcctttcttggagcagttcaccgatgactgggactcccggtggactccctctcacgctaagaaggaggactccaagtccgaggaagactgggcctatgttggtgaatggtccgtcgaggagcccactgtcctcaagggtatggagggtgacaagggtctcgtcgtcaagaacgtcgctgcccaccacgccatctcggctaagtttcccaagaagatcgacaacaaggacaagactctggtcgtccagtatgaggtgaagccgcagagtaagtgtgacaattgctgcgcatgctgggtgctgggacactaacgatagtcacagactcccttgtctgcggtggtgcctacctgaagctcctccaggacaacaagcagctccacctcgacgagttctcgaacgcgtctccctacgtgatcatgttcggtcccgacaagtgtggtgccaccaacaaggtaagatcttgctaaacgctgcttagtgcaggtgactgcaacagggactaacagctctatcttttttaggttcacttcatcttccgtcacaagaaccccaagaccggcgagtacgaggagaagcaccttaaggcacctcccgccgcccgtacctccaaggttacctccgtttacaccctggtcgtcaaccccgatcagaccttccagatcctgattgatggcgagtccgtcaaggaaggttccctccttgaggacttcaacccccctgtcaaccccgagaaggagatcgacgaccccaaggacaagaagcccgccgactgggttgatgaggccaagatccccgaccctgaggctacgaagcccgaggactgggacgaggaggctcccttcgagattgtcgacgaggaggctaccattcccgaggactggctcgaggacgagcccactagcatccctgaccctgaggccgagaagcccgaggactgggatgatgaggaggatggcgactgggttcctcccactgttcccaaccccaagtgccaggatgcctccggatgtggtccttggtctccccctatgaagaagaaccctgactacaagggcaagtggtctgctcccttgattgacaacccggcctacaagggaccctgggccccccgcaagattgccaaccccgcctacttcgaggacaagactccctccaactttgagcccatgggcgctgtaagtgtacctcttaattctaatgctaaggctttggatgactaatgatgatgcagattggtttcgagatttggaccatgcagaacgacatcctgttcgacaacatctacgttggtcactccgccgaggatgccgagaagctgcgccaggagaccttcgatgtcaagcaccccattgagctggctgaggaggaggccaacaagcccaagcctgaagagaaggccgccgaacccagcgttagcttcaaggaagaccccgtgggccacatcaaggagaaggtcgacaactttgtccgcctctccaagcaggaccccatcaacgccgtgaagcaggttcctgacgttgccggtggtcttgccgctgttctcgtcacaatgatccttgtcatcgtcggagccgttggtgccagcaccccggcccctgcccccgccaagaagggcaaggaggctgctggtgctaccaaggagaagactggtgcggcctccagctcctccgcagacactggcaagggtggtgctaccaagcgcactacccgctcttctgccgagtaaagtggtgcagctatcggtggaacagcacgcagggaagaaagggggagagtttaaaaggcgaaaaggtcaaacaaacaaacaaaccagggatatcctaactacattgtgtttttattttatacctctgttgcagcgttcaatcaatgtttcattctgattccatggtgagaaggccagctgggtatcagctgccgcctatacaaggaagaggacaagcagacctcaattggggggtttctttgggaggttaatgcaagtgagatgtgtaaaagtagccaagctgcagaattctactgttggtttctctagttcacggaatgatctgatagttttgtgactttccaagcggtgtcacatttttgtgaccgatcgtctgggggtgcggagtccgaggttcctgtacaccgtcatcggagaagggccgacaccagcctgttattcgcacaggagtggccatctccgcaaagagttgaatgtaaccctcagttcccatcaagagcatatttagctactatacagggactacctatggatagatcgtagtagatgctctctccaggtcagcgagctaaacactaagtatgcttcgagattaccccatacaatgactggattgggcaggcagttccgggtgaccatgtgattggttggagacgccgagcgttatcagaacctcggcggaaagcgcatcaatacggggaaagtaccagacccagtatgaacctggtacctgaacggcctccacgtatttatctactttgcctcccttcctgctgtccacacctcctcccccttgaattatttcccttgctcttccttgtgattcgggctttcttctcaaatcattgtcctcctgaccccgaacatccatctctcacgtttcttatcttccatctttcaatcatggccgcccgtcggtctattgtccgttccatccccgctctccgcgccgcctctccccgcacggccgtggccacctccagatctgtagctgcagcttcggcctcgaggcgcctttctactgttataatgccctcttcctcttcgacaacttcttctgcaacatctaagctctcctcatcgtcacctgccaccatgtcagcaacacgtcgactccacgctactgcccagcagttcacccccgcaactacctccgcggctactaccgccaccgagtacccgacggaccatagccccatcgccaaccccatcgacaccgccaatttcctggacaaccaatttgttgcttctaaggctactacctggatcgatctgcacgatcctgctaccaacaacctcgttactcgggtgccgcaaagcaccgatgaggaactccgtgccgccgtcgagtcggccgagaaggccttcccagcctggcgcgcaaccagcgttattgccaagcagcagatcatgttcaagttcgtgagcttgattcgtgccaactgggaccgacttgctgcatccatcactctcgagcagggcaagacctttgccgatgccaagggcgatgttctccgcggtcttcaggttgccgaaacagcatgtggtattaccacccagctaacgggcgaggtgctcgaagtggccaaggatatggagaccaggagctacagagagcccttgggtgtggttgctgccatttgtcctttcagtaagtgatcctgcatccgtcctgcaagctaggtgacattgtccgacgctaaccgcaccccctcgccttctcggcagacttccccgcaatgattcccctgtggtgcatccccatcgctaccgtgacgggcaactgtctcatcctcaagccatctgagcgggaccccggagctgcaatgatcctggccgagctggcccgggaagcaggcttcccccccggtgtcatcaacattgtccacggctccgccaagacagtcgatttcatcctcgacgaacccgccatcaaggccatcagcttcgtcggcagcaaccgcgccggagagtacatctacacccgcggctctgccaacggcaagcgtgtccaggccaacctgggcgccaagaaccatgccgccgtagtcccagactgcaacaagaaccagaccctgaacgccctcgtcggagcggccttcggtgctgccggccaacgctgcatggccctcagtacggtcgtcatggtcggcgagactcaggactggctccccgagatggccgaacgggccaaggccctgaacgtcaacggaggcttcgaagaaggcgctgacctcggccccgtcatcagccccgaaagcaagaagcgcatcgaagacctgatcgccagcgccgaagaagagggtgcgaccatcctcctcgacggcagaggctacaagccagagaagtaccccaacggcaactttgtaagcttccacccaaacccctttccccgtctcctatccagctacatcttttatctaaccagcaccaaaaccacaggttggccccaccatcatcaccaacgtaacccccgaaatgaaatgctacaaggaagaaatcttcggccccgtcctcgtctgcttgtccgtgcccacactagacgacgccattgagctcatcaacaagaacgagtacggaaacggagctgccatcttcactcgctccggttccacggcctctcgcttccagaaggacatcgaggccggccaggtcggtgttaacgtgcccattcctgtgccgttgcccatgttctctttcaccggtaacaagaagagtattgccggcggtggcgctaatactttctatggtaagcccgggttgcaattttacacgcagcagaagacggtgactagtttgtggaggagtgaggatgctgttagcactaaggctcatacggttatgccgactcattcgtgagagattgttttccaagttgcatcagatatgattgtttcttattatgaaataccatttagttcgtgttttcggggtttctgattgtatgggattgttttaactcaattgcatacctcaaattgtctctgcttttgtccgcttatacgcttctcgcgcggatgtcattggtatctcctaatctgatatcatcgtacctcggtctggacaagtggacatgtgatacagtacggccttctacattacgtgactaccatacatatgtggaagttttacgaagagtcttaggtattgaaacctagttttctagggaacataatgatatttcaatttgcgggcatccctagtcgaaactagtgcggacagcatttctgcagtcacatcttgcaatggagccctgcctctagggttttagtgttagggcagtaactaccctgtctgccatgcatcctctccatgatgtatgccagcttgcgaacaagagcgtctcacgtaggatgcccttactcagcccgcggcttgacgaagctgtagactagccgggccagcttgtaggttttgcccttgacgacagcaacacggcgagtgtaatagcgcttgccgtcaatgatttcgaaaccccaaacctgtttattctgcgtcaaaaattgtcaaaaggcgggtaatatgaagtaaccacgaacctgttcagcagtccagccgctatctaggttctccacaaagctggaataccagagcccctctccctcgccaaattcttcaccagtttcatcgacgacaaagccctcagacggacttccgtcggctagaacttctcctctaaggaatttgtagacctggggttcgtcgatcttggtctcgaattctgtataagggcgcacctttccgtcctcgcccttagagccccggaagaaccgcgactgacctttgaggtgaccaaagatgtggtcatcgtgctctcgtaccttattgtcactaatacgcctctcggtcgtacccttgatgccaccggtgacagtctggtcgatatcgatgtgccatacagacggctctgcggcatcgggatactcatggatggagagggttactgttgcgacgctaagagctttacgcatgagccaactcattccttgctatgacacccacggcagtatgttagcaagacagttgccgccttgagtcgtatacatggttgacttgtagagcccacaaatgggctgtggaacttaccaactcgagaatgggctctgaggggttggagagggttttgtcctggaatgaatagggtcagtagagatcttacgaaataaaggaacgggcatcagtaccattgtccactctccattgaggttcttaaggttgctgtctgcgggggcagccatggcgatggtacaatgaggggtgagattgataagatacgagactggaaagtaggcggttatatgtaagaatgcgtgatggggatgatgaccaggacaacaattggtctggtcgcaagatgattaatgagaaatcggcgatggtcgtacaagaatgagttgggggagtggaaggagaaatggacgtggagcagcgccgacaatctgactacttatatgctgcaggagttactagatggggcttcatgtgatgggctccttccatttctatcgcgggattgtgacttccgccgaggcatctgacacgtgccaccgcctatttgatgttgatttggcgactggcattctggagtagtactactagtagcaggaggtgcgcaatagttcaccgtgatggtagacgttgctcccatttggctgagatggtgtcatggatcgacgactcggttgcggactatttatttctaaagtgtaaataatggtccggagtatttgctgaccgacgagcacatcctagtactattactccacgtagtaacttccttgtagaataatgtcatacctatagtagttatatatatatatatatatatatatatatagattatactattcaagccaattcagcaactatgtccttgttccatgacaggcaaacacaccgcttcattcatggtcaggtacccgtctttttgatagtttggttctctcccacattatatctgcctcaggccaccaatgatgatgcccctttcacgtgcccgcccgcggaggagccccaaacccatcaatcaatcaatcatgcttctgtaaatatacccagcctgtccttgtctccagtcggccattatcttgctattagaaaaagcaattggccatgtctttcaataggaagtatgctggtcttcccgacctggtacgttacatctaccatacctccctcctgccccatctcaatcaaccgactactaacatcgtttgtttgggccaggatctcgctccggatatctacgagacccccgatctgaccgacgaagcatctaccgttccggttagctaccccgcctcacgcctgcgtctgccttttccaatgcttctagctgctcatccttgacactacactctatagactacaactatccgcaccgcatccaacgtagacgatgacgccggctccaactccgacatcgaccggcaggggatcaatgcagacgaggcacgcgcccacttcttaggagccacggtcgacgcgcgcgatgtcaacttctccgacagtatcgcgatgaagcggaaggcatacaagaacaagaaccgtcgccggcgcagaaatgagaacggttcagaagagcccgaagacatcagcgacagcgaagaggaaagcctagagaggaagctcgcccgccttcgcagggaagtggaggaactgaaagacgagatggccgctcgacagaccgaaaccgaaccggaagccgcagaagggaaggagcccacggacgacggcgtcctcgaattgagccgcgccctggacaacctctatacctcccgcagcgacaacacggggccacactccgcagctgcaatcctagcacaaaagattgcaaccaaatccacatccgaaaccgctgcactcagcacccagaacgcaggcgccacacaacaacccgaacccacagctccgtcatcctcgggtgtccttgcccacgccgcagcattcgacggccgcctcgccctcatcgaagccgccatgggcatctccagctcctccaaccccttcgtcagcgacggcatctccgaacctgccctccagcccgtcctcccagccgtcgaccacctcacatcccgcctcaccaccctcatgaacatccttgtcggcccgaaccccgtctccgccgtgccaacaatgggctccgcacccccctccacaacagtcaccaccccgcatctcgagaccctctccactcgagtccgcaaactcaccgcagacacagaagccctggcgtccgcgcggaaacgtgccgtggacgccgccaaggcagctcagaacgcgcgcatcgcatccgccgctatcgagccctcagacatgtccgtctcgtcgtcctccgctacggaagtcgacccggctgctacccagcgcgatgagcaagctaccaagatccaggccctctacgctactctccccaccattcagtccctccatcccatccttcccagcgtgctggagcggcttcgctcccttcgcgctatccatgcgggtgctgcacaggcttcggagtcacttgatacgctggagaagagacaggcggatatggcaagggagattgagcagtggcgcgagggtctgcaggtagtcgaggagaagatgagccagggcgaagcagcgatgaagagtaatatcgagcttgtcgaaccttgggttcgggatctgcaggcgcggctgggtcggttggaggggcagggcgcatgatttggaagattgtggattagtatgcacatataactactaaatttcttgtaactgtagctggttgatagtagtactgagtacccatatatcatttgtcaagcggaataccatcagcaattgctatagcagttgaaattcaatagtatagatacatggtttttgttaccttacgtcactgtagatgctactatcatctataaaagtatatgtcacaacaatgaccataaaacctaagaaatagtagtagtactactaagggtatatatacaaaacctaatctaccaactcaactcatacctccacccccctcttcaaaatcctaatcttcggctccatcctcacctcaacccaccaccctctcgtaaccacatccctcacaaattccctccccttctcaaagagcctcaccccctcgtctccaaacacatacgctaccactttctcctccacagccccgacagcctcatcaccaggccggacgatcctcagccctgcgaacccatcaactgtgtctacgacttcccaggatccgaggaccttctccgtctcttcacctggttcgaccaggacatagtcgaactgtgaccagaacgtcggtgatgacttggtggtttcatcttcggtcttgtcgtagtgccaggagggtttgattgactctgaaagaggagaggaggaggatgggtgttggagaaagcgagtgacgcctgtttggcaggcaaggttgcctaggtagacggagatggagtcgggggatgaggaagcgctggtgttctcggcgtaggcgtggagggtattcaaggcgtgagcaccggggtagtttgccgacgaggcggggaggagaacgaaggtggagaggaggaaggaggcgaaggtggatgcgagcatagctagggagaggagacggtagaggagggatttagtccgatgggtccaaatgtatgatgcgccgagagaggcggcggcagtgagtgcggggatggtgtaaatgatgaagcgccattccttgtggggttgggcgctgtagatggcgaggaagaacagggaagggatgagggtgttggctgcgaggtcgcgggtggagggctggaagagggcgaatgggattcccacggcgtaggttagagggttgaggaggagacggggaacggcgttggtgaagtagaagtgccagggatgggtgccccaggcggaggcttggccggagatgacgttaaatttgaaggctgcgagttcaggccagagggggtattgttgccagaagaaggagtccacgaggacggcggaggtgaggccgacgagcaggccaagaatgccggcggggataatctcgcgctgaatgctgatgcgacgggtcgcgaagaggaagacggtgttggttgcgagaaagatggccagttcagagcggaagatgatgccggcaacggtcatgaggtagagggagagacgggcccgttttttgtacactgcgggactcacgggctctggaagggtatatcgcagggccaaggtggtgaggccaaaggcgaacatgttggacagggtccgtgatgcgtagtagaagatatggaattggctggtttggaagagtaggtaccagattgcggtggtcttgccggcagtgcggcgcaaaccagaagcaaatgcaagcaatgaggcagcattaaagaggcccagaatggcgcgtgctgaagtagatcgccatcgtcagaggcgctgctcaagccatgctagaaagaagcacataccgaggaattgtctgtcaatgttggccttcaaccagatgaatggctgcgacaggccggacagcatcacggcgccaacgaacgtcctagggacggcgccagggaaggtaaagtgatcgtattctgtgcgcagtatctcggagacattgcgagtcgggatcccggaggacagtatatcatgaatagcctgaatgtggaacgactcctctaccttggtatagggcgctgcggcgagatggaggagaacgagggccgggattgcggcgaggagcaacaggaagactagagagtagatcaaaataccgtgcaatattgagaatgatgaatgactacttaccgacatctctccccatgatgacaccctaagcaccttctttttatgtctagaatacttctaacaagaagacaagaaagaagagtatatccaaaaggacaacaacatcccagcgggtaaaattacgtatgccgcgatactgccgccgcggcttctccgcctctcctccgccatctccatccagtatctccgtttcaccaccaccgttcaagaaccatttcaatctacattcctccttcccctcccccaaccagccaagatgttcttcttcggtcttgggaagctcgtctacggtgcgcatatcccacgtctcccctccccctcccacgactcagctcacaggagacaacaagtaactaactcaatcgcataatcacagtcatcatcctcctcatcaactccctcgctgtcctctccgaagaccgctttctagccagaagtacgccattcccccatctgccacgaggaaagcaataatgaataaatgattaactcatgaaattgaaaacagtcggatggggccgcacacaaaatgaccctgctttcggcgcaacctacgatactaccagcgtcaaagcgaagactattaatctgattgcgagtgtaaggactgttatgcgaagtacgtcattcctcttctcaaattgtgattacgcttgcgaaatggtggaatgaaaggaaagaaagaaagaaagggaaacacaagctaaccgaccgcggggaattgtttagtaccgcttattgtgatcaatacgataattatcgtgtacgagcttattctgggttaaactgggatgaagctgagccggggataatatgaaggaatgggagttgtgttataaatgcatacatgattactactgctgctgggattcttgctccggtctggggggcgctggcgggctagagagggtgtgtttgtattccaactttttcttctttctcttgttctgttcattgtacgattgaaaacggattgaatgtgttggacagaatagggatcgacgcttgctttcctgctgtagtcatatggggatgtgcgagtgcttagctcctagtgctaaggatgagacgcatgtatgtctgccccgtacctcaagtctgaggtagctactagccggtgtgataataagcccttctgcttcaatgttgatagtttgattactatctaatgcgtgtacttgcatcggtctatataccacgcaatgttgatacatatggtctatcccacggacccgaaggatgaaatgctcaacatgaccagacaggatatgacaagtccagatcccgacttcactctcttcctacacgaagaactgcgtccccctctttcgctcctggcatcggcggaggatgtttgtttcattcctgaaaacccgtcacgaaccccatttctccataacccatttttgaatggtagtaaaatcgacaacctgagataacttgtaaaatccaaaatccgaaaaaacatcagtcgccgaacgcctcacttgcccagctgtgtgacccaggcacgggtatcacatgatcgaatagcagtcgagaagatatatagcaataacaagtgaagtaatggttggctaaaacgacatgcagaagcaaagttcgaagacatcacaatgcaggcaagagccaaatggtgggtgaagaaaataagacagggaccggacccatttcaaaccttgcatccactggcaacatgcccgcaccctgagcaatatcgccaaatgaaggagccggtagtgaagagaaatgtgatgatacatcaagaaagtatgtacggaaagtccacgtatgttatgtgcaaaaacgaacaatagatgcatgcttggtgcaaccggcgaaaagcgggccttaagaaaggatgctgaacgatttcttccggatgctgaaactgcgccatttcccatgccctgcccgatcgcccttgggactcttaagagcgtctggctcgtcgtcttgacctaagggcttatgaacgacgtgtgattcctttggcggggaagccttccgcggtgagagctgctggacgggctccaatggcactggattcggcgttaaaggttcggcactaggaaccgacggcagaccagatgacgaagcacggctttctttgtctttgcctaagcgctgactgaagctcttgctgcctcgtttcaaccggctaagaccgttgctggacctcttcggatcgccgtcctttccgttctccgtaggattgcgtcgatcctcatctgctttcgacgctttgctggcctccagggcagcctttagttcggcttcctcgcgtcgctgattttccttaaccctcgcttcttgttctttccgacgctgcttctccatctccttttcagccgctttgcgctctttttcttctttggcccgctccttcttggattggatgtcactcttctttgggctcaaaggccggttggcagtttcaggtattggcgggactgggggtggagttgctaccgcgggacttgacggctcaatgtccggaccaggatactcggtatgtgtgggtagctgaggtgcggtgggggctcgtcggaggcccgtgtgtcgttgaggctcgtcttgcacggggatctgcgaggcactatgaacatgagccaatcccgcgggttgggggaagccgttcggtttcacagcagcttcgttcgcatcagccgcactggcattcatgttctccatttcttgctccttcaagacagcctctaacgtggtctcctggtagaataggacgtaggcacatgctaagccgggcttatcaccaaagaagttgcgcacgtaattcttgtcaacaggctccaccatttcgtcatcaaagagcagccatccacgatcctgcgtcttgataatagacacataatgcccatggtaaggaccgcccccaatgtgaaccaccacagcgtataactcgtataggcgatcaggatcctccgcatcgtctgttgtattaaagaggcgaagatggtaagggtacacaacccgatgaaagagcttttgcagtcgctgaagatcctcggtatatttaaatcgcttgaggtgcagtgccaaaattcgcgggaggcgcttgattttcatgcgtttctcagcctcctggagcccaccgcagttatcgcagtgaaacttgtttcgctcgcagagcatctcttctgctgagaatttccttaggcacgaagtgactgatgaatgctgctccagatctaccgacaaatccagaaaaatctcgtcacgctgggaaacattctcacacgtcaagcactgtgtctctgatgtcaaggttccctcgaacagctcgtgcacccatcgagttgtgttgggagttttagagcccgaactgatcgactgcctggaggaatcggtggtgtctgctggcggcaagctcggtataggttgcttcatggcttctgcttctacattggcaactacttcgttaagcacaaggttcagaaattcgtgagcatcttgatgcatggccgaccggaacatctcattctcacggcgaagaacgtccaggaaatgctgcggtcgtacgatacctatcctggactggctcgcaacgacagattcgaagatatctttgagagatgtgaagagcgactctgacatcccataactgccggcattattcttcgtttctaacaacggcagcgactgcagagcgattttctttttgtactccgaggagtccttgtcttcgggtttcggtggctgagcgggaggtgcgccgggtcgctgagcgttggcgagtctctgtttctccgcttgtgcctcagcttcctgattcgcggcgaagttctggtagcgaaggtttttcgccaacgcagcttctaggctttctatcggcgttcgtgtcggatagttgagtacggcttcgcgaaagggaactgaatagtagagacactgcaagattgagttacagtaactgcgcaaagggcgattagtgacatgactctgggtgggtgtttctcccctctactgaatgattggtaccgatggtccactcaccaagtatttccgtactgaataagagaagccactgttagcaatcccgataaaccggggtatgggttgcaaaatgggccaactcacgttctccatgccgaaaaacttgtcactaccgtcttgtcgaaccgaatccgaacccatttcctgcagcatcttctccagcggggtaatcggaagcgccaggggttctttcttcgcgggagtcgccccgaccgaaggagtggaagatccctgaaaaggatgcagtcagcattgtggtagttgtggcaaatggtgatgaagacgcgacaggttggctctctagcgatgttgagggcgtgccgcatgtcctttgaggtttccctcaaggattgtcgacatatcctggcgagtttatatgccccaaggacgttgaaggccacagcatacttcaaggcaaaagaagcgcggccaagccagcaaatcgaaggacttaccacatctcttcggaaactcctcagaaaagaccccatgtttatcgcaaagtctcaaagaccttagtattcaacttcatctggtagctttcgcgaataaagtagccgacaccggaaccgaaggggagtggatgtgaagcgttaagacggcgcgcaggcgaggcagccggtatgcgacggcaagtacagtaagcgaagtcgagtagagataggagggtttgtgagagcaacggtcggctatatgatggggggtttgagacgaccgaatgacagcgacaaaggataaaaagaagagcgtctagattctcggcatagggtttccaaaatccgcggatccgacgagcgtttgaggaagggcttgagggagtgggtgtggttgagtgagccaggaatggggcggaacgtgaacgggcggcggaaatcgaaggtggagaacgctgcggtcggagggaataaggcacagacgaattgaaagcaacaggggtcaaagagatgtgtaagaagacgagcaggcagaatgaaaggctggacaaggagaggaagaaggtgaacaagagaagaaagagagagaatgagtgagaggcagaggtagagggagacagagagaggagaggcgggagtaggggaacgacgttgttggtagccggattattccccaatcaggaacctcgagccatacacagtacacagtttgatacaccagttactcttgagtggatactgaatacagcctttcacatctgcctgggtaatattacatgggggttctcccgtaatgacgggcgggtgcgcgggcccgagcggttgggggggcaaaaccgatttgacttttggagaagaacgcttcgaggaggggaaagatggctttgacgggtgctactgtcacagaccgggggaagagagagactttgagccatcatttggacgggagcagattcccagagttatccgagtctagatgttttggttttcttcccccgcaaaactggtggtgattgcaaagaaacagccggccgtcttctcgatctcactccacgctggtaaacctcagtcctgggtttctttacccaagaaacacccaccagtttttacagcggttttcaagattttttaactcatcccacacatcttcccaaaagagacatccgatgaaccagccccccagtctgtgttccccctcactactactactctactcctttctctcatcttgaacctagcgagttcaagtggccccccccatagctggctcagctctttatactacgtcaccgttcccatatattaaggttcctccacaaatataccagcctacaccgtgcaatgcaatctaacaccagaagagaggagggggagacatttgaggccggatccactggcttatgatatacccggtggttctccccttccgccgtaaactccgtcagttactcttaaatccgaagaataattgacctacttcatacatttaagggccatttggcatgctaagaatccgtctgtccatgtcttctcctattcaagccttggtgtgacaagaacaagagaagataagcggtgcagagaattgatgtgtaagagagacagagaaagcttgcgcggaacaggtggccatcgggtaatatggaagatacgagtcgtgaggtgcggttgcgtcgatgttgaacaccatcgctctgatttgttgccagcccattggcatggcttagctttcccacgagccttctgcggccggtactacctgaaacacgcataggttgcgttgagatgcgtgggatggctttgctttcactgcaggcatggaaacccaacctgagcagaatactgtgcatttggcaatagtcatgactggtgttgacgaaagatagagggacgagatgctagaaccatccagcactgttatcagagtggtttatctatcgagcggtcatggacgcgggataatgtgcgtgatttagcgaccagtccggcctggcggcgttcttggcggtggcttcatgttggcaagttatcgcagcgcctctgtgtccggggtatttcttttccaagggggcggggaggtcccaggggcaactgggatggggtcaggaggccttcgagcattccgatccagttcttattctatattaactttgccattcccagtagtagtacatgcaatcgtcatctgcgttcttttgcctacaacgttgtacctttccttccaccccctctttctggggtacggtcggggccataccattattagataagatcaataccacctagtaagcggttagtgtacacaaagcgaacatggataggtacgatgtcatacataccgtatcacgctacaccagaaccacgtggaaactcaaggatcagaagggtgccttgtgaccaatcgcatgatttgtattgccccacagaccccatccaccccagcatttgagatactagcgtcatacacaccggaggcgttgtacggagcggatgtaattgtgccttacacacacacacaaggagcagggtttggtttcctttccgttccagtgacactcgtgtcgctttccgattctgtcaaggaacaagctgccacttgcatccatgagaaagttaaaatcggatcgagttcggcagtgaaaccataatttatacgcacgcataaaaacataaagtaggtcgacataacaacctgcttttgcaatttcaaccatgaatactgcgacgttagaggataaactattaatggcgtaaccgatggtatccgctctgcgccattcagcccgataaagcgccagataactacaaagtaataggtaacatcatagccccgggttagcctattactttgtaactaccaattgataagcaccatggatctgggtttcaagcctgcgacaaatcaatggtctttggggaagatccatgagaacaagccataacgtcattgggtggacgtgggggcactagggcctgcactaaaagctgcgggcgtctaaatggaaccttccaccgcgctcggtctactccggagtctagtccgaagcagtaagtaggttttgctaagtactggcggctggtatggaggtgtgcagtgagagtgagtgcctggtcaaaccggaaaacacaatccttacagacgtcaggtgtgcaaaataccaaagtgtaacatctccccatgtgccggtctgcctcacatcaagccaccgtctccccgccaataagcgccctgtccatgtgggttgatactatccatgtgcttgaaactacacgggggcagatcgtggaatcggtaggaccataacgggtagtcagggattcttcctggaatggtgagtaaaaaaaccagttctgggggctggggcttggagttggacaggtttggctgtaatactagcagtagtcgtggtgactgcggctttgtactcagtttcacttggctcttcgcctcggtcggatggcggaatgagaccgaatccgaatctgattagtgaagtcacccgaatgaaactaaccaggcagggcgacgtccatatgcttgagttgcagggagttagttaccccgtactactactactactttgcataactgtgtaagactggaaacttgtcgcatgccccattcggtgatctaccgagccggatggacattcctctacggtgtccctctagcgatgatttcgaacgcgaagtatctcctgctatacttgtaactattaatacttccttggcatgaggattccacgactcagcccagcttttttctggataagcgtcattttgtcaaatgacccttgtaatggacggtgtctaagatggtccctttcaaatatctaccaacaactctgggccgttgtcataagcctcaggccatcgatagacctgaatctcgccataccgcttgcagccttgatctcacatcactcgcagccacgaggttctagatgtggaccaggaatgtgtagatctagccagcattccagctaccatgtgacttgttctgatctctgctacatcgcatggaagcggaaaaacaatctgcagcactgagcatgacgcaggagtatttcaaagttcattatccaccagatagatagtagaaaaccatcattgggatcaatgttctcaataaggatgagcatactaccgtatcaggttgcaggcgatagagcaaaaacaaaaaagaaatatgcgacacctctgggactcgaacccaggcgggcgaacccacaggctaaacagctagtacggtaaggtagtagcaggcctgcgccttaaaccactcggccaaagtgtctattcgatgaaagtattagctcctatagtcgtatatagtgtacgttccatgtgtggtgtctgactcacaaatctcaaaccaccgattcgccgacttcgactttgcctccaaacatctctgctcctgattttaaggctgcctgtcaataacgccggttcgcgcgggtgagtccgacctcaattccttgaatgcacccctcactccaaccacgcatcctccgctccgcccgacgagccctgacggagtgtccctgggccccagcgagcagttgcagacgcagcaccagcaccagcagcaccagcagccgtagccttcagcagcaccaaaccagcgagcggccaaacatccggcaggcgatcgaagcccccaccatcccccaccaccgccactaccacatctccctctcccactcgacttttccctcctccccctcctccattctccctccccatccctctcgtccgctctccaccatgcccaaagaaaaggaatccaagctctccttcaacctcaaaacccccaagggtaccaaggactggtccggctccgacgccctcctccgcgaccgcatcttctccaccatcgccgatgtcttcaagcgccatggcggtactgccctcgacacccccgtcttcgagctgcgcgagattctcgccggtaagtatggcgaggactccaagctcatttacgaccttcaagaccagggtggagaaatctgctctctccgctacgatcttaccgtccccttcgcccgctggctcgccatgaacccggatgtccgcagcatgaagcgctaccacatcgccaaggtgtaccgtcgcgatcagcccgccgtgagcaagggtcgcatgcgcgagttctaccagtgcgatttcgatatcgccggtaccttcgatcccatggtccccgatgccgagatcctgcgcatcgtcaccgaagtcttcgaggagctgggctggaacggccgctataacatcaagatcaaccaccggaagattctggacggtgtgttccaggtctgcggtgtacccgaggagaagatccgtcccatctccagtgccgtcgacaagctggacaagatgccctgggcggacgtgcgcaaggaaatggtcgaggagaagggcctggacagcgccgtggccgacaagatcgagacatacgtgatgcacaagggcggtcgcgaactccttgataacctcctcaaggatgagggcctgactgccaacgagtctgccaaggccggtctggaagatatgggtctgcttatggattacctcgaggcattcggtgtgctggacaagatctccttcgacatgagcttggcccgcggtctcgattactacaccggtgtgatctacgaggtcgttaccgagggctccgcccccgccgtggcgtcctccgcaccggaggcccaggccgtgcagaagtccggcaagaagagcaagtccaagggcggcaatctggaggatgacgaccgctccaacgacccgaccctgggtgtcggcagtgtcgccgcaggaggtcgctatgacaacctggtgggcatgttcctgcccaaggcgcagattccctgtgtgggtgtgtccttcggtgtggaccgtatcttctccatcaccaaggcccgtctcgagcgggagaagagcgccgaagccctccgcagcagcgaggtcgatgcctacgtgatggcctttggaggtaagggcttcacgggtatgttgaaggagcggatgagcgtgtgccagactctctggaactctggcgtcaaggtaagctcccccacccccacctaccatcttttctcccctcttgctatatactaataatccataggccgaattctcctacaaggtcaagcccaagctcccccaacaattcaaggccgccgaacaagccggcgtccccttcgccgtcattctgggcgaggacgagctcgcggccggcaaggttcgcgtcaaggaaatgggtctcgaggacggacaccccgagaaggaaggtgtgctggttgatctgactgctctgccggcggaggtcaaggcccgggtggctaagaagcgaggagagagtgtcgatggtgttgcgcagcagttgggtgagatgaaggttgatgcatagagcgggaaaccatatacagggcttagatgggtttaacttgtttgtgctaagagcgttcaacttgaaaaaaagtataagggaaggaaagaaagaaagaaagcaaaaattaacgaagatgttctaaaatacaataccccgggggttattttctatatctttcgctttcaatggttctcctggtatagtatagatagatggcagtcaaattggagcgacattattcttacactacaccatctaaaagttgtagtttcaaatattgtgatccatccgtagtccgtcattctactactgtttgatttgatatagtagatacagcatgagagtgagagtatacccatgttaatcatacatctggacaaacgactaaagtactgctaaagtaaagtaatatacatacccatccctaactaataataataaatacaaaatcaatcaacctaccgcccctcagcacccttcatcaacaaccccttaacaaacggcacccgatcaatcacatccaatcccagactgcgcgcccacgccacaggtccattaccagggacattatacaacttgtgcagaacatcacaagcaccgccgatcttcgcattcgtggcgtaccgatcccacgcataccgctcgagagtgagcaaatcgcccacatccataccatggtgcacggcgtactcgatcgtctgcgcgagagacgccacgtcgcccagacccaggttcaagccctgaccggcgagggggtggatgacgtgcgctgcgtcgccgacgagagccacgcggggagagacgtaggtggaggcgtggcggaagcggagggggaaggatgctacgctgccttcctggacgcctgtgaccatgggtgggaggtgggagggctgcggggtgtgttggaggcgccaggtgagttcgtcttcgtgggggttttcggttgtagtagagggacgttccatgcgcagcatgtattggaggtcggtcatggagaggcggaaggcggcgttgaccatggagatgaaggccttcggggagagggacttgaggtaggcggcgttttcgacggtcgtggaccagacgagggttgcgttgttgttggggagggggagcagggcgatgggtccgcctaaggaggggaggaagcgctggtatgcggttctcattccgagagggaagggagcggggtccaggtcggcgagggagaggcttgcgacgatgccgtgtcggttgtaatcccatccgtctgtggcgatgtcggcgaagcgtcggactgggctgttgatgccgtctgcgccgacgaggaggcgcgcggcaatgcgggtgggcggttgggaagtggtgttgttggtgggtgtgatggaaaggacgggccaggcggagaggtcggggccgtcggggatatcggtgccattggtgatggaggagacagtgctgttggagaagagggagaggttgtcgtctccggaagtggcgatgcgggagaggagggcacgaacgaggttggcgttctcggtcattgtcgcgacggcgcggaggtcttcgaacggagaggtctccatggaccagtcgaaggagatgcgcgagccggtttcgccatcccagacttgcatctcctggtagggctgtgcgcgggatgtgtcaaggtgatcccaggcgccgatcttcttcaggaacgagacggaggagggagtcaggctgctgacgcggttggagtagttctgcgcatcgagggaccacgagcgggctttgttcaggtcctgagtttcgaccagggcgactttcagcttggaggtggtgggagaagcccctagagaagtcagtcagagacgccaattggatctatacagcgcattggaacagcatacggagagcagccagcaggcctagaccggcaggaccaccgccgacgcagacgacatcgtagatctcgggggccacagcgttggtgggcgagtgggaagcatatctcctgcgggcaggaagacgacccaattgacaagacgggcaaacgtagggacggagagccgtccgagagagaggacgcatgatggatatggggcagtgaacagcggggaagagagagcgagaagccggaagtggaagggaaagtgaagccatcaccagatactcaagcaaacaaagcaaacatcattccacctccatcaaccaccatcacaaggcatcattctacacgaagaaactcctcattctcgcccccaaatactaacttttctcctgcataagaatcattaaagaaatacccatctaagcataccatcaaatcccacaaaatgcaacatgccatccattccatccccccctgactcccaatctcactctcacttatgtactctcactgccactgccaccatgcactcactccgccacaatgcacccattccattccactgcagaaggcaaataaaccccctcaagcagaagataactagtaaaccctgaagaactttaaagtatattagtaccagacacagccctacaacccaattgaattttcttcccaactttaatatcacactttcctcactcagttactcgccttatacatacaaccctacctactatacacagaaacaagacacaatgtcctcatccaacaccactacaaccaaaaaacccaaacccaaaacccaacctcaatcccaaccccaagaagagagaccccatctatccgccaacttcgccaacccatcatcgcagagaatcgactatgatcatgaagtctacctccatttgatgtccggtgatgatggtgatgacacccgcaaggacaagaacagaagcaagacgccaaatcaggtgtatagagaggttggttaccccttactctatctttccgaatcaaatttcatgattctattatgtgttgctatgttgtgcatttgcgcgaagtttagttgtctgatatccaagtgcctgtctggtgtggggtgatatagaatatcgtacggagacatacgactcgcgcgctggacccggcagtcgtggatcctaatgcgcagagggatccgagtccccttgatttggagtgggcggaaagtcagagggttagggagaggttggtggggaactaattgggtattatggtaatctgaggatgaggatgattatggatttctaccggacgagtaaaaggagggaataaagaaagaaagatagaaaatgcaacgtcgtgatgattattcattcagaagcaacaatctccttccacaatgataataagagaaacgaaaccctcattaagcgacaacatggctagtgcgatatcacagtgtcataatcagtagtacctaagtgtagtaatggtggtagtagttaaagtatcacctggcctccgtgcctgggtcatgctcttcttccagatctccctccatctcagccacaaatcgttcccaggtattcagtaccccctggtagaactcgatctgcttctcggccaacgctcccagcgtatcccggaactctacggccttgatgcgctcaaagtctgccacctcgcgcacgacttcctcgtcgaacatctccgacgtcgttttagccgattcgacctcgcgcgtgagctcgtcaatgcgaagctccaacttccgcaccctctcgcgtcgcgactgctcgtggtcgacgccccgcatgtcctccatcttggaccggatgaacgaggccggggacgaggtcagcgggttggaggcatagtaggacgaggggttagaggcgagggagtcccgctccgccaccgccttgtttcgatagtcaaccagcgcttcgaagtcgagctgtttctgctcgcgcgttttgaggagggctttaagcgagacaatgtacgcctccatatcccgcagcgaccccagataattctggtcagtgtgatccttgagcgtcttgagcccgcgccccgtctcctctaccgatgccgcaaagacttgtaggggcacctccacctccggttccaggggtacaagtttgcggaactgcgtagccaggtcattatagtctgcctcaagatccgattcccgccgagccactcgggctacaatcttctccacatgattgaggtcctcgtccagtttatcggccttctcccgcacttcaataaaccgcttatccggcttatgcaccttggtgaaagcgttgacaaaggtgtcggtaaagttgtcaaagatcccagggaccccgctgccgtccgaggtgctggtcgagttgcgcgtggaccgcaaccgcatgtgtgcattccagtcgggcgattccaggaagatggccagtaacggtgcgcgacgaagcacgggatgcagcgtaagccgtttcaaaaagcgatgtaaagaccatgctcgccgggtagtgaattcgggtccgaaccgatcgccgcggacatactccatcttatgcttatccggcagcggcgggacggcgcaggcagggtattcgcgataaagtgtcttgtataggaagtagaagtcggtgaatctgcgtcgcacggtgaactcgggtttctggaaggacttgaaatcggtctatcattctagtcagcatgcactgcaaccgcacagccttttccatctgagatcactgaaggtaaagataacccaccgtagttgtaaccaaataggagatataagcgtctttcgttccatcattctccttcaacggtgaatctacccgacactctagtacgccgtcgccgatgcccgccaggtcgacggcatccgccagtggtccagcctgagggctttcttgagcgttgctcatcctccgtttgccattgacatcgtgagtgtatggcgcctgttcctctgtgtctgttccggaggtcgtgggtcgcgagagatcgctgtccgggtcatgcctccacgagacgctgtcgaagtcgtcgtgctgatccatcgaggggttggtttgattgcctgccgcctggagccggcagagaaggctgggtcggtagcgttggagtgggtggagatggggatcagtgcgaggtacaatacgtggagctaggaaaagccggtttttaaattaaactggggggctctagaagcaggacagcaagattaaggtgggaggagtgaggagatggaggttggttggcgggcggtcaacagcaggagagacgagatgcggaggaagtcaaaagcagcgacgggaagcgtcatcgccaagacccttaatttagtgttcctttggtactattccggagatcacaaaccatggcagatgaagaataataacccgatcaaagatgatgcacacatacatggtatatacacgctttctctatgcagcatacacagcaggaatattgttcaacgcaggtcatccaacaagtaagaaacactgtccgaaataaaatcaaccctcatctactgcacttcatctccgagaatgctctccatctgcgccctcccgttcttgttcgccgctgatcccccgatcccgatacggttcatcatcctcatcactgaataacggttcctcatcgctctcgcccgcaaaagcattgtacagctcgccaccccggcgacgtgaacggttcgaccgtccgttcattgcctgtagctcatcctcgtcctcgatcatctcgaaatcgtagtcatcccggctgtcgtcgcgaatacgtttgcggcgctgcacatggaagtagacgcccaggccaatgcagaacacaatgatggagccgatcgcagcgtagatccaaacttgcgtccgcttcgacgcaccgaacgtggggaagaaggaaggcaggatactatctgacgcggtggtcggagaaggacttggtgttgagcttgcctctgtactaggggtcttctggagttcttcatcatcgatgggctctgtaagactaccggtcggcatcgcggatgttgtaggcttaacgttcaccgggcgatcaacgccaccagtgggcttgtcaggcagctcggttttcgtgggaacggcgctgatgctcgtggtagccacgtttccttcctcatagctgtggtcgtcatcgtgttcagtaggcatggggtggagaggctgctcggctccgtcaatcgcctcgccccacaagttgagtcgccaatcgatgaattgcccagtatgctcgttgacattggtgtccttgacaatcacagtccatttgccaatcccggactcgcccctagatatgtattagcagaagaaccgacaaccgagaaaaagtttacttaccagtgagcaacgctcatgaaggtccagtcaacatagcccacctcttgattatctggccgccggggcgtactgaggtgactgacccgaccgtcagggctccgtaactccacgctgagatcgcctcggcgggtgtggttaacattcatggtgaccgtgacatgctccagccgttccaggttggctcccttcaacatatcctccgtcacctcgtacgaactagccaagccctgctcgccctgtgggatctcatgctcaacccgctgccagggggaatggagccaggcttgaggcttcaccagatcccaggtctctgcccgtttcaccagcgtatatgtgtcgaccttaccatatccccagtcatggctgaacttcttcccgttcttagtgtcctgccagcttccatcatcttcatgaacaggcactgccgcctcaatcatcaaatactgaacgtcacgccaggtgagttccggccgcacactgagggccagcgccacggttcccgcagcgagcgggccggccgccgaagttccaccatgggtagtcgagcacttgtctgtgccgacgtccgtggtatgaattgcatcactggcgccgctgctgtaggcaaccaccagttgcgccgagcaggattccgaatacggaggatggttaccctcccgatcaatggcacccaccgtgatgctgtagatactgttggtgtaaccgtcaaagttacagttatcgtcatgaatggcaccgttaccagccgcaaacacaaaaaccgagccttttccaccacgaccattttggataccattgaccatggcccgcttgatcagggtgcccggggcttccattgtggcgccatcgtcatagggaccccaggaacacgagtagatatcgttctcctgataggcgtagttaatagccgcagcctcatcagtgtcatcaatgggtgcggagagaatccgaataccagcgatgcgactatcatacgcaacaccaaccccgcacacgtcgttcttcgccgcaccgatttcacccgcgcatctagtaccgtggcggtcatcgctcaagcgcggcctcggctctggtactttgtcgttatagtcataagaacccgccgcaaaatagttcggcctaagatcgttgctgtacatgtccaaaccgtcatcgacaatagccgtcgtgacaccctgccctgtaacgccctccagccagatacccgtcacgttaagatcatggcccaactgaacagtattatacaaatgccattgttcgccgaagatggggtccgcgatgcccaattccgaggcaatgcgtttctgcgccgcaagcgcttgggggtcattctgagtgttgacgggcgatctggcagcatatcctgtcggcggcactcttttatggagctttctctggggagccagcttctcggaccaaagaatgccacctagaccttcgtctcgcccgaccaaggagggaaggacagcggcgtcatctccggagcggcggcgtaacctccgacgatcgcgcaattgatccagcagcgcatggacatcgtcactgttttcacggggtatcgagaaggtatgatgtgagggtaattctccgacggggccttcgtggcgagcacctagtcgttgggcgacgtcggccggcgaggtggattcatcaaggtgtagagcgaagtaatcatgggtctcgtaggaacgatggggatggagagaagcggaggcagcagcgcagaggcccagagccgcagcgacaccacctgtaagacgcatcgtttgggggagagttttggtgaactctctctctcaggacgatgtaatcaggccaagtaggaggcttgccatggaccaacacgtactgggtatgaggcgggtcccggtgtacagccagaagcaaggaaagtccgccaggtatgtgtcggtctgtaggagcgccacccagttgggaaaagggaactggggatcaaaagcaataataaggaccgaaagtggcaagaatggcaagaccgtaagagaaataatgaaatctgaatgaaagcgagggagagagttgacgagttggcccgagtgaatagaaagagagctagactaatacgcggccctggggcgggagaccaaactcccgacactccaacttgcctttcgccgatccactttttgccttttcctcgcccaaaatggatcaccgcctcagatggcccgccgctagcctggttgggcctagcagatcttggctgccccttttgggcccccgttagatcggagatcatgttattccaggcccgatcacatcgcataactcgggctgcatgtatggatatgcaggtggtggaacgcctattatgcatggggacaatccttttcctcgagtttattgcaccgtggttttaatagtgttgtatacaggtagaattgataggccttatatcaagtcgacccccgcatcatccgttggtcaatctcaggaaactactgtcccaaacttaggttttgattatatagttcaaaccgaacctagttttaccgtgtgtacaatatgtccaactcgaatcgacagaatattattctcaatgggatgtttttatgcttactagtatctattgaagaattatgcatagtcagactgtgaaaagttagcgtcaaacctgctaaatacctcataatctacaagaaaagaaagaggttgcattagggttcgcatcgatctagtgtaaactccatttgaacaataattaagaactagcatttaattaattacactatgtccaagcttttatccacctattccacagactatgtccaacaaccccaagattaccaacactccactttttacagacgaagcgacaaaagacacaaaaggaaaaagagcagcaggcagctccacgccaccgcactcaagatcagaccctgctttcggacctgtcgcaaaacatcggtatatcgcatcgtctcaaacgccaccagccggtactgcgtcgcccacccaagctgcggggcatggagactcagaaactcttcaatatgcttgcggatatggtaagacatcttgaacacgccttgtcttagctccctgtagttttgcaacgccagttcatttataatgtggacgtccggctggcgatacttggtgtactgctcgaggtagtcttccacaatcgcttggggggtgtcgggtagttctttttgttgcatcgcataactcaaggagagattgtccttccaggaggggaaactccttcgttggtcaagaaaatcctcgaatagaattcggacatcttcgaagccggtgttcatgccttggccgtagaaggggaccatggcgtgtgcagcatcgccaatcaggacacatgaatcctggtagtgatacggtgagcatcggatatcgatcatggggtgatgaagatttgacttgaattgcttctggagattgtcggtggggatgaggtctggtgtgataccggggaagttcttttcaaagaactctacgatccttccagaggatttcagttctaggaagacgttttccggggcgaacaaattgcaagtcagtgttccttccttgtgggggttagtataccgttgtttaatgaaataatttgtggagcatgcataccttgtccggacaggcaaacagcataaagtctcgttggggccacatgtgcagacagtccatcggaagggcatgacccgcagggatggttagctcacaccagaagatatcctcccacttctgattgatattaatcttcgcatagcgggacagaaagaagcgggttgtagagtgagcaccatcggcaccgatcagtaggtcaaacttggtctcatgactgggctcctggggtcgagagatgttatggaaagtggcacacttctgcttcatgtccaagccattgagcctgtgcttgtagaatatgtggacattagggaaggcagacagctcttctagcaagctttggttgatctcggagcggctgatagcataaagggcctatgtatgaatgggcaagagtcagagtggttgcctgaaaagagcagtgaaaggaaaggagtaaactcaagagagttctgacacacctgtccatgaacatcataagcaatccgtctggatgttagtcgcttcttggacctgctgtgcaccattcgaccatagacggggacagtcgtcgataggatcctctctgccaggcccctgcattggctatgccgcaaggccttgatgcctcgctcagacagcgtcagactgatactcttggcagagaaggcagtcgctgtctgaacctgactgtactctacatgtacaaccatccgttagaacagaatggcactgggaaatgcagcagagaggcagaaagtaaggcagacgcaccgtccctcatctcataaatttccacttgaaagcctcgctgagccgcatataaacccgccaatgccccaacgggaccacccccgacaataacaaccttgtatgaagacatagtaatataagtacagagacctttctcacagaagagtaagacaagttgattgtgggagatgccctggtaatactagcattctgaaaaagggcatcttagtgcccttttatatccaaaaggtgcaaccatttctccaatgtagaccgctttttaccaaattcggagttataatgtagccctggcatggtacattaccggtgaatcctgattgagaaaatgtatatgacactattccgatgagtccattcggaagttaactgtccatatagaaatgccgatcgattggccactccagcatggaacagctgacttcattggcctgaactggaccccgtaagaatcaactactggcatccttcaggaaaagaatgctaagattgggggccctttcaaaagagagcctactagtgaccattcgcagggtttgccatggggccaattgcctcgaggatctggacagagttagactatcaaacgatgtatacgttgcgtggctgatcggagacccaagatattgataattatgcagtaaccatacctagtacctatgtaactacttgagtttacatatttcgagaagaaaagtataacgacttcaatgattgtgtaatataagtatgaaaattccccagaagtcccggacttcatggacgtgtgagtcctcacatgcatgaagggatataattatcgaagactcgtatgccggatgaatgcgggctcccgactcgcagcctagtcaatacaggatgcctaataatgagccttttttaatataatcttcttggcaattccatatgaaagtccacgagtgaatgatcgaaacgttgctgtctgttggactgtatactcaacaaaggttgttatcgccctctggcaagacacgcatcacccaattggttacttgtatatcgtaggatcgcgtcagtagtgcatgtctgacgtgaggtggagaagtgtcctaagaaagcaagaagaacaataaggagaaatatactcagaattctgcagtgattctctgcgaatcccaccgctagatgaaggatcgccggcgcgattccgcttccataagcatcacctacgcatctccgtcggcattgccagaacagagacagatctgcccgtctggacccggctaatatcacggcgtggccgctgaaaaagcgcattgaaccgcctctgcctgccttgagtggctacaatcccaacagtcatttcatccttcagatttctagcgataagagatccggaaattgaaggctccgaagcgtgagtcaatagtaatcggaagtaataatgatggtagtttacagaagattctactcctccttcttgctgcccacttttcccccagaacgcagtcccacaaagctgacaaagcagactacgagcatggctgcgaacataagccaataggccgcttcgtaacccttcagcagatttccatccgagtgtgctgtgacagatccagcaataacagcgctgacggctagtccgacggagttaccaatctgtgagacggcattaaacacggccccagccagcccttggttctctcccggataagcctgcgaaattatcagattcgagacagtgaagagaactattatatccgaatagcgagtcagcatcgtctacttcatttagccgctattttcatgtgaaacgtaccatccggatgaagtgggctgaggagcatccccacaaacggaccccgccagtacccccagctcggtttgactaatgccatcaacagagcagagatagtgctgatgcaggcagagacaaaaactaaagtgcgtacttcaactttatccactacgtagccggtgaagacattggtgagcgccccgacgatcactaggggcaggaacatcacggctgagatgagggcagagtgatgttgaatgttttggaaactgcccatactggtcagctacttgttgtactttccccagaagcacaaggtttacacttactagagtgatgagaagtactgaaaggcattgaaaacagcccaggtgaagaacacgatgatgcatgtcgaagtaaacgtggtgttacgccatatactgttgggaatgagggcgggctgaccctttcgctgtcgccagttcatccacgcgacaaatgcaggaatgagcactagtgaaacaacaagaagggcaatgacatagcctgtgcgaatatttcgataacttccggagagttcactgcaggacacattgcattagcaagatcgtgtagaacgcgggagattgagggaacacctacgccatcacgaaacacagcaatgccagcgagatactaatgatgactgccccaatccagtcaatttttgccatgcgcctataccacggctctccgtggggtttgttcacagcgggcagcgcccaacaagccgtggccgataaaacggcattgatgatggcactgatataatacccgtagcgccatccaatcgtgtcaacgaaaacaccacccaggatgagccccaatgaatagcccaaaggctgccccattcccatcgatgcaaatccaatgtttcgcctttttcccgacgggcaactgcgcgtcattaagctgactgcagagggcaagcacattgcgatgcaaagacccaatacagtccgaaacgcgatgagctgattccccgtttgtacaaaaccgcaagccagtgtaaatatcgcatacagaatactccccgttgtccaaattattttgtcaccaactgcatctgcgatagaaccgaagagcagtaaagtacaaccagctgcgagcgcgtagactgatgcgggccatagtaggatatcttcgtctagatgaaggtcgatcgccatttgtgggagggccacggtcagtattcctgaccccatcgtgttgaggaagctgacgcccgtgagactgacgatggtgaaattcgcgcgagtggtactgaaggacgtggctgaaaaggctgccggtgcgaatgttgcttcattgttgggtgtgctttcggacgacgtggtatcaacatcacctggcttgaatgtgttcttttcgccttctgactgcattgtgtgtacctccgaagacgtttccagccttgagattaaatggagattgccagatagatcagctgtcatccagcgacagccaccagaaataacagctcaggaattgttgaagactgttttagtttagtcaatgatgggctaggctgttcggagcttagtgagtctcaatttgggtgagtcagtaagcataccaagttaactaactacccctctacggagtacaagcatgctgacatattattcttttaattcttttgtaatcatgtcgggctcctttccgctttggatgtccgtaactaaatcctcccaaagacgagggatccaccagctgccgtttctgctaggggttgctatagtatgcgagagtataacaaggctgacttttagggttatcactgataagcaactccgggctccaccgcgggactctttccgtggttcgataacattattactatcgtctctgctcaaggtttcattgagctaattaattcatcagcgcgcattacaaattcaagcaacagtgcgcggaacaaaacgaaagaggccccatagacataaatttggccagctctccggtccgaaaagcgctccatttttctcgacttcttctagattttctttctcactcacatcgtaaataagttccagtgtgctgacgtggccattcaatggatgtgagagagcatttccttgagcagcggctgctttaactagcagtgcagatgatcatccacgcatataccttacagtagaatcgaatataatacatggaaggaacctagagtcttccgtgcttttctactttgattactctgtagtctaggctacctccacccattaagggaggataacagggatttaccattacttaggtaacgagaagatgtgcgacagacttcattcgttatagcggcagcccctcattcaattattgatatgcaaaagatgtttaggcttttagtcgagtatagctcatcatggctgcaaggtagaatttaatccttaagtagtaggtgcacggaagcatggatacatgagtggaataggcatgaagcgtctcggcaagactataggaagcccgagctaacaacctacatgtgatgtgtccgattaagaccgtcttgggaatttccattacattcttgaatctactggaggcaagatctgcttctactttccccactgatccgttctaccttgaacttgctttctcaccgcttcgttactttagtctatatgtttcctcttcgcctaacgtgtgattctgaccatgtaccacaagcatgtgacctccaatcgaaggtcgcaacgcttcttaaaatgtatattttttcctactttgcctcttaatggtccagcttacgggggtcatgatcctaagaggaatccatgctagatttataggctcatacacttacccaagaagagcttcgacgtatgttttctgatggccttcagtctggttcatctatctcaatgtcttgtatactcaatattcatctgagcgaagaaagcaagcaagcagaacagtctcatgtctggccaccaaagtcatgtcgaatttaacgtatgacggtacgtactttgaggcctaactggcagtgtatgcagatggtgctatcttcacatcagtggagctctctctatccgcagacggttccgcatagctttacgaattgtaggcatgactaattaccttatatgaccaccatatcatctcaacgagcttttatcagagcgtgcgcgactatagcaaaacacatccgatccctggtgaggaaggttggagcatgccactggggacaacagagcctaataaacacgtataggagaaaccaagtgatctggagtagagagtcttctcaggcgttgctattcgctatatgctgacttctacagcctttacagatgactaattcttgtcaatctagtgtaccgactttccaagatgatcaaaagatagccttgtaaagcagcacaatgcccggatatactatccagactcacagtcgcatgagtttctcagtttgctacctggctgtgaaaagatgcgccgacttgactcccaaacgagggagaaacacatacttgatgctttgttgtcaatgatatatattagctggtctcttctgatgttttactcccttcacccagcttaaaactcatggagatcggaatagatatccttgtatactgagtccttcgtacgaaagaccttacaaggcatgctgtctatgatacgagtttcaggcagtgctggattaccccatctggtaataccgacagatagggtcatgtgacccagagctaagccgtaaacgacacaacagatacaacactagcattacaacttgagagtccaaacagccagaggtttgaaccacaaattttagtcacacatgtaaccactggggttcaagtactagtgctaatcgagtgctgaaagtgtgcaatgacctcagccatccagtggtggtggtcccagtaaggtgttccttgccaagcccgtgcaacacccgcacagccatcatgcaagtgtctaggctgcacaatatacttccaccctcaattccttgcttaactctgaccatgatgctgagtgacagatggtgtgacagaggagatcaattgacaatgattcccttcaagactggctcaactgacaacactgtccaacatgtacacgaaaccctttttgaggtggcagacggggcgacgttgacggcagtaacttggccagacacctgcccaacgaaaatccaaaaatcctcacaatgacgatccaaatcgacaagaatagaacaagatatagtgggaagaaaaacggccgagtcagcgtgtacctggcagagctcgtggatggacgccccgcagaggcaaaaacagacgagtcaaagagaagagaagaagagagagggctgggctcatttaccagccaccggtttagattgacatctcccctccgatcgatcaaatccccatccccatcgtatattagcattacgcctctcgttgggcatttctctctgccccgtgctccataatttttttttctccctcctcgtcctcttcccctcttcctacattcttcacattcccttcttttccattctttcacttcccattgtttggtcggcccctttgcttagtgggttttcgattgtttactccaccggccgatctgtagttatactgcatacttctattatctccgatcttatataccccgaacgtgaggaaactaccaaggcaggctactactaggcttccgccacctgcagtgcatattgccaacactgctttcaactgcaatgctactctactaatcgaggcatcatttcggcttctgctcaattcgtatcaattgtataatcccaccgccaacatttacagggggtttgtttcaagactggcacacttgaatgcgccacagtgactacgtatcaactgagccaacgaaggaccaacaccgatccgaaacacgcttccaatcaatcgctggccagagcctcctgaacaagcgggactgctaagtaacacattctgctgcgtttgctgcgtgttacaccgcaaacatggcgacagatcgcttccccgcccctcccacggaagcttccacgtatctgcagcaggcgcccaccaatggtatttatacagccccgtcgcacaaaagacagccgtcccatgtcgtgaagtccgctgcaccggattactacgaggataacgacttttacgccaaccccaacaattcaaggccaccaccgccctatccagccaattctagcagagttcaaagtcatcataggtcgcgttcatattctaccagaagcaaaagctacaggagagacgtgtacccagaagacaacatggaggaaggagaaaacctaccatcgccggaccgcccagtatggtctgaaaaacgctcgaaatcatcggccaccagagctgacaaacgtggcgacgaggcactcaaggcctcattatcctcgaatagccagccatccccagtaagtcggtcgagcacggtccgcactgcaaccgaacagcgacgggactgggcgtctgatcgctcgccgctccaaaagctcgaggtcacttatacaggcgcgagcaaggaggagaagcgggcacgggctctagaggctgaaatgaaattgaaggaacggatgaagcggcaggcagaaagtcgtgcgacaggaacggcgcagccttcggactcagtagagagcgtggatcagagaccagtccctggacgaacggctgtaccaagaccggcgccgggagcaaagcgatcgcatcaccgacatgcagcttccgaagggcagacaagatacagccccccaggaccagattcatccgacagagccagacctcctcgcagcataatgccacccccgcaagacgccgcagaacgtgctcttgacgagatccaggactttaatgggggccggtcagatggaccaatggcacgaacgggcaacgctcccaggcgaacggtatctgtgagccatcctccccaaggaccaccgatgggcccgcgggcaatgaaccagggcaaacaacgagatgcacaaccgtatccacctatctctgctgctccggactcagattttcctgaacaatctagaatggccgtcccagccaggaaggccgttcccaatcagcccaacacccgtgcgccaccagttgccaacccggcggcttatcaaaataggttgcccccacaccttgccccggagaggggggcttccatgcagggaccgactacccagcagggagtgttgaagaaccctactggagtagcaccggtcttcccggcacctgccaaggctagcgtagacagtgggctggatgtaaacaatccaatagtacctccggctccggcggagacaaatgtgccgtccaagcccaaggtctcgtttaacgtgcctccgccgacaccccctcctctatctgagtggagaactgcagctgtagcgagactgggagcctctgatttcgattttcaacgatttgatgccgatcggagtaaggcctggtgggagactggcgaaagcagcaaccgcagactcagtcgagccctacccaacaactttgcccagaagccgtctgctcagaagccaacaggtaagcagccaaaggctagatcatcagtccaaagctatctcattgctaatcacacatactatacaggtaacaagcgctttcagccatcactcttcttacaaagtggacctcttctccgctacgccggcctgaagcgggtccgaattgatggtcccaatgggccgtttaacaaggagacctggagaggcagtgttcttatcgtcacacaagactcgctctcctcctatgagccgcgcccgactctgagggtgtttgcccaaccaatggatcttctcgctcctccgcccgtccaggtaggaggcgaagattctcaactggcaccagagtacgttgacccaactgcagggttgatgaagttgggccgggacggacgacctctgtatgtcaagcctgtggagcatactgcggaaggcgaagatctttcattcgttgaaaacgacgatggaatttttgaattgtccgctagcattatggactacagcagtgagggtgtcaagcagcctgtcccggcgaatcgcatccactccatggacggagagactgctggaagctacaaagaaatcacaggtgcccgtctgtatgctgatccaggaagggatgtcacgttctggaaatttaacattgagatcgaactgggcccgactcagcagcgggtcgcgtaccgtctgaatcatggaccggctctaggcttctgggtgccagctaggggacagtcaatgaacattatgttccataccggcaatgggttcagccctgcggtggactccaacaagctcagcggtccggaccctctctggcgagatgtcctcaacgagcaccagactcgtccgttccacgtcatgatcggtggtggcgaccagatcttcaacgataaggtgattgcggaaaccgcccacttccaggaatgggtcaagatcaagaacctgagtgagaaatacgaggcgcccttcactgcggagttcaaggcagaactggaagacttctacctggagaattatgcatcttggttttcgcaaggattgttctccctcgccaactcccagatccctatggtcaatatgtggaatgaccatgagatcatcgagggattcggctcctacccggaggagttcatgaactcgcccgtcatctcgggactggggaacattgcgttcaagtactacttgcttttccagcatcacagtgtccccgaagaaactgaaaccgaagagcctagctggctgcttggtgctaagccggggccgtatatcgaccaacgcagtcggcatcttttcatgtctctaggcgacggagtggctttcctcggcttagattgtcggacagaacgaatggtaaatatctgatgacgcccttcgtactactttgatgctaacagcgatacgctagacggatgagatcatttcggaagaaactggcgaactgatctgggatagatgccaccaggagattgttcggggtgaaacccgacacttgatcgtgtcgctaggtatccccctggcgtatccacgagtggtatgtcactgactgctgtcaaatccccacacgtgccatgctaatgtcttcgcaggccatggtcaagaatatcctcaacagccgcaagtcgcttggaaaagccgggctttttggcggtttggtgaacaagaacggcgccaaagtcgagatcttcgatgatcactggacgtcaaagcggcacaaggctgagcggacgtatctgatcgaagaccttcaggatcttgcggcagagaaatccgtccgggtgaccatattgaggtaagagctattctggttttgcggtgcagggatatctaaccaagactgtttccagcggcgacgtgcatctggcggcgattggccagttttactcgaatcccaagttggacatacccaaagaccgagactaccgatacatgccaaacgtcatctcttcagcgatcgccgacatgcccgagacggaaatgatatccgatatgcttaacaagcgcaaccgcgtgcatcatatgaacactaacacggacgaggatatggttcccatcttcactcatgatgtgaataacaagccccggaacaacaagcggttgctcccacgccggaactggtgttcaattcgggagtataagccaggtaagctgacccacttttactgttgcgtctttacttcagacagtttagagttattgtgtctgaccgatggacaggtaccacgccacccggaacaccgcccgatgcccctgctgaggaagagccccggcccgccaagctcaagagaacgctgtctctcactcgcggagagaaacccccccgggcagggctccttcgacgactctccctccggggcccgcctcctaccaaggatttcaacctgggagaggcaccgcctgcgcgtcggatgagcatggacggggcattcccgactgcagacacggatgatgcaggtgaacccaagcccggcccgttcctgcgacgacccaccaacctcagtcagaaggcgtccaaacggggtgatgatgggctcggggcgttgatcaacctggaagggggactggctatcacgcttaatctcgagctaaaccccaaggatccggcggggatcacgacgccatacaagttactcgtgccaatgttacgctacgaagacatggagtacgatccgcctgcggcatcggtgcctaaagggtggaagagatggcttggagtgcgacgcaagaaggccgacaaggcgccggtggaagacaccgacgtcgagcagggcatgacagatgaggaagatgaggacgatgggttcgatgacgaagatgatgtgcgagcgaggtttgagattgctcaaggaggcgtgttgcctccggagacactcgtgcctgtgagtccggatgcgggagggatgggaatggagcaagaagaaaaggaggtgcctaagcggaagaagtggtttgggcgatccaaatagagatggagagggttcgagacgccttatgatgagtgatatgattccacgagtgacgactgaatgtaactatccttttcctgttcatatgatgtgatgctattcccgaccattttccattgataaccaatgacataatcgggtctcgcccagcccggttggtaagcagccgtgcacgtgaccgggtctcgccgcggatgatttgtgagccagtcttttggcctcttcttccaccaagatcttcacttggccgagcgagtcttgacttgttgagtctagttttctggttccttcgaccttatcaatcagttccagaggtgcgtctcaataatcacacacaccaacgtctccctccctctctctctctgccccactcgttgcaattctgccctttccttagctaatccgtgccggccagcccttttccccacccctcttcgcctctccgtctgtctgcccagagataattcatttaacccccctcctcgctcttccgccttctctctctttcctcccctctttcttcttcctatatttaaatatccaattccttcccccccttcaacaccgccaatctgttttcctccgcctttcgtcgttttcccttctccacccttcgttcctcccttggattgactgccgccgccgcgtcgtccctgcaacaaaactcctcgccctctgcctccgtcctatcaaataacctcaaggcgcccctgcgcgtcaattccacttcaacctccagaatggtgcacaccaacgtcgttagtaagtggatctttttctccctttgggatatatatggcaagcagaggagcatgaaggaagaatctaaccgggatacatagtcatcggctccggccccgccgcccacaccgcggccatctacctttcccgcgctgaactcaagcccgtcctctatgagggtatgctggctaacggcaccgccgctggcggtcagctcaccaccaccaccgacatcgagaacttccccggtttcccggacggcattggcggtggagagctgatggagaacatgcgcaagcagtctgttcgcttcggcacggaggttatcactgagaccatcaccaaggtcgacttttcccagagacccttcaagctgtggacggaatggagtgacggtcccaccgacgagcccgctcacactgctgacgccgtcatcatcgccaccggcgccaacgctcgtcgcctcaaccttcccggtgaggagaagtactggcagaacggtatcagcgcctgcgctgtctgcgacggtgccgtgcccatcttccgcaacaagcccctcttcgtcatcggtggtggtgactccgccgccgaggaggctatgttcctggccaagtacggcagcagcgtcactgtccttgtccgtcgcgacaagctccgtgccagcaaggccatggccaaccgtcttctgtcccaccctaaggtcaccgtccgcttcaactccgtcgctactgaggtgctcggtgaggagaagcccaacggcctgatgacccacctcaaggtcaagaacgtcgtttccggcgaggaggaggttgttgacgccaacggtctcttctacgctgttggccacgaccccgccaccaccctggtcaagggtcagatcaagctcgatgaggacggatacatcgttacccagcccggtaccagctacaccagtgtcgagggtgttttcgcttgcggtgatgtccaggacaagcgctaccgccaggccatcaccagtgccggtaagctttactcagttccgaatgtatgtcaattgcaatcaactaactttgactctcaggatccggctgcattgccgctctcgaggccgagaagtacatcgccgagcgcgagtccggcgaggagcccgccacctccaccgagaaggccgctatcaagcctgccacccaggaagtcaacggtgaagtcaagcaggacgcccagggtgccgccgccgagtacaagtccaaccctctgctttaagcgacccaacaacctttcatcatcccccctatacctccattttcttttccatcatatttattcccctcctctattatctatctagacctggagttttcatttagaccgacctagacggctctgtcattgttatgctctagccaaggtgggggcattggcttatggactggttttgtgtctgcgcatttcatttccttattttttctttttaccttgacggctgctttatatattactagactcactccagcgattctgttgttttattgttttgtgatacacgggattgttttttccaaagatggggttttcgatggttcgatcgatcatcctcttcgacgatctgatctcatgaatgtgaacggaatacaaaatagagtagaaagacgttatagagtaattttatcttctacagatatgtttctctttttttcctggtctaacagggtcataatctcttcagtagcaagagacatcgtacataatgatcatagtcatacaagggatgcaattggacgtgtgttgatgagtgtaggtggagttgcgtagagatgttatcagggaaggagcctttaaagagcaccatctcccgacgtgccattcgtagtcgctggagctggcgcctctggctgactaggctgtacgactgctccgacagcagcagcttctccgttagtcctaggaacagcagcattgccatcatgcgacatcagcgaagaaccagacgggtcggcactcgcaagctgacgggaaggttcaggagcaatggttatacttggattctgcgaggacgcaggctctccccagcttgcaaatggattcgcagcacaccatcggtccttgacttcgtaggaatttttctcccattctgccatgtcgcgacgccaggtatcccagatcttcgcattggcctgtcggttgacttctatctgctccaagtagggccgtttcacctcctcgctggcctggcgccacatgaggccaagcgcttgacggatctcgtcgcgcgcggccttggcgttggggtccttggtcgcggctcggcgggcttcgtcacactgcgtgcgacacttgccccagtagtctttctggtacaggaggaacgggttaagcgcagtgcgcgctggtcgtgggggtggcgcgcccagttcctcgtagatggcggcccacatggctttgtcatacgcttcccgacggagtgcctcgggcgatgcatcgttggctgtggcaccagtgggttcgagtgatggtccattgctgtttgtcgagggaggttcttttcgcttctgacctgtcgtcgtcgcgggtgtgccaaggtctacagccttgcccttctccggaacgagcggtttggggacgtcaatggggcccaggatggactcgatcacctcagatgcagcccgcagcccggacagatatgctccatggaccgtggcagggtgagtgccgcaggttgcttctcctgcaaaatgcaggttgccgattggcttggccatcaggtcataatcgcccggaagtgattgcgcagctacatacgagtagcttcctctagtgaacttgtccgtaccccagcgagtaatgatggtctccagaggatctggaacagccacgtgcttgaagacattacgcagttgactggtcacttccgcaataattaccgaatctggtgtgtgctctgcttgatgcgcagcgtccccagccatgagagcaataaggaccgggagaccagtagtcttcatgcagttccaaaataggtaaaaccggccgcgattcgccgcgtagtcttcctgcatcatactgtttcgatttgcaggctcacgcagaagcccaaacatatcacgctccgtgtcccagaacggctggtcaaagaccaagatcactttattcataaccccgaagccaagtcggtcaattgcaccagttttccaatccgggagcggaggagagaactgtattgagcgttgtttcaggacacccagagatcctgtaaagacaaccttatccgcaacgagcgactcaccatcctcgcaatgaaccactgtcttctgcttgcctagttccgtgtggccataggatattttgctgacaatcttgttggtacgaacatcgagttttgtaggcagcgaccagaggccgtacggcagttgctgatatccaccaatcacctgtgagtgctctccctcaaactcgtttcccatatcctgatcccacccggaaagactgagcttgccaatgttagctgcattagcgtactccaaattggccatatgccaattcaacagtcgcatatctttcggggtcagtgggagcatgcgctggtactgtcgcacaccatcatccatcacggcgcctaatgtcggaaacggcgaggctttagccacataatccaaattgatggtctggttcactgcaaccccattgtttaaactccaacccatcgtttgacaggcgaggcgagctggattctcctcgctgttgtcagagtcggccaatggggccccgaccggcttaatgtcagcggttttgtggccaacacctcgccggacgcgcttggcaggaaacagaagcccgatggtcccagcagccctggcttcttcgtattgtcttactgtaaggccgtcgctagtggacacatcacgtccagaatcgatgagatcccggtcaccttctgctgtcgggactatcacggatttgtggcgataatgcccggatcggtccagtatgtcattgtagagcatctcgtctgttgcatcccgcgcttcatccaccgctgagccatctatatcgtagattgtagatatgtcgcgcaatagatggtatggaagagccagctggccccggataatctgatccaaaggatttccatggtcaaagccgacaataatctgagcgcccatttcagccttgggaactaatcctggagccaaggtagatgactgaaggcttcgcaaaggatgcgagtagatacgacccccaatcctgcgccttccttccagtattatcacacggggagacgtgagcgggtcatgataatgattgaagaggccttccaagtggcgcgcacaccccagaccggccattccggccccgatcacaacaattacaggtccatcccgccgtcgacccttcttcggaggtgccggagcgactggtatctccacgcagccaaaattgatgtatccattgcgcacgaggaactcataagcgaatgatgcaaggttcatccagcgataatcctttgcacatcccatggcttcctcctttgagacactcagcatgggattacgcgtccacaaacgcagaatgccgtttcgaatgttcagatagacagtgacatggagatgacacatgtgatcttggagaagttcctgttcctttttgtgaagcgcgtatggatttagtcgggacgcatacgccgctgccacacattgttgggcgtagactacagcgggcatcctgggaggtatcgaggagcgtggccggtacttcgcctgaatagatccactgtcgacacctttgtggctgggcgacgaaaatgttgacgaagacataatattgacggtcctagctggagatgctgacgtcttctgaatgagactgggggtaaaggcctgcgtcttttccagatgattcgcagttgcttgaatcgtattaggtttataagactgtggtgttaggtctgctgcctgagagctatcctgcaactcccggagaaggccttttttttcagggtaacttccccttacgccaccgttaagggaggggttagaatgtacgaatccatttccatttggaagaccacttggatatataccctcagtttgctttgcaggaaattgagagggggatcctgttccagcgaggactgggcgcggtgccagcaaagggaaggagcctctgccagcggcatcaaaattggtgggtacatgatattggtccaggtgattgcattcgtaggcatggccatccggaccttgagtccccaaggcagcggccgatttcatgattgttggcaagggagctgaagtgggattctggcaagtgctaatttctcagaatgtaggtgtatgattgcaagtcttctgggactgtagcaaagagctcacgagaccaactactacactgcatatacggtgactgactgattgactctatggacacccatttcgtaaggtgatgtaggatgctaatgcttagcctattcatccatggcgagctccatcacgatcagtccattggacgggtgaagataaggcctggaccagggatgtgaaatgtatcttatctttcaattcaaggtcagcggaccactcgatatcatatatgatttgcgggggaacactggggaaagtccaagacaagtatgaatgagcctgacgcagggaatgaccagttgacatacatgccgggatggagttagtggctaacaggacaacaggtccttcgcctgcgaatccatcacgttggttggcttgtttctggcagcggcgcaaaccctactagtagtaggacaaggaaaccgcagggggatctgagtggtacggagtaggtagcgaccgacttaccggcaggaagagaataccgccgcctgaggagtggaatatggagacaacgaatcaagggatggggggaagagacacgatgcagaggccgaagggagtcagttcaaagtagacggacaatcttgccttgaggctgtcggactcgaaaagggaaagaaagtcggcgggaaattcggccggaaccccgcgtaattttcagtccgaccaaccaatactttcattgctttcgttacattcctgctggccgtcatcgtgtgctatcgtcagcctgaagactgacttcgtgtccatctccccctttctttgcttttccaagtcttctcttaagccagtcaaatctggctaagagcacctccgcgagatgctgcttttgcggtctgaccattgcccctctcagccttgctcaacgctcccggatcctcccgcaacaccagcgctcaaggtggacctcacacttcttgggacgttgcactcgtcaccaccgtctcaatattccagtccacgccggtgacttacaggacgaggtctttagtagtatctgaggattgccttcctgatcagtagacctacctgcagagattctaaagttactttatacaaggactaacacagcctggtgttcaacagtctagaggcatagccagaagccgggctcctatggcccctcgcccaattataatatttacgaaaccccccaagggaatttacaaaccgtcatgtccacccggaaagtgtgctgtcatcactcgtaaccgcagatttctatcacgtagccaccaacaccctcgccattgactgtcccgggccgactatgagccctagggtctccgcacgtgtgtatgtagggtatacatttcctcatgggtcccatctccatccttgaagacatctgaatcgttgtcggtaaactcatcgcgataaggggaggcttgtgtacggtggggggaggtctcactgccactctcatcgtcaatcgccaggtcgacgtggtcgtcgtcgaggtcgccgaatccgatgcgttcctcttcatcgcgcgcaagaagagcggccgcactgttgacttcaggatcctcggaaaaggcgtcatggggacgatgggcagcatggtcagcttgcagcgagcgtcggatgtcctccctttctttcgcctctagctctttggcccgggccaatgttcttgttgaattgcgttagtctcggatatcgggacaatgcaaggagatatcttgactcttaccttctatatatatacaatcccgtgaagataccgatgcaaatggagacgatgatgctgcaaatattgacagccttggagcctgcactcatctcttcattgttctccgacaagacgcgtaaccggttgccgatgaaggctggaaccagcagcttcggcgaaatgagtgctgtggcaagcccatacatcaacggctgaaccgtggggaaggttgagaccgccccattgcataccgagtagggcagcgggcagaggcggatcatacacagcaatttcaaaccgtcatacttcaacgtcaacgacaaagctgcaaatctcttatcgcgttccatcaaccggtggacgaatttggataggattgtccgagacacaatgaaagaacaagtcgacccaagcacagttgcggaagcataaagaagccatctatgaacggggttagccctcttgcgcacccatgaaaattctcaactcaccctttccatatcccaaagatgtagcccgccatagttccaaatgtggaccatccaaccaacggcggaaaggagacaaagaaaacacacaaccacaaaaccccgtaggctagaggagaatgctcccattgtgccgccacaggttgaagccaaatgaagaccttcccggtgaagacaagaaagccgattccaaggagattggccagtaagaacgcggccaccgcccctaccctttgccagaagttcatcttgcgccacgattccaggatctggtggtatgtcttggttgctcggtctatgatttgatctcggagggtagcggatcgtccgccggagatactggctgaatttcgcctccccggtgctcttcggctccatggtggataagcctcatcctccgacggagacagaggttctggggatgaggtcgagacggacagtgcccgggcggtggatgagtaatccgctggcatctttcaaggtggatgaataaaataaggcagctgaaggatagtcgagcgtatgtagcttaacttgatatccaatatgcgggatcaagcccggctcgatgtagagatcggggtgaggcgaatggacgcctgtgcagagagatgggccgacgggcgcaaaccagtacgcgacttggggttcggcgatgtatgaatgcaacgctgtagatgttcaatggtcgttcagaatggcgatgcgcagttgaaatcaaggagggcgtagctaagcccccgtctaggaacgaagcatgagtggatgggaagagcgatagaaagtggaagagtgagcgaggaagggtccacgacgtctagctaggcgatgatgaaatgggagctgtccggtaattggtcaatgagcttctgctagttgcagcacagaggaatggtctcggatggtggcagtgggaggtggaacacaagctcggattagaatggcatttgtcaatagagatggagatctggatgcgaaggaatgacaatgatagcagttcatctaggctctcctcatgagagtcagtccgtctgcatttctcttgaaggtggagtttagtgtctgcctgaaggcggcaatcggggaagatcttagtcaggatcgctgctgactgttccactttttctgttacatacgcctcgatacggggatttttattacgggcggtatgattgttttctctctattgatcgcaacttagtagttgacttgttgttcatgaatgaagttttgccctcgtgatgtgcttgacttggggaagccatattctaacattctacttgtggtagataaatggattgaccctatggcggcccatcgtctccatctcgataccgaccagcaagtatctatctgtttagtccggcagatcgaccaggaagccattcttagtgaggaattggcagccagtctagattgcccccccaaaaaggggggaaacttggtaaggtgacagcgccgccgtttctttggttgagagtcaaatcgcaccccggaagcttcagctttggttgattgcctgtcaataataaagaaaacatttaaagacaaatagaataaacaaaagtacctctctagggcgttgattggggagatgttcatcgggagacgccgcgtaggaattgtttgagaggggataacctccttggaatccatcaatcaatcaataccaaatccctccgctctctccgactttctcgctgcctctttcttgcttctctccccttctttctacttactggctttacccctctcacttctcctcctcctctattctctctctctttctctctctctctctgtgtgtgtcttgcgcgtcctccctctttggacctcctctttctccatctctccaacccagatcctcttcttatcttctctcccttccttccttcgtttaccggatccactctcttctccccctccccgtcatcatcgatcattgcacgacggtagatgcgatgtaatcacccatggacttcaagcttgtcccctgtcgcctgtcaaccttgctaacatccctgttttttattcttcaagatttcctcttcgtttcatgaattccagctgtcctgggaacaaatcatggacgtggattatcgaatctgacctgtcttctgttgtctccttgatctgattactgttcccaatctccaaacgccgattaccccacatcttcctgcacacaccgtgtatccgtcgccctcctacttcttccttccttcgttcagcccccccgacgatccagaatgattcaagaagacctcctcgaggactgtcttcgcatcctccaggatcaagctctggatgaagaagagcaagtcgagaaaatagaggattttgtacgcgaaaagacctccttatcaggtccgtccctagaaaatgccgtcctcgacatcctctggcgccatcgcaatcgcaccttgccagactcctcccctccgccgcctcgtcacacggtgattcgacgctcgtctcctgccccttggcagatggcgcgttctgcgaccccattatcccctcactcgaacctaggcacaagccccggaagtacctcgtggctccagagctcccgaggcggcttatcccggccacccctgtcctccaccgtgtcgcctttcacttctccgcgcccatcgcctcgactagctcttgcgcaacccatcccacactcccctaatctgaacgcatacgaattctccgatcaaagccaagtgtccgatttctacggcgacctgggtagcgatagcaatgtggactggctggttgctgacgacgctaacagcgtcacctcgtctattgggaccccgagcatcacaggagggctgagcgccacggcacccgagtttgtgcccgatatgagcccgcacgatatcttacgcactgtcctgggagacaagcgatcgaatgatgaaatcgaggcggccctggaagccaacagctacgacttgggcgcgacgatcgcgtcgctgtcgcaacccggtgacggtgactccatcttgccgcactcggaggacggccacgttgtggtcggaaagtcgatgtcaatggagccgcccaagattgctacccctcccagccagagtcgcagtccagtggtctgcaagtactggttgtctaccggccaatgtctccgtgccgattgccggtttagtcacgatctaaccaatcacctttgcaagtgagtatacccccgagcttcccaatgcctcgtccatgcaagaacaggacactaatagcagcacattcgtacaggtattgggttatggggaactgcttggcaggtgacggctgcccgttttcgcatgacccttcagctctcgttgcaaatctcagtgtggcagacggtacgccaggcacagcatcacctggcacgtcattccacatggacagtacctcggaggccttccctcccctgcagtctactgccgggatgggagaccaatgggctggccagtatcttggcaagtatccaggtcatttgtctgcattccctggcagcaagtacgtgcctcaggccatgcaatttgctgttggtaagcgaaatgggagtatgaccaacctgtcccgccctcattctcgaccagggagtcggcatcagcatcgtgagctgaacccggctgctccatcggtcgatgatccagacgcattccccacccttgctgctgtcagtgccaagaatacgggcaagaagcatcatgggaaacgcggaaatcgcgacaataattcaagcagagaaaacatgcctacatcactagcggacgtggttcgcatgtccccatctcctgcgcctgggaaggggaaatcttcgtctaagaacactcgggatggggttaaaggccgcgaacatagcgcagccgctcaggcaatcccaccgccgcagaacattccctggttggaaaccggttcccgagcgaaccaacaatatatcaaataccggacggaggctatccgccatggtacggtgaggaacaaattccttcaaaggtaaattgacacttttgaagtccgaaggcttgaagctaattgtctggttagtgctgctcaagcgtggaaccgcaatgacgcaagagccgcaaaggctttgtctctgcggggtcaggctgaaaacgaagccatgcgcaagtgtcatcgggaagcagcccggcaactttacgaagaacgtaacaaacatctcttagacgctggtctggatgatgcagcggaggaactgtacgttgacctgcatggcttgcatcccgaggaggccattgaatacctggaaaagatcctgctcaagcatgcccgtgaaggccggcgcgtagtctacgcgatcacaggcacgggccatcattccaagaatggcaaggacaagatcggcaaggccgtcaaggcatggttaaatgaatggaagtacctgttccgcgagttcagtgtccccggcgagcggggtggatatgttggtggcatcctggggattgaccccaccagctacgataaatcactagccaagagtctggaagatgatgcaaacagcaaggcggatgcggaccagcccatcttgaccatgggcaagatccagctgttgaagcgcgaagacctggagtcaaagcaataataaacagcaaatcttcttcaaacactcaagaaaacctttcttgatgctcgatctcccgaattcaacattacctccaactcagcctagcatacgctttgggagactactgggttttatgtgaattcttgtagggaagtgatagtcccggagtataagaggtgatcgatagactatctactcaaatcttttcttgatctcatttcggttctaccttcccctcatccaacaagtaccataaatagttactcctaatttgtcaactggcttgactgaatttttgtatatataactcctctcactcaagacacaaacaccacctagtacaagcatgctcactccggttcctgatgcccccactcctccctcaacttcccaacatcaaatccacacgcctccgccttcctaaccaccgccctggccttctccgccaccggcacatcaatcattttcccatcaagcgtccacgcaccccgtcccgctctcgcagccttctcatccgccacacacaccctcacagcccacttaacttcttccggatccggtccaaagatcgcctgcgccgtctccacctgcgacggatgaatacactgcttcccattgaaccctagccgtctcccatcgcgacattcctcctccagcaccgcaggcggggacccgtcccccttggtagatttgtacgctgtgcagaccaaatcaatagtagagggaaggttcgcagcgcgagcagccgtagcaatcatagaccttgcgaagaggaattcagttaatgacggggtacgggtgatgctgaggtcgagtgcgaagtcttcggccgcgaaaatgaggccctgcaggaggggcgtggaggcgcagatttgggtgaggtttgtgagggatttggcggactcgactagagcgaggagggagattggaggtctcggggtggaaggatcctgttgttgttgttgggagagagtgtgcgtgatgacatcgttcacgaaagtaaggtccgagggggtgttgactttggggatcacgattgttgtgagattgggagatttgagctattatcggatttagtgagttgaatggaggagaaaagtgagggatgataatggtacgcaccacttcggtgagatctcctagggcgaggccgctgtccacggagttgattcgtacggctcgttcgcggattccctgcggtgcgggctcgtcgagtgctctccgcaccagggaccgagcttccgctttcttgtgcggagttacgctgtcttcgagatcgtaggccacgcagtcggcggttagagtgcgggatttatcgatgaagcgttgggaggagcccgggactgggattcggggttagttagggggtaattggtatagtcggatagcatgttggggtgtgggatgagtgcggaaatgcggggagagctatgggttgggaagagaagggggcagtgacgtactgtagagaagggcgcgacggagggtgtttctggcggccattgttgatgagagggagagtgttcagttgagctgatggtagtgagtttgggatcacactgaactgcaatgtctcctgttggattgaaagaatggagattgtcggatgaagctgctgcagcggttgcggattgacccgcaactttaagagatcctcggtttgcgcataaaggcttctccagtcaggaaccggccgatgacctcatccggcaggtgtcgcgactggcccgtatttagttcgttccattggcacttgcattattcacctgtgacaaccactgcctttgtctttcttgtacaccaaagtgagcaatatgaaagagcccgagtgccgatcgcgcatgaaacagatgggagtcggagaaataagatgaaagagtgtcaagtaaccgtccgccgctccacattctgccgcgccccaccgcccctggctggagacacgcagcatcaacgcaatcccgcctcgcatgatctggactcgtcaggaggctgcttgactgccgtctatctcatgtgcattggactgtttccagaggatatttcttgacttgatcctgccccttttttgtcatcatggaacaacaaccgctccagccgcagcagggcgaactgaactggcgcctcagtgcccatccgattactctcctgttcttcctgggctttcgcatcggcgccctactgatgtacctcttcggcgtgctctttatcaagaacttgtgcgtaaaacacctttcaaactcaacttcaggatcatagctccctcaatctccaaacccggaacctcccagagctaccctatctagatccgagcaaacaaccaagctaaccactgcaaccagcgtcctcgtcttcatcatcaccctcctcatcctttccgccgatttctactacctcaaaaacatcgccggtcgccgactggtcggtctccgctggtggaacgaagtcaacacttcctccggcgactctacttgggtcttcgagtcctccgatcccactacccgcaccatcaccgccacggacaaacgcttcttctggttgagtctgtacgtgacgcctgcactatggattggcctcgccattttggccattattcgtttgagcagtgtgatttggttgagtcttgttggtgagtttatccttgcactctttctcccagcaggtatataagaagcgtggatgctaattgtatacagccattgccctcgccttgaccatcaccaacactgttgcgttctcccggtgcgatcgcttcagtcaggcttccaccttcgcgaatagtgcgctttcgggtggagttatgagtaaccttgcgggtggcctgctgggcaggcttttcaagtagggtgtatgtctttgaaaagaattatgctgggattcatactgggtatggatatcggttgtcagtttcgtttttgatttgttcttctaggtgtggattgtggggtgtagtggtttctatcggggaggatggagcaggatatcttaggggaggggagctttttgttttgtcggttatactcttctagcgttatcggttagattttattgtattgtatcgtatgttactactactggtatattttgagcttgtagtttgtagtctgatatctgactagctgtaaaacgagcctatcctcgtgggggatatatagctcaagcttcaatggagctatcactgaacaataagatcaggtggataggctgaagaccaatgtgtaatcctaacattatcttattccattatccagctaaaggtatctggggtatttgcaccctgaatagaccatcatacgcgataaataatcaacaaacaaattgtagatgctttgcgctccatttcaggcacagtcaagttcaaaaggaccatccgccctgacggaacatgaaacccgtcggatcatacgccttagcaatgctcgccagtcgcgccttattcgttggcccataactgccatatacgtcttggtagtcggcggcatcgttcatgaagagaggattagagctatcataattgttagcgtgctgcactggacgaagagagaaatgaagggaaggaggacacgtacgagatccaatccacatcacccgattgataattcgtcggcttagttcccaacagcgtgttattaaatgcctccttcacagtatcacccacctggcgcagatactccggacaagcatcattgcaaaccggattaacccagatcaagtcattctcaatccagacacgatcaccgttcgcagggtccaggccgagagcattaccgccggccttgttggaagcacgagcaatgcgcactgatagcggttgcggggtaaatgtgccgatctggatgtccaagttcttggaggaatcgttcttgatcatggactggtaggtagtccagtggttttcaagcagttgggtcatctgctgggacggcatgttggggaatgtgttgacacgaatggcagcgttgatgccgtagatcttggctccgcctgcttcgttcgttagatcggtgtaggtggtggtcttagtagagtcgataagggcttcgatgttgtcgagtccgacgaaggcgttagtgctgggcttcgctccatcgtagaagaagaaaacggctgggttggagactatcgctccaggcaagccaaagtcgaaggttgggatgacggcggctttggcgtccgggtattcacttgtgaagttggagagagcttcaaagatttgctggcgtttgtcggcgctgtaaaagcgaatgccgccccagacttgcccgttgtcgccgagtgggtgaccctggtatgtgaacttggtaacgatgccatagcggttgccgccgccgcgcaaggcccaccagaggtctggattagaggtgctgttcgcgttgacgatggtgccgtttgctaggactacttcgaacttgaccacgttgtcgcaggataagccctgagttgggttagtgctggacgtagaggaaagggggcggaggagggatagggcaaggtagtacatattgagctgagtagtatgacaatccccctccaatcgtgaatcctgccacgccgatattagccaatcggccgcctacgacgacctggttcgtcttctccgtgacagcgtagacatcgccccatcgggctccagggccgacgtcgaaagtctggccgtctgagttacgcgtggttgaggacaggttctcattgaacgagataaggacccccccgttggtacttgagagtcccacattgaaattgtgaccgcctcctttcaatgcaaagggtgcagtgggatatttgttcagctgctgaattgcgacggagacatgttgcgcgtttgcagggaaaaaggcgcaggccggacggttgtcagcattcacgccgttccagtattccttgactgcattgttgtagtaagactgattccagaatgtttcagttgcgtaggtgcctgtggggtcccagacggtgtactgggggtaaaccgtgtgtaggtgctggcaaacagacactgcgtcggtgtttggggctgccaggacaggggccactgcagccagaagaagagcagcagctatcatcttggatacgaaaagctttgctccgtgtagtgggtggtgaaataaggcatcctaattaccttaaatgccaggctcagggggtccatgctgaatggattttgtataatcggttgtgatcgatcctcaaaaacgggcaacattccgtgtagtatttgcgtatttgcgtattcgatttaagatcgacacgcacgtttgagctaaaacagactgttaaatgaacggtcggatgggggacgctcttcagagacagtcatttcatctaagcggagggggatctgcaaggaacctcgaaacgaagtctcaactttgggattgaccgaggatgcacgtgtttcccccctgcttcatgtttctaatggttcagtgggttttcttcagcattactcaggtgttttagaagcccgtgggagattaccgatgccatgggtacgcttacagtatatttaatgctgtcagctgcaattcaaatctgctgctgagaatacatcagctcataccggatcattggaccgatgagatactatgcttctcggcatgttaatgagcatctgccaacctctcatagccttgtttgaattgtaatgttgtatttctttatcagttgaatcatggctgcattcaaaggtaaagatctctcctatcctaggcagtacaatgtattccataaactgtgacagcgcagtgtatctcgacaatcacatctatttctgcgaggggaaaagagcaaataaagaaaaaaaaaaaataaaaagaagaagaagaagaaaagacaaagatgcttattcttatgtcagatggtactggagcaagggacgacctactcagcaaacctacagggcacggcttaaggatacatgatatacattcttcgtcagcagtgctgacagaggaagccgaaacatggtaaccacgatgtcacctcgtaatagtactagaactagcaaaaccacgactcatccatattatgttcagctttattctttgacctggcccgccaactcttgctctcctgaattttgcgcctgcgtcggtgtcgcatatcaagctcaagattgtatggtcgccgatgccatctctgctacggcctgagggcctaagcagatagtaagaaaagtcgacaggtacattgcagataatgaccgaatgccagttagtcctatataattgatagcgatcagtttaaaggaagatagcatcaacgaaagatggctcatttaaagcagttagatacttctgagttagagaagaagccctgtgggactatgcccttttccacttgctggaaatgacctagtcagggtccaagagtcaggaatttgatatcaagcatttaccacgagagagtctgactcattcgggtctgaggtgtgcggaaagacgaatcatcatttgggtcgccgccagtgttggggagcggggacaaacttaaccatatccgtgatgatcagctcccacagttataaagatcgccgcgctccattcgcattttctcttatcaatcagtgtgaagattcccataacaatggtatcctctatgtctgcgtccagtcccagcaaatgcctattcttacgttgcgataaagtatattgccaggtggggtactgataaactgggtatagagtcacatgattgttaaactagatattctacctggattgtataatatgcaactgacaattcccaagagtcgctgagttgagattgaatggtcgataacaggactgttcccctcaggcctcaatgctggatcactagtctcaaaacatacaagcgcttattccttagtcattctatcttggctgacatgtattaattattttggttgtcagcgaactgaaacccgcattcttccaacttcacgaggttcaattgtctcttacaacttacgcataaatttcttcctcaattactatcgtgtactctaggatgtcacaaaacactacgaccacagtacaggagctacgcctgggcacccgcaattccaaactggcactagtacaagcggagcatgtttccaaggagctgaccagtgctcaccccggagtccagtttccctggcaaacggtggtggtgcgcggcgatgccgacaaaagtagccctttcctgaaatttgcagggccatccgacgcagcaaagaacatctggaccgaagagatggaaaccaagctgtgcgcaggagagctggacctcctcgtgcattgcctcaaagatatgccgacgcgtctaccagaaacctgcacactaggggccattgtttatcgggaagatcccactgatgcgttggtgataaaggaggggctgcggtcgcagtatacggatctgagtcaactgccccccggttctgtggtgggcactagttccactagacggaaagccctacttcgatacagatacccgcatttgaaagtggaggaatgccgcgggaacctgtaagaagactgcccctttttgtcactgagagttgactcttttctgacttgacatggcagcggaacacggctgaaaaagctagatgacccagaaggtccattttcggcaatcatcctggccacggccggtatggtccgcatcaatctggaagatcgcattacgaaacgcttgcctccctcggagttcccgtacgctgtcggtcagggcgccctgggcattgaaatccgcaaggaggacgcccagacaaagaccatggttcgaaaaatcgaagacctggttacccgtcggatctgtctggcagagcggtcactgctacgcactcttcagggcggctgctcgtctccagtcgcagtacattgcactgttgagcaggcaccaacagcttcctcgccagctcaattgcgactagatggtactataattcatccccacgggacaactttgctatctgaacggacgacagcggaagtgggaacggacgaggatgccgaggcgttgggtgctacggtcgctcagcaattgttgaagaatggcggacaagcattgctggaagagattcgtctgttacaagagaccattgcgacagatgcaaaatagaagaggacctgaatatgtacccttaactagtagaattaatccccgctcaatgtacatcgccacgactgcttatttctcacgctatctgtcacccaggcttcatctgtcagtaagatggtcctttctaccgaaacagtacccttggagccacagagtagcaccacattgaaaatgattggacaatgtctttggctgcatgagccatttggaaggactcataggcacgccgcgaaaaaaagtgaagtacatcatgggctcagccgatcagcaatcaaattattattttttacaaaacctcatacatcgcaatttaacgcctcaccaaactcgaatatgatggcgaggagtcagaaaaaaatttcatgtggaaatatatcctcgcttccttactcggatttcatcacactcgtcttctccgaactagtcactctacaccaccatggtgacttcctatcttgacaaccacatcgtctagacacccgacatatatatcgaggtgggtatagctataccaccactttccctccatcatcattatttctagcattcctaggctgtcttttcttctaagctttgattatcttcgagacaagatggttcccaaatccgcagggaacacaggggccaccctaacgacccttccaattaagttaattgtgtctattgtgtcatatctgcccaatcgggatatcaaatcgttacgcttgacgtcccagcttctgcacaaactagcgcaattacgtatagaacgtgtctttctatccgctgaccaacgtaacctcgaagtcttccgtgcagttgccgaccacaaagtctatcgccagcacatccaagagattatctgggatgacacgcggctgttaccacctcctcagttctcggtgctagattacggacgaaatccagaagagcgggtcccctacgcaggagctgaactctggtacctcaatgcttgtcaagaaaatattgaagatttgaggaggtaccaacgtgactatacggggttagcagattgcatagagcgggccgagcaggacgttgcttccacattatggctgaaagaatctttcgacctctatgaaaaattgagtaaggaagaggaagaaaacattcgcactaacgctgataaggaagccttcgagtatgggctaaagcaatttccagccttgaaaagtgtcacaattacacctgtaacgcatgcgcgagttttttatcctctttatcaaacacccatgattcgcacgttcccgcctgggtttaattatcccgtcccgcgcggatggccgacgcacaaggagaaccatccggctctttctctgtggactgatctacacgagcactggaaagacagatggcgtggattccgggctgcactgcatttgctggcaagagacagagagcaccacaacgtctctgagctcattttcgatgtcaaccagctggacacaggaataaattgcacgatatttgaacaaccgtgtgaggagctcttaaaccttttccttattctcaaccagccaggattcaagcgacttgatcttgctctctcataccccaatcaaaaagaacgtggatggccggtttttcgcaatggtaatctgcgagacgtgttgagaaatgcagctgatttagagcacttcagcttcaaagccagtatgtacacgctccaggaaagctcgtctagcaatcgatgctttccaaatattccgcttgataccattttcctagtcgcaaaatggcagaaactacgccactttggactttcaggcctctcagtcggtactactgacacggtcaggcttctggatcgactgccactcaccacccgctcggtcgagttgagctttctgggtttctcagagcctgatatggataattggtcaattctgatcgaagggattcgtgaccgtacccggtggagatatcgaagtactagtaggaggcctaagcttattgtgggtgtggatgtaacgcggaatagacaacctggtctaggcatctggattgaaagggagatacacgagtttctgtatggaaatgggctaaatccatttgacgagaatggttgtgttaagccaggcgtgggatttgagcgtcaatccaacttatgatcggcctcacgttcatcccgaatggttggactggttggattctatggttacttatggatttcaacacgtttgcaaagtgtaaaattagatagtgccttacgggttccatatcattgatgacttgatgaactagtaccagtatctgcctataagccgatagaccgaagatgcattgcaggagaggttctggtactactacttctactactaccattccacatggtctgtagtttctcttggaaatgaacttctgtttgcagatttcagcaattttagacttctctccctagccaagtgagcaaatcaaaaagcaaagtgtttgcctgaagtatagcaatgggccctccaagagtaaagtttctggtcgaggagggagccgacatggaagccgttgatcaagaagggaatactgcgcgtctccatgctcttgagaaccgttacatggaagtagtcagtctctttcttgacatcgacttggcaaatgatcggtgcaagattgggtccgtgctactctccgcagttgaggatgatgaccctgagctggtcagccttctaatcaacaaggatattgacccgaactcaagttgcaagacgggcattggccgcggtgattgtacggttctcacttgggccgccaagaagggatacacagagctggtgcagcaccttatccactacggtgcagatgtcaatttgcaggataacgaacgttggactccacttgctcgggctgcacaatatggtcatgatgctgtcgtcaaactactaattgagcacaacgcctatattgattttcctaacgataacttcacgcctcttcaaatcgctgcagccaacgcgaaccagagcacggtcaaacttctcgttcagcatggagcgtgtgtcgcgcacttagatctgactcccgattcgcttagccttggatattacgaaatgaagcaattaagttcacggggatccacaatagaaatgagggattctgagggacggacacctttgatttgtgccgcagaaaagggtgatgttgccagggtcagattcttggtcatgcacggtgctgtcattgacgcgaaagctgcaagtggtcgtgcagcactcttgcaagcagctgcacgaggccactacgcagtagtcaagatactgctgaagtatggagccgatcagacagtacgtgatgatgatggcgcagatgctgttgttttggctgttaatgagggccattcagagatttggaagcttcttcataaacgcttgggtctataatatatttctattccttggcatgaatattagacatcataacagggtggggctcaatcgaagtccatgggttctgttttctcggagggctttatctgtaatgttgtttacccatctgctttcttctgatgcctgtagttagtagtaatagttgattcagctacatcctttgtattccaacagtttggatacatatacactgtgactaactcatttattgaaaaactttatataagagttggcaatatgaacaacgatgtcccgcccaagtaagctttgctgtctactttcaatccgggagtcgacaggctcaggcgtttgtaattcatctgaagcacgtaatacaaatgactggacggacacctcctgaaatagttgaaggtaagacctccactgagtagaagtaggtatatttatcaaagatctttttgcttgttctgtaatcaccgtactcctaagcggtagttgaagttgaattcaaaaaaagagtggtaaaaggtcccggaaggcaactctttccataacattccaagctaaaccctgttatccgtcaattaacatgtgacaatctccaccaggggacagacatattcgagcttcgggacttttcagcttcttttacaaggctgcaataacaatcctgtgcctgcaaggctgagtgctcgtggtggtgttattccatcatctgaaaccctctaatgcatggacgaggtcttatcacagcgcttacgcaagtcgccaaaactgtcatttggcttgcgcaggggttgaaagccaactattgtgcatccgccgttccccggcacgaggctaacgacgcgtctaatgcaccttcgctgcgccgcatcgctcctttagtgtactttttcaatgtgttatcttagagaaattgtctgttgagagagtcggtgaaaggcggatagatctctgcctggatcaaacccctgatagcgtatagtattccatatactgtaatccaaactagaggcgggagtgaaaattacaggaggtattcacctggagagtgagttcaagtaccgcgtattctatctaccagaaggtatgttttgattgcgaatttccacctcaacaatacaggaagcctgcttcttgctttctgaactgaactagactcaacttcagttctgcctgttgtggcgtttgattcagccttgtcggaagccttctttcacccctgctgtgttgggagttttgttatgtctcttgcaataaaaccaattaacaagattttcctgtctcctcaagtgtgtccctccgtcttctgttatcaccttcctcatgccgaccttcaagcgcaaagccaggaagcccagagcatgcgtcaaaaccggtggactctggaatgatgaagaaaggcagcgcctgtgggatcagcggtcgttgtaccgccacatgcactggaagccatttggcaaggtgtgcatagcttgttcctttcctttcatatatcaccctctccacccatggtggcatactgactctacgcagatattcttcccccatagaagtctaaacgctcttcagaaggcatattccgtatgtcatgttatgctcccactaccaggacctacctgactttcgcaatagaatatgagtatacagagaagactaacagccaacatggtatgtttggcccaattcacctccctatattgatatctatcgtactaatgttgcagtcaaaccctgatacccctcaggatcctcctgcaggccgcattgtaacgctacgaacaagggccaacaaacgttcactgcctgacgaaagcgcgcctgagagccgtccggggaagcagaccagaacagctgcggtcctttcttcggggaaggaccaagtggaagaaacggatcaaaatggcatgacagacgaggatagctcttcggactatgaacaagactccgatgaagagacgcttcaggggcccagtctaccttttgaagaagaagaaagtcaagatggaatcgagacaatcgttatcgatgatgggaacaatgatcctgaaagccaccagaacggtgaagaagaagcagaggtacacaggcctgatgccgaggaaaatactgatgagcctgtctctcgctccacagtaagtgaaacgatacacatgctcactagtcttgtgtcaagcttacagactcatcctagacgggcgtttccagcaataacccccctcctacaggactcatgcctggacggaaaagcatgacaccaagttcaagaagtgaagaaaaatacgcaggctacgagaagcttgcaaaagaggcgactgagcccactaggccttcactcccaccggacgtacaatatctcaaaaatctcacatggaggtttgaaactgtatttttcaagacgcatgatcaggagaaagtcatctcctcactgcaaagccaggttgaggatctcaaaaatctcaactcagacaaggctgcgaagctggagtccgcacaagaggaggttaggaaacaactccagactataagatccctcgaacaacgcgagcagaagtataaaaaggagatcgatgactggaaacgcaagatcaaagtttccgaacagcaagtcaccgtcctcgagtgcaaggtagctatggctcgaaaccagaataaatgtgagacgtgtgagagggtctcaaagtttttcgcaccggcttccgcctcagggaaggccggtgagtcttctggcagctcaatttcatgaaacattcggtttcaactgatttgatattatactcagcttctttcgcatcattatggggcggtatctatgcacggtctccccttattttatagtcatacgaacattttgcagtttgatatataatagcaggcccatttatgttgtattagcaagccctctcttattgcataaatgtaccagacgaccgccactagtagtagctctgtaatcgagataattgcgatagttgcttattcaaagatatcgcggtcaaggtctgcggtttggtccatctgcattctagcatgccttgaggagcggagagcaccctgtcatagtattttaatggctagagcagtcacttgtctaggcgcctcagatacccctcattcgcaaattgggatgcttgaaaagatatctaaaaacaattgagcctgctctgactcttcgtgccgactacactggtttaggaattcctctgttgggagcttgatatgctggaaaacaaaatcggtagtcaatgtgtctagcgggttgcttgtaccctcctgagggtcgttgtctgtaggtatgtcagtagacaatagtctataaaaggtggttagatggcagatttggcataccaagcgcatcaaacaccacaagtagtctttgaatacagtagtccgccttctggttcacgatgcttcctctgctgttaatcctcatgatgtgaaggcaggattctatttcttggcgtatctggggtggattcggctcggaatttgaaggataatgttggcgaacgaggaatagtgctaggcagtggaggatagctgtgaagactagaaatattttagcacgttggttcataagataggcttcctttgggaattacaaacttgtatagttgcatgtataccacgatgcatacaagtccatgaacccctggagtgtggaaatgtgcgatatcaaacacctcaattcttgtattgcgaaccagtcatcctggaggatttgggaccgaatgcgctggatatattccctgatatgctctcccgttggcttcattgagtcagatttcaagaatttcatcattagagggaagttcatgatcaatttcagtctatggtattgtatgcatagaagtgttcgtacggcccagcgagtatctggcaacgctgacagctttagtaactcttcactcgggagcaaggcaatgcgatcgggaaggctgtcagcccattgttcgagcctgaagtgtaagagttcatgtttgttgatgatggcttgtacatcgagagattgacccgactccaaattctgatcgtacagtgtttcgattatgtcggccaggagtgtgttagatgatctttatagagtaagcatatatcgctttgtagactttgggggttaaccaacgttatttgggagagataaatagagcttatatcccctggcatcgcgtgctgtttcattctaaaggtcatttcaaaggagtaagggataagaaacggtctcccctgggtcaaacccataaccctgataaaagccaggttactactaccttgctgaacatggcacccaaaagtgtgagggcaatcatatcttccgatattctgaaaggacgataagtggcctgaacatacctgtcattgttcagaacacccatccatatcttttgatgtagcttttcaggtgtatgatcacgagcatcccgggcagaggcacaatgaaagcccatctgcaatgaggttcttacacagtttgtatgggttgtataacttaaagtagatctttgatgattctgctcgtagatggacttcaacagtaatacctggactgtattactgtcaaatcaagtagaacgttgaaagtataatggaggctgacctagctcaacagtgggtctctccagtgtccgctggtctagaagacccgcacaatgactatagaatacttctgcttccggaagctgtaaggatgcagatgcatgtgcccaaaccatattcaaaagagccaataaacccctttgaaacctgggtggtctttcgaggtgagccttctcataggagtccaacactgtctcgtagtcgacatatggaaggaccacactgattgtagtggaaaagcgactaataagatacagtgcctcatctctagacggaagagcgtgtatatcctccagagatattgagagctgcttcaccattgatgctctcccactagttggtctcataccttgttttgatatgttgcggctatgaacagcagtttgtgcttgattgctcaatgtgaggtgtaagagagcgctttcagcgaatgcgtttgagacgtgtctgaacatggcgtaatttgagcttgcccctgcccagaatgattagcttagctggattccatgctagaggactgcgtaccgaaataaatatggccaagggatgtctcagagaaagcatgtgtagcgagttcatcaacacttctgtcttcgttgactgtttccccaagctccctcagatctgacgaacgtgtttgcggttcagcctcatggcagaacttataccccaagacctcaactcggcgagataaatccttctgacctctgtgaaaccaaaattaacattcacccttcgctataatagcatgcagcttgacctcttatccgttggacgtcggatacccgactctataggctgctgatacttgcagtctctccccctgtgccgacatcgtgcacacgccggccttgttccctcacactaagagtatcagttctttgtatacagaattgacagatcttgtttaatgagtagataccttcagtttccggcatcgacattccgaacaggcaacctcagttcttcgcctgcgatgtggccgatttgacatggtagcagatttacaagatgattccattgggcgtagtgagagacggaagcaagcattctcagctcatcaataattcagtattctgtataatgcggggaaatcagtacctacccgatctccatcacctcctctggaccaatcggattcgcgcttcccgagcgtagccgaaggtatccccattgggctgtaaaacatggaaaaactacactatcaataacgagatggcctacttatgcaactgggaaaagctattcggatggccgacctcggttatggatgagaataataacagctcacacaggtttggtacgttgtagacaaagaatctataagagcagcgggatggaagcataatatactacagtaggccaaaccatctcaactatagtacttgccgctttaatctaaaatacgagaaggagcaaaccacatactttaaagatgaccgtcttcatacagaccattacatctactcccatgaccagcgctggcctcttcctagcgctcatacttattgtctactctatctaccaacgatatctacatccccttgccaaataccccggtccattcctcgcatgcctgaccgacctctggcaggtctaccagttcctgaccctcaagcagccatataaccttacagagctccatgccaagtatggaccaattgtccgatacggaccagacaaactcagcattacccacgaaggcgccatccaagcaatctatcagaaaggtggaagaggaatgccaaagacagaattctacgacgcatacggcgcagctcatccgaatgtattcggtatgcgggatgaagaagtaagactttttcttgtcctactataagaattgctagaaagcttttctaaatgtgattagcaacactccatccgcagacgccatatgtcccatggtttttccatgagctacgtgaaagagatggagcaatacctggatgtgaatattcgaattctgagagataagatcagggaacatagctctcataatagagcatttgacctcaaaaaggctctgcattattacgtggttgacgtccttggtgagctggccttcagtcaatcattcggaattcaggagacggatgacgaggcgcgagtcccgccagtcatcgaacatagtctgcttgcggctgttactggtgcctggcctgctatgacgacaacactgaaaaaatattttccgcttgttccatacaagccacttcaacagctctttgctggccgcaaagcttgtgccgatctcgcgtcggagtgtgttcgacgcaggttgggggattttggtggaaatgggatgtccaaaagcgacgataggaaggatatcctaactaatctaatattggctaagcatcctgataccggggaacatcttacgcagacggatcttgagactgaggcttttggattcatgtacgtctcttttcacacttcataatgtatctgtcatcaaatactaaagggagttacagcatcgcagggacacacacgacgagcgccacgacaactctgctattttaccacctgcttcataaccctcgatatatggaggagtgcgtaaaggagattgagaccaatctgcctccccttacatacggagagacagcatattctgtatctgccgcagaagctgctctaccgttcttgcgccactgcataagggagaatttccgaattacgccggtcttcacaatgcctctagctcggagggtcatgagtccaacgggtgtgatgatagacgggcagcatataccacaaggggtaagtcgatgtatagactacgtccacaatgccgactgttgtgctaatgatacgcaataactgcagacatcaatcgccgtctgcaaccacgcattccatcacaaccctgacgtctggggtgatgatcacaacatcttcaacccgtaccgatgggagaacactgagattgctgccaaggcacggatattaatgcattttggccttggtggacgtcaatgtattgggaaaaccattgcaatgacgaatatttataaaattatgagcacattgttaagggaattcaacttcgagcttgctgataagcaggctcagagaaagggcatacctgaattgattagtgttgggattagcgatctgcaggaggcattgatggtcagagcacatgtgcgggtgcaagagaaggtttagtgggcgcataatttatgaagttccgggaaccataattttctcacaatcaatgaacaattcccggagacagggcgggaggctgtataagggaccattttgccggggcacacgccggacacaaatgcaaatcatcttggtattctgacagattccatgtggctcctttcgtagacattctctgggagcccactgttctctatcgtagtactgcataggtcttcaccgggatgttgacgacgaccacacatcggaaattccgagaatacgaacacagattgcttggcgcattggcacgataaaaaccacggtatgatacctgcttacactgttattatcaagcatagctacccagcatcatggcaaatcagacacgagcttgccgcagggtccctgaggtcggcagttggctgcggggaaattagcttggcgggcttggagatccggggtacaggtcggctaaatttttaggccctttcctatattaggtgagttgggttgggtgtaaaagtagggtcataggcccttaaattcaagcgtatcctctcggcaattccccattaaccgcatagcaagatggaaaagcccggtgttcagcacattgagagtgatgttaatggcgatgggaatatcgccatcaaaggcagagatcacaatgatttggaatctcttgatcggtcgcatgaagaaaataccaaacatagtgaatcagatgctttgacggaagaacatcgtcaatatttgattcagagatatgggacagtagaactggaccctatcccggacatgactgatgctgatccctataattggccgacatggaaggtatgtttcaccttataccgagtcaaactccaagaactcaatattgacaggccattggtgtagaaaattattaacttagcccttgttgcgttccatgctatgatggcgacatttacagcatcttcaattcaatccgctttcgttgagatcgcagaggaccttggagtcagcgtacaaagagcaagctatttgacttcactagttatcgccatcctcgggggtgcgcctcttttctggatgccattgtccaaccgctatggtcgacgtcctattttcttgctttcgttgctttgcagtctggttgccaatgtgggctgcgccaaaagtccgtcgtatgcgaccatgggattttgccgggcccttgttgcattctttatatgtcctgccgctgcaattggtagcgctgtggtcgccgagaccttcttcaagaaagaccgcgcaagatgtatgggcgtgtgggctgtcatggtgactttgggtgtaccgcttgcgcctctgctttttgggttcgttactagtcgagtgggatacaggtggatctactggatattggccattgtcagtatgaatgtcacctaaatgggagagggatgctaactgtaccagaccaacggcgttcaattcatcatttatttgatcttcggccaagaaactctatacatccgtggtagcgctgctagtcacgtcagtaacccaaccctccaccaacggttccttcatgtgaagcgcattgatccagcgccattggagatatgggactttctacgccccctcggtatggcaatccgaccctgcgttatgattccagctgccgcatatgcgatgatattcctcctcggtggtatcctcccctccattgagatgccgcaactcttccccgagatgttcggacttaattcagagcaggttggtctgcagtttatcgcgatgattatcggctctctgctcggcgatcaggtcggaggattcttatccgaccgttggatgttgtacgggcagaagaaaacgcagcggccagttgcaccggaattcagactctggataagctatccaggtattatcctgacgatagttggcgtcgttatcttccttgtccagctagaccatgcttcatcgcaatggaatatcactccgttggtcggggtcaccatcgcggctgttggaaaccaaattgtcactaccgtaagcttcacatatgccgtggattgttatcgatcagaagcagcaagcgttggcgtttttatcacattggtgcgacagacatggggattcataggaccattttggtaagttttctgtgtttgggagggagatgtggatatactgacagtaaatcaggtttccgcaaatgttggaaaatgttgggtatctggggagtacgggaattgcgattgccttgattgtggctgtgagtgctattccaatggctctgttgcattggaagggtaagaattggaggcagaaaagaacatgaataccaaatggcttatcctaacgcaagttccgctgatttctcattcagcctcatttttgctcaatttacttatgagcagctgcttattgtcctgctgcctcacttgagcaatggccgagcatgtatagtatttagacattcaatccaatgtgagatacagactgctataatcctggtggagaaggggagggttttatagcttgcaagcaccggttttatttgatatccaagctttataaccattgccagttggcccttataagaatcagtgcctagcttggattctctgtaggtagtggttagacactcttcatttatgtctactctgtcaagggtcctcaaactttgtgccagactctatcccgcatactaaacgtatagcaacttgtagtgtcgattgttggggataacaacatcgcagcacgtgtgagagaaaacacggattatcagagaatatatagcgcgaattcacgccccaatcaagctgctagtagactctgttaattgttgttaattggcattctatcatggcgttctgggctctgatggtgggcctaggtggcgttcatattgaagaaagtggcgctagcacaattcacgaagatgcactgccaatttacaatttgtcacctgaattctagagattttatcgcacagctagctctagaagtctatactaggcaatattccaatattgcactagtagcacctaagttccttttgagctctattgtgttgctattgctatgtgggaacatctctgaatttcttggaggatgattagtactttgactgtaccttccatcattggtattcctcgcttaaccttcatacaatccatcaacaggggatcgttggctaggtggaccatccttgggttccacaagactaagtcataattgcttcgtttgctcgtaaatggagaaacccgtgaattggctgatctatcaccctgttgttctgctcttcgctttttgcaggcccccagacgggaccccgctctctcatttccctctttctttttctcctgttcaaatcttccgtctcttcctttcttctccaggcctcctactttgtaccacggctttggtggtagtcctttgcagacaagtaagctgaactatcctacacaacgtgccatcgataggtaagtgttatttccattctcttgcagatatatcttctcatcaattttgtcttttgaacattattacttcttgctggctcatctaacctgtataccgaacgcgtacttgcgttgttaccgaatggattaaactgcaagttgactgactacaccagtgcatcgatactcatctagcttccatcaactacagattgtctcttcaagatggctggctggacacttgaaggagatggtgacgacactggcaactggggtggtggcaatgacggcggtacgtatcctcttgggaaacaagttcctttccctcaggatggcatgttgttaatcatgctccatcaaatcttgaagttttatgatactaagagataagacaggtttcggtaatgatgagaacactaggcccggtggcttcagtactgagtccagattcggtggtgatgactttgctcctctagctgaaggccatggcgatgataatcggtgccggaagtaagtaccttcctacagatcctcactgtcgctaacaagcgatagctgtggaagcgatggtcactttgctcgcaactgtcccgaaccgcgcaaggatatggcctgctttaattgcggcgaggatgggtattattatcatgtgccttctcaataatatctttgatctgacacagcgttagacacaacaagtctgagtgcactaagcctcgtgttttcaagggtgcttgccggatctgcaataaggaaggacatccagctgccgaatgccctgaaaagggtcccgacgtgtgcaagaattgcaagatggaaggtatggcatacggcatgttttaaacaagtatacatcgctaatggctcgtgaaggtcacaagactatggactgcaaggaaaaccgtcgcttcgacttgaatcatattcccgacaagcttcctgaggaggcttgggctatcctgaagaaagctagtgacgaaagagatctcgaggatttccgtgaggtaggaagcacttatttgttactacttgcatttcacatcacggatgtgaacgtgtgctcgttgtactaacatgacccagggacttaaggtgtactccaagtctcttccgcaggccactttcgtcgacatcgaaatcaagttgcgtgaagaggacctcaaattctaccttatcgcgctggtaagaaagaagattcatcttccctgcacactgaagctctgagaagcacgcacgctaacgctctgccgccctctaggataaggaggtgaatgattgtatcagccttattgatcttcaggggaagctgaactgcacatacgtggtcggctttttctttagtcctaagccgcagcgcgccaatctcagagaacgctggccgtcttccgtcgaggacaatcttgaacgtcttgctgacgccggtctgccttacgatcggcaggtgcccaagtgcagcaactgtggtggtaggctacaatcagtggtttcgggtgttctttagtcgctaacggtttgtagttttgggtcacactgctcgtggctgtaaggaggaacgagaggaacgtgaacgtgtcggcgtcaaatgcgtcaactgcagtgctgacggacatcgtgctcgcgactgccctgagccacgtcgcaatgtttttgcttgtcgtaactgcgggtaagctcaccttgcaagactcgagattctctactgacgatagcaagcgcggaggaccacaaggcatcagaatgccccaaccctcgctctgcagagaacgttgagtgcaagcgatgcaacgagagtaagtctcaggcatgtcgtctattttcttgttatatgttgacttcataatctagtgggacatttcgcgaaagactgtcctcaggctccccctcccagaacctgccgcaattgcgggtaagtttagaacagcaattccactgatttattcacgtctcctaacgtagcagatccgaggatcacatcgcgaaagattgcgacaagccgcgtgatgtctctactgttacctgccgtaactgtgatgaaggtagcatctccaagacatcgccctcaatttctaccgcatagactgctaatactcattaacacagtcggacacttcagccgtgactgccccaagaagcgagactattcccgggtcaagtgcaacaactgtggtgaaagtaaggatgcctcccaaccaaatgatctaccaagcatattctaacatgaccctacccgtcttatagtgggccatactatcaagcgttgccctaccgccaatgccgctgaggacgcccctcagaatgacagcctcagcttcaacgcacccgtcaacgacgagtggaatgacaatggaagaactcaacaggaaagcgccctggccgatgaaggtgaatataatgctggttctgccactggttggtagaagaaggatgcggaaagcaaagccgatcaaagcatggtgcagaaggcgtcgatcacattcgtctgggacgatgtctgatacctttcacgtgtgtttctcagtcgcttacatgcttacctctcttttcgcacagcaaccagttggccttctatggtgggtgatacttgttgaggttgaactttgatgtgtgctcttaccggctggttcgggtaatctccccttaattttctttcttttacttgcagaagtcgctcgggagacggaaccgttcctgcttgtctttgcttggtgagtggaggatctgtcagactgtttgacctgtaaggtactagtttgaaaagttaaatcccaaaaccttgttgctttctaagtgtgccgtggacgtagattatattcaatattctggctagagacttaggcctagtacccccatcatacaacgcatccacattaactcatttccaacatagatatcatagtaagcaacaatagtcccgaaataaaagccaactgcacaaaaaggaagattacacattaaagatccactaccaccaaccccctaactcccttaccaccacccactcactctcctcctccaccccataatcttcgcccaaaaccccggcctccacctcctcacccaaaaaccataataaaccaacccagcgaccccaatattaaaccccacaaaagcccacccgacgccaaaatccatccacctccgatcataccgatactccctctccaccaggaactgatccgcaaccgagtacggacaatactcgcagctcctcattgcatccgggttcatcaactgccccggcaccgtccgcagataatcacccagatactcgatacacgattgccccgaaggcggattaaacaccgccatctccgtcctggtgcaattaaccgtgacaccatggagctgagttgacgtcactccagcaacgaagtacgtaaacggggagacgcggtacatgaacatccagaaaccggggagagcgtggggcggctgcataacgccgttgaaggtgagggccataaaagagcatatacctgttatgagggtggaggtggggaccgccaggagggcgaaggttatcgcgtagatgaagaattggataaagaagaggaggacgagaccttggcggggtgatgattgggtagttcctgagatggggtagtagtagcttgcccagacgcagatgctgaggatgatttggtagagaagttcggtgaggattatggagaggaggagggataatctggagtaggtttttgtgtggcgttcgcgggtttcgtatatgaagtgttgtttggtgaggagaggggtgatttggtggacgagcgggacgaacagagtgcagatcatgaacgcggagaagatggtttcttggaggccgcttatcgaggtgccgtgtttgtagaaggagaagctgatgatgagtgcggcgcaaatttggaggagtattcttgatatgatgtagaggggtgaccgccagtagtattgaagggttcggcggaagacgatggggaattggagatgtagtggaatggcgtattctctgtcttttgttgggttgttgttcggggtgttgatactctcgaattcttcgcagatagggtcgactttgttgtttctgacccagacatcggaccaggcctccccgtgtttattggtggcggtggaaagggtttcaactatgtagctggcggagtcttcgtcttctgtgcgggtccggggggcaccgtttgaatctagatagtctagcagtgtttgtgcattctcgccggtgggtccaaagtatacagttttaccctcgctggagagaaataggagctgatctgcttgcttgaatgccatcaagctgggttgcattgtgcagatgatcgtttgtccggcgtcggccaatttctggaggatacgatagattgtgcgtgaactttgcacgtcaaggccgctgttacagacattagctcctggtttatccaaagaatatttgttccaaaaaaagcttacctgtcaggctcttccacgaacagaacatctggcttcgcagccaactctactccaatactcaaaagcctccgctgcttgacgttcaagccctctccaacaactccaataacagcctcggcgtaatcctccatatccagtgccttgattatttgctcgacatatgtgtatttgcttcccttggagacagagtctgggtgacgtagcaatgcgctgaaacgcaaagcctcacgaaccgtggccgtttccaaatggatatcctgctgttgaacatacccgatttttcgctggaaacttgggctcaaaaggcagttgctgaagagtatgtccccactgacagctcctattgtggtacgttgcgccaacactttgagtaattccgtcttctgtgtactgttaaggctcatcaatgcggtgattgtccctggcttagcccagccagtcaccttgtccaggacccgatggtttccactgcttgtgtttgtttcgtatatcacattgcgccagctcaaactgtttcgctgaggctcaatgaaactaaaatgattcaatcccacattgccagcggtatcttggccgggagtcacagaacctttcccagcttcttcgtcctctttgtgatgctcttcgtgcctaacgcaagcagatttacttccttgaagcaaagaaagtcttccagaatggatagttgggtgtgaaataaattgcgtcgcaacgaaataaagacccatccaaccgaccaggaaaacaataagaataccaaaatttctccacacgtggtcgtaggtatacctgtaggtctgccagatataatcatcaccactaacagtacggcggccagcgagagctccgacagctgagcagatatatgcattcgtctggaggttggggtgagatggtatgaactcagcacatccaaactccctaccgtggaactcgttggcgactagggcttcatatgcgtagtagacggggttgatatcatggacgaattcgaaccaatgatgcatccgagggacggggataatgaagcccgtaaatatgaaaacccaaagtaccagcatcccagcaagagctcgtgcttgcgcgagcgtttttgttactgttgctgtcatgtgaaaggctgcacttgtcacatggatcaacacgaagttgatcaggaagcatatgaagaattgcgaaggttcgcgacgaaggttgctcatgaaatagatgacaattgtgttcaccaagacaagtagaaaattaattgggatttcactcaggagcacggctagtgattcggccatgggatggtagaagccaaatgaggcatgttttttcaccaccggacgctgggaaagctgactgctcaactcggcaagtggtagaagagagttgagcatcactaggtagaagagcactgcacccttggagaaaaatccggctgtcgttgcaggcgtgttgtagaacattgagccaataagcagcgctataatgaagttaactgtgatcttgcatgctgctgaagcacgttcgttccaaacacgctgaaaagcgcgtattatagttagtctgacttgcagcatcagactagggtactgcgaataactctgtactcggactggctgcttctgttgttcgtccagattaggatctggcagttgttctctcgagtgggacaccgctatctgcttatgatcactcatctccctctgcagcccttgatactctgcggactggcaccagtacgtctcaaactcttccgaagttcggggaactctgttctccatatcccgacgtggctgcctctctgtgggattggtagttgaggtcaaaaattcggcagtactctgctgtggatggcaataccacccttggcgctcgaaaaagcccttggcttcagaagaagggccgtaaaatatctgacggccctcgtataacaacaaggttttgtcaaagagaccatacgttgcttcgctggcttcatatgcagctacaacatgggatgatgagcccagatctgccgccagccgcaaagactgcacaaatttcaatgcctttgttggagctagaccctgagttgacttgtcccatgcagctaaagatgctcccgacaggataatctcggcaatactgactcgcttgcgctcatcttctgtcacgtctttgacttgagtgctgtacgtgtggctcagaccgaacacggcaataacagctttcgtcatagcttttgcatattctgtccgcgttattccctggagattctggatgggagctcgtatagatgctgcaaactccaaggtctgtccaaccgtcaaatgcgggaaatgtttgtcggttccggagctataaagcattgctctcttgacattactgggtgcctgctggtgtgggatgccattgtaatgaataaccgattcaggacccagcttcaagccattaagctctccgcacaatgattttgcgacagtactgcatccagctccaggccgtcctaagacaagcagcagttctccatgatctaacacgccatttagattccgtatgatctccttgggggatttgcggctcgggctgaatgtttctcgcggacgcagtagggcggaaaagacgctcagagccgtcagtctacgatgaacctggggcctagttcccagaatacgcaggttttgaaatttcatggccgagatctctttgtatgtgccctggttaaacatgtgcatgatatttcgaagccacccgtataaaccgaaatctcggcgctctgggctaagatacggcttgctggacgaggcattggtcagttgactgacacgagcaaagacttcatcattggcaagcttgataagatgtaacttctcggttggatctagagaagcacgggtttctgtatagattaacatattgttgatcttctggtctgccattcgggatcgttttgatgacagagatccaacttcggatatcgaattcctctcatcaacagcaatttcgttatgatgatttgcttcgcatatgacatctttctctcctactgtgtgcaccacatctgaggacgaagcgggcccagtatgggatagaacagtatcttcatcaatgactttctttgaaggctcatcttcacttatatccctatcctcagtcgcgagtgtagggctaatagacacactttgatccaactgctgggcagtttgataggtgtcgccttcattttcttcttgagggttagctgcctccctttctgtctctagctccttcacttcgggtgtgatggttggtgagaatgaagcaggttccgcatgtgatatgagaaaggtcccttttcttctttcgctggtttgtgttgctccagttatcccactggcttttgtctcccggagggcaacgtctggttccgtagtctgagtaacgctggcttgggccttcacgctctcagggctttctgtagacaggaaccctgatgaagtggtctgtgcgtgaaccatcgtgtcgccctgaccgtcagtatagtccgtagtgtcattttgcccttccaccgcactaaactctgttttagattcaacatgtggtggtatgacgctctgttcggatgatttgttcccatctgcttcggaaatctcctgggcgaaccgcgacgtgaaaaggagtcctgatggcgtatcctgcccttgagaaataactgatgtttcttcttctgtatattcattgtaggtccgcgctttagcagccacctcgcttccagtgattctggattccgatgtcacatttgagaagcccaattgcatgttggaggacgagatagggctttctatcatctcaaactgcatagatccagcatgctctcgagaactatcctgcccttgagttgacgtttcttccgtatatccttcgtagatttgcgcttcagtagccacctcccttcgagtgacacccgaagctgatatagcatttgagaacgacgattgcgggttagagaaagagatgtttctttccatcatttcagactgcattgtttcagcattttcataagacacattctgcacttgagaaacagctgccgtgccttctgcatatccactataggttcgcacttcagaagacacctcccgttcagtgaaagagagatttctttctatttcttcagactgtatttcttcaaaatgcccttcaatagtcctagttgtagaaaagaggtgaggagaggcattctctgtctggaaaaattgaatttggctcctaaaatcatccccagccgcaatgaattcgtcaacggcctcatcttcaacagtacgggacctggatgtgtattcagagctcgatcgcatatgagcgagattgaagtccctcattgtttcctcgctgaaattgccgcttctgaagacatcttccccacccatcaattgggaactagaaaagaatgttgaagaagtggaccacccgtgtgccggaataggatctccccccaggtcatccctattggaattcgattcgttattatctctctcggccataacgtattcatataatcgtcattcgtctcggcgatgaaggttaagatatgaatcttcggccagcgatcggattgacccaaagacggaaggataagaagtatggaagagtcaaataggtcagtctcaaagccccgggggcaaaatgaactgctatccaagaaaggaaacctgaaagaatgggatccgggactctgcccacttttcaaagattctctgcacagaccggacaccaatttgtccatggtccagctcaacaaatccatttcagctgacacttgcatgggtctattgatagatgaaaaataaatctttggaaggaataagcaagcaagccatttacaaatcctcagtggtgcaggagctccgtggtatccactgatttacaaggctagctcgggattttatgtataaataaatagttagtccgatacccggagataatagtaatcccggccagatatataaattagctatgatatcttcgaataaattctagttttgactaataaatatataataataataatcatgtactaacttacatgttaaaccttcaatcagttcctgggttatagaagcaatagactacgagaatagagataagagaatactttcatagcttcagtgtaagaaactcttctaggaggagaagtcaatacgaggtcatcattacccgcagatcctctgcggacccctagaattccctatatactcaggtacacacatattgggagtaggcctttgtaggggttcaatccttacattcagctggaataaccaatggatcaaaataatcctggcagccggctctactggctagtgactaccaaacagctcatactgcctggtgttgatcatcccaaaatagtcttaagatgataatattgaagaacatgattaagtttaagataatactacgtattagtaagaatagaaaggcacagaaaattatttgtatattcttatctaagcactatggaacaaggcacgcgtggcaagggcagttggtatgtggtattatgcaatcagaagcaatcggtccgatagtgcttagtcatttttatgtatagttataactacttacatccgtactagtattgttacaacacataattcatccttattcatcatcccgttcataagatcacatttgatagcatgtccgaaccacagttatgagtttaagaaaagaaggagcaccttacctccagactgcagcctggagaactgtaatataacaatcagtaataaaattatatggcaattatgataatctgtaagaaatcataataaagtaataaaagagtaattaagaacatgaaaatctactagccactataattataacaagcagggacatagcaaaactataggcttacttagcgtgcttgaacaggtataagaatatgaattgaactgaatagcaaaactataatatcagagaaatgcaccatgccaacttttatataatatttagtcaagagaaaatataaaagaacagcttcaattgtaagctataactattatccctacaacctcaacctgcacagctgtaactgtgaatgttgtggatacaaatcttcacggttagactactcttcatcccacccaagcgagcgtatagaagacctatcagcgatagccgtggagaataaacttcccaagcgttgtcactccgcaagcgactgacccactaaagcccactatctatctatctatctatttcactcattgacagctgtcatacacctattggcttaatgcaccatgtgggtcattctggattctgttctgcagtagttcagctgatcatcttcagccatcgaggtatttcagctgggtagagagacttatgaagaaaacagggtacgcagggaaataatctccgctccaaatcaaaacatcacacatcatcgcacccgctccagatagaaattcaacccctggtggtctggcggcatccactgggtatcttcgggctccatcccccaatctaccaaatccaccagcgtggcttcaaccttccactctgtccctgattctgccgacacaagcccccagagtttctgaaaactctctagattatggtagaacatcatcccccagggccggatgtattctctcgcggcacgacgcgactgctgatatccgataaggacactacccggccgggacagctcaacaatccgctttccagcgtcaatctgcccctgccaggaaaagaggtggagaaattgccccgcgatcataatgtctatctttccgcggagcttgttcagctgctccggttcatcggtgaggaagtgggcggggataaacgagacagccttcatccgatcgtcatcgttgaacagttcgtaacctaagtgccacaactccgggctaagatcgagggcccacacttgagacggagagacaccattcgcggcgagcagacgcaggttctgacctagccccgtgccaagatcgatgatggtcgtgcttggttggagggcgcgatcgatgacagcagggaattgggggaacttggcaatgccagggagtaggaacatccactggcctacgcatgggtattcgccgtattgccacgctttgtcgcgctgtgattgttagcagtgctgaccatcatgtggatacctaggcagacataccacagcgtgaagatgggcgtcaagctgatcctcgcttataccgctccattgggagaaaatgtcccgcatgggctggctgaggcgagggccaatatctgctttgtaccagactgatgtgtcgatctcggccatagtttttgagtttctcttccggcttgatgagagcgctatggatgcaaatggtgctctaaggtaaattgaagatggagatgagatttctcctccttgaagaggggccaaagccagtatctataccaagcagcatatatcacgtgccataagcacaatggaaagacataaaagctgttccagcattgtatctcttgattcactgatctagctagcagagtaggaggacaaaatatggagcagacgccatactagagcgacgatctcttctgggccacgcaaaccaccctcggcatagacaaatggaatccccgtcgcgattcttcagcgagccccataatcatgtcatgaatacgagacgcctcctccacctttcctgcagacttcagccgagctgcgaattcctctagcacgagaatatactggtccccattcgccttgcagagttctggccgatccctaaaatgaaacagctcggcattgacgaatccaccatgcccctccatcaacgactgtggcagatccaacacccaatcattacgcccattggactgggcaaattgcacgaaggcgtcgcacgctggggtgggctggttgccttgctgtgctgtgggtggcttggccacgatcgtatcgggatagttcaggtcgtcccactggatgtatccacctggcttcaggagctgaaaaactttatcgatgatggggaaggggttgctctcctgcacgaccagaacgagaaggcgtaggtggactacgtcgtattttccgcgcaggtcgtcagagacttcgtcgaagatgttccattggcgaagactgatggagggcgccacccattcgggaacaggggcgtttttcaggtccacgtccagaccgtccagctgcagagtatatggcgccatggctgggtcccgcataaggtcacagagccagattgcggtgcctgtggctagatcggcgattctgacggtctcaccggcagggccgaggtcgatagaggggtggaggttgaactggaatgattctttccacaggtagaattggaggttgaggcgtgaggctgctgtgtagtttcgatccagcatgtagtcgagctcgttgcccatgttgaagccggatctcatagtttcgtgttccattgtcggcagagtgtaacttgtaactggtcaggcaaagtgcaaactgggctcaagcagtggacctgagactgcatgggatcatccgatttatacctttcgtatacaggtcactgagaatccactataatacgtagcaaactcagatgcttcagctcatgtctccgctagataggtatgtgctggcatcgatccacccagctgaagatctgtggcgtagcagaggacgctttctctcaagatacacaggtcttctgtctataaatactcgtatcgcaagggttcaacatgcctctatcatcaaccaccattctcttcaattctcaacatgactatccaaactgttcgacttggccttgccgttggccatggcaccggccgtgaattggtcgccgtctttgaacgggtcattcagacactggccaaacaatactcggtcaattttgaatttgttcgctcttcttctacctaccactcctatcacaccctcactgtctccggcgaggacaaaaacttgatcacgcacattgcagatgaaaccaccaaggatgcaattgactaccagcaattctgcgagaatgctgctggctctggcatcgcggcaatcttccgcaccgccatccacgcccaatcgctctacctggtccggcaacacctccaagcggccaaggtggagcactttagcctcggcgacggcaacgcccttctcatggtccgcgatgaagcacagggcttctacgctggcgacaacacatacagcgccgaccagcttagcatcacacgaaccactagcttcagcaagcccgttttcgaccgcatcatccgctttgcactcgacagggcggccgaaaactggggtcccgagaacgtccccaagaaggtgaccatggcatacaagttccacctctttgatggcgtgttccaagcttgggaaccccaatggaaggcccagttcggcatcgacttcgattttattcagcctgacacgctcaatcgcagcttaatggcaaatggagtccagggccgttgcatcatcattgcaggcaacgaatacgcagatgtcatccagcccgtcttcctcaactggttcggtcaatcgactcccgagaccatgtacgctgagaacgtctacctgcgtccagacgtgaacggcctcagcgagtaccaaactgtccatgggtctgccgatgccatcgctgataagggcctcgtcaacccattcgctaccattcgtgccgcagccgccatcctggagcgacacgctgggggcaaaggtatccagaagctgacagagcaggctattcaaagcctcctccagcgcaaactcactacccccgaccaaggtggttcattgaagactgaggaaacagtcgatcacttcctccaagccatcgcaaaccccacacaatctatcccatccaccgccaccaccaccgcctccggcgacctccaagccttccttggcctcaaatccgccctggtagtcatcgacttccagaacgacttcatctccggaaaccccagtcctgccatggcaggcgtcgtcaacaacgtccctcgcgcggtcgacttcgcccgcgcaaacaaccgccccgtcattttcgtccgattcctcggaaacaccacctaccaaagccccagctggaaacatcgggacgccattctccagaaacccgagaagtgcgtcgaggggacgtggggtgcggagtttggtcctggggtgaaggttcagcctggcgagcgcgtctttgacaagaaggcattgctggatccgttcctggtcccggagttcacagcgtatttggaagaacagggcttcgagcatcttgttctagcggggttgttctcagatgtttgtattgattcgactgcgagaaccgcgttccagaaggggttgagggttacggttgtggaggattgcacgactgctcttcattcgaagcaggctgatcatttgcagtttatggccaagctctacggagccagagtgtcgaagctgacggagctagttgggatggctgtgtgaggaattttttttctttactctgtgtggaaagaacatatttcatacacttagataaccattcgtctataacgtcttagattatcaatagataacgaagaaagtagtctcgaagtgttggtattcaaggatgtacatagctaatcagcttcaagagtgaagcggtaaacagaggtaggccgcactggagttccttggcgagtatgtagttgtttctaaaatcctcaacatactggcgcgcagttgaataatcgccacgcgtctttctgactagattgtacacgacgctctgacgtcccacgatgccgtgccctagtacgatctttttgatcaccttgtatgcttcatcaacaaagtctttatcgtcgacggatggcacaaattcctccatgagttcaccagttatctgcctagtcagccatgtctgcaggcatttcgagcatctatgccattcgcgtaatttctgtggtctttcttcggatgtggaaggtcaagatcgataaggtcctgtaatccaatatcttcaagtatttttcggacctgaaagtcccagtttgggaagtttgagcatcctttcagtaggaatagcactccaggaatagactcgggtagatcatcatgtattctgtccgcttgtgtggtcccctttgggagacctattgtgatacgcaataaattcctgaaggagaccgcgcgtccctgatgaaaggccattttgatgtaggtcgactaatcggagcgctgaaagtgggtatagattgtgggtgatgctttcttagcacctctgcgtgttcgtatctggtagaatttggtcaacaccaacaacggcgcgtccctgttcaccaccttgattttggtggccctaggctctccgccttatttggcgtcagttcgtgcttttcaggtctggatagcttcgcagatcgaggcaacgaacagtgactggtttaattgtatgtatgattgatctagatggtcaagatgttgatgttgagaatggcgagaggccgaataagcagcagagccagcgaaagatctggtggggtctggctacagtgaatgtctagagcttgagaaaagattccacttcacccataaatccacattatatgtgtggaaccccaatgtgggccatagcagtgaaagctccagcacgagagtggcggagaccacaacgagatgcgcaggttggacttggttggataaaagctatgaattctatcaggaataataaaccatatagtctagctactagcttttgtaattttgcagggcccgggatcaaatatagttgcttttactcgacaatctagaagaaaacctcccagaccatgtgcgatttcgctcggagtatgtccacctctgctgcaccttcactcaaagaaggaatatcttccacatattgttttacctctgctctatcattcgctttcagtcggagaacctgtccaatttggctagttagccttttaggtttacagtacagcgctcccagtcagctcacctttccttgctgtggatggaccacatcaaatacctcttccgctattcctcctgtcccagacaaaaagccatcagtcattcggtggaccatgagaagaaaaagagaatgtagctcttttacatatatcttggtacttacctttccaaagcttcacgcagtgcaatgcatctctctccccaaacatcgtatcataggacgatgcatcccttgcaacaataataacataccatgtcacacacggatccgtggaaaatggctgcaggcgttgcactggctcacagtcaagatacttccctccttgttggaaaagctttgacaccgaggtgaaatttccaatgggaatgaccttggcatcagaaaacccatgtctaatccacggaacctcttgcttgatggactcggcccgttctgggctttcaatgcctctccaatgtacgaccgccccgttgaccttgttttcctcatcggttatcgaggggaagaatcgagtggtttctccacttctggtcgaagcccaggcaaattcagactcttgtcgaagtaaggctggtggggcgtcgtcaagggtcttcccttccttaaaaatgtcgtagaatagatagtccattttggcaggatatatgatgttggtccgatgaggtctggagtctaagcgggggatagaagaacatgagagcgagagtttcttggtcacggactctcgtttgcagcgtgtcacttcactgttcgtcagatggaggttatcttgatatacacccgtccgtcctccgcggcgctcccaacatgatgcgatcgaaactggggccggtgggggatcggcaatcagccctatgccgagccggcggggtgcatgtgctctgaaggactagtagtagaattcaaggatcttcctcaaatcttgagccgagttattgatgttattgatcccgacggggccgagggggccgatggggcaacaataatcttgcagtaggcgttacagaacaaatagtaggtgtcaatgcacgaatgcagatctcctcgagcctggtgtacaagaacctgctagagtcaagacttcttgctaggtttcgcatagcctggcaactctgggcgtagtccgggatgtggagaccaaattaaaatgcatacataaattctcgagctgctcatttacttcggctctgccaaatcagaaacggctactactacatcaagatgcacagtgtcgccggttctcctgacgacccaaaggtatcctccattttctctgtaaaactgtcttccattgtaagtactgagtactaagaagcaatagtgttggagtactcgactccgctgcgctatcctgatgaacatttgcgcctatgtcttcattgggaatctgtatgcagcaggtctcgccactggctttgctccactggctcatgacctcggcgttgaattcgacacgcttactggccttgtcgcctgggctgtatctgcactcggaatctcgaatctcttttggatgccgaccgcaatgtgcatcggtaagcggccggtaatattgatctccatgatagtcttcctggctggatgcacatggagcatcaaagcaactggtttcagagatctgctagcttccagaatcgtggcttcatttggtgcgtagtacctatcgttactgctatataacgcgtgagctccccttgattggtgatctaggggctgggtctatcgaggctcttgggccatccgttatcgccggtaagtgagtacggcttgactaatctttagtcgattgacatgttacttatgtatccttgtatcatacagatctcttttcggagcggtactttgcaaccgccatggctctcttcgccttgtcgctttgtgctggatctcaaatcggtcccatgatagccggctttgttatcggcagcaagggctggagatggttttttattgtttgcgccatccttggtgcagtcaacttcttggcttcggtcctttttttgcctgaaacaacctttcgacatagtttgaccgaagatgggaatgttcatgccgctgaattcgaaaaggaagcgaaacaaaggactgaacacagagaaaatgaaacctcacccagaagttactgggaagacctgatatcaattagagatcgcggtctcgagcctgagggactcaaatgctggcctgggcaattttccctcccattccggttcatttgtgtccctattgttttgtttgcgacaatcgcctatggcatctttctttctgggttagtggatttatactgctgctcttactccctcctcttcctccttttacttccctggtgctgccatttgtcctacctattacacaaatgatttttacagtagtagtagtagcagctactactagtactcacccctactgatatccatatactacactatacaagctgactggcaagtaccatcccagaatcgtcctcatctccgccatcagcccccaattcctctcagcaccaccataccacctatcctcatcagcaatcggtgtatacacactctcctccttcctcggtatcgtgataggatatcccatcgccggccccttaaccgacctcctctccagatgggctgccgccagaagatacaccaccaataacacccatcacccaaaagaccgcatgcccgcactcatcatccccttcctagtcgcaccaccaggcttaatcctctttgcgtatgcaatcgcaagcagtaaatccttgtacgtctctgccaccggctatgccatgcaagcgtcagccttagtcttcgttccttcagtcaccatgtcttatatcatggatgtgtatccgcagtcaggaagcgaggcaatagtacttattaatgcgggtaaaaatgtggttgcgttcggagtgacggtctctggtgctgattgggtggatcgtgatggcatcgtccgggtttgttgggagttggctgctgtgcagtgggtggttttggcgttggctctgccgctgtatgtctttgattctgctgtgagacggtttgcggggcggtttgtgtagtgtactacatgttagtgatctgtttttctttctttccttaagttgactaagttgacaatatttagttatgtagattctgaagtgagcaccgagtcttctttcgcgtagtatagcatatattctgtttctatctatctcgattaatgtacttaatttggcaaagccagtatcgtgagtgatttcccccctccccacttcacgaaccagtcatatcctatatttaattcaatttagtgcaagagacgcagctcagctgcggggccgattcaaggatcaggaggtgggtttacttgtttacttcccctgtgattgactgccacatcctaagtatctgcaagacatactcgcaacgtggtctggtctggacccccatacgccccgcatgactgttgatcttgcttgacaccagtatgcacttcgtctagtaggctcggagtttaggactttaggtgcctcttaagctttcagggagagaatatcatgtcgggggaggtgcggctgagcccgctcatgtgccagccatggtggtagggggggggttctaatgggttagtatgtaaatttggtaggtctgaaaaacaggtagcaggatcttcctgtggctgctggggaagctatttctccgatgaactgtttgacttgtgttttcggaaacataatcctgggacgatttctgccgtcactaggcaaaaataccacacgtgttggatgtacaatccgccggtgatatcggagactgtggatgatcatcggggaataactccgcgaagccgaatgtatggtctttgctccggggtgtttcttaaaatcccattgttgttgaagcctatggcaagcacactcagtatgtcccaaaggagatcccatgacgttcctgatattgatggccgtgcttggtggctctgtaacccgagtttccgagacatggaggacgaagaggatcggaaatctcgatgaaatgagatgacatcatcgcgcattcaagcctagctttggcctccacggcttagcttggttgtatctattgtaagttagtgcctggatggttgattcggtggctcatccttggctattgtgcgccgatgatctgccatggtactgcccaaggtaggtaggtgtatcgcatgagcagcttgcgctagtagctggtgcgctaacgtataatgggcgaattcacaagccgtacgtatatgtttggtctgtgttttagcttcgtgacctgtgtacgaaccttgggctgtgctcattaccccggattctagatcgacttgattgcggtgtcgcctgaaatccacgaggggggtcttcggactacaaacacatcctcggttgcgctgaaagcggacatccaacttgaattctagttagtcagtaaatctccagtttgactcacagtatccatttgtgagggggacaaaaatcccgcgctgtcgagccaagaccaccagcctgatccaagcgccgaagcacgcgccaaagaactcaatccgttctagcagccccaccaattgtctctgctttcagtgctttgtgcttgttggggaattattcgacacgcaaagaaaaaccaactagtttatatgggtaagaaaacaaatattggtcctggaacatccgaaagtttcccgagccacttacatccaccaatttgcgttccaattagagcgagccacagtaaaatgctcaaggaccagtagacgctttggcttctcgtggcagggctccctcatgggttgtcgcatgtggctatagattggtgcaggtggttgtgaaaatatcaaggtagcatgactttctacgcgtcgcgctagagcgtgaataaatgtccacaatgtagtattcggttaagactgccttggctccctggtaccatcatattggtattattgatattcttgggcgacagctatagcaaatgagtagtgcatttcttccgtgcatatctacgcagtagtttatcctggttccagctgaccgggatcaattagtcacctcgtttggtgtaacatgactctgccatacttttggaaatcatgtttcgcattcgagaaatcgtgatgggatgtcaggtaagctggtcgtgtctgtcagatgagcgccaaagatagcttagattctagttatcttgccatgtgaatcggtgcgggtgtcagaacaccacgaggcgatctactatcgaccaagaaaggaaagcagcaaggcgctgtcatgtcggtccacgaataaggcaaggtaagcgacgggtgagcactgggaagatgcagagagtggtactcggtacaagagatgcattggacgactctggatgcacatgaggtaggggaattcctgcctatggggattgattatgcgccccctctccagcccgatgaaaagcgcgggatgtccagaactggtaagccgtaggggaacctggagacacgctcggccacaaccgaagagcctgactgcgggggggagaccgagcgcggtttcacggatgatggagattgctacaactgatggataaaatggcctggtctatcttggcaactaacttgagccggtttagtggttagacgctaagccgcccgagggacgccagcaaggagtatgggttgccacccttgggccagtgaggtgcccggcttgcgtcgcgcgctttttccctcagtcggccggcgagctgaatggttattcattagtactttggggtaccccgtacccgtctaccctgtctggtaatctccagggctacgtactatgggacgggcgcagggcaccctccctgaaggcagcctaatcgtccccaccagactgctcctccggataagcatctgacatcccacatcttcacccgtcgagcgggtagcaccttccagaacatttggggtcaatggctcgaacattgcagggaaaagcagctgtagcatagtgcatccatgcatcaagccgtggccgtcctctggggccgatgttttcggtgaccttcggccaggcctcggccagcgcatatctgccgtgattaaggttagtcccaaccccggcgggacttcggcctgtatcagacatcgtggtcggtgttgaggtcggtgtaactgcacactctcccggcggccttccttattgtcaaaccgacatgatgactgcatggtcgcaactatctggttggtccatctgtaagcctgtagcaaataataccttcatcagacgactcagagtgacctagggaggttcctgggaggcaccaggaagcggcttgttgagcgaagtggagcttaatcgaaccgaataccgaccgtgattggaggagacgggctcttagcgagtgtaaccgcatgcacaaggccgatattcatttgatgctctcccacggaatccccgactgcgcggagggggaaaggtttggtcggcatcagaccaagctgaccaatttggagactaggcgccccatcgacgagaatattacgggacaagacgagacggtcgcccgcaggagtctcggtcgaggaggaagagtaccttaccgcggcgagcaaatccctatatgggccaagaaaagcacatatgggagctaatggttttctgcatattcagttaatcttattgtccttctcctgagaaacgatgtcgctagctcagctgtgccacacaacaatactttcaagcaatcaagcaaggaggacgcgatagcaaacgcccacgaggcggatagagccggggaatgtccttactggaagcggtaaagcggtcggtccctctgtgcggagtctccaaaaaccccggattctgaataatcagcccggatctctctttcttcctcatatcaacggaaagggtccacggggaccggacgacacccgacacacgacggcatgacacggtaacatacctcgcgattagctattccgtcgaatgagcaaagaatatgacgattagattcagcgcactctgcctacgatcctttccgttttccttgatttcgcccacgcgaaaagccacgcgaactggccgatgacgatgactgcaaacgcccagatcgcagttagccgccccggaggctcacattcctgctagccgtccgcaatccacccgcctacccaacggacaatttaatattaacatacgctttatggaaaactacgcgataatcactgtatgattccttttaagttccaagcagtggacaataaccagagaaaataaaaaatgaattgccaagtaccaaacagtatatcaatctcggttggctcacatccgagctggtccaaccgcgggttgaaacactcaccatgaagcgaccgctgtgctcggtttctccagaaacggctagtcccctgctcatcccgacacccatgacggcatagaggaggcctccgaccgttgggtggaaactgcttactcttagtataatgatacccatgtacttcgagttaatcggctttagtactcgcctgagcagacgcggcccccaattcagcccccccgctgatcgcgacgcccactcatcgtggaggtggagtaagaagtagtcgggcaacccacccaccactcgtcatttcatctgaatttggtctccaagatggtgtgagatggtgtgtgcctgggggaggccatgtggggaacggtcattcctccgttggttgtaagagccaatggaacttgctggacgatgggtccggggagagacctcttttagcaagtgctctcggacgcaataatactgtgttctgtgtctctagagatgtatcagtcagtctctggatccggagagtggcagctgtggggatcattttccccctccaggcttctgtggcttaggccaatcagctgcaggattcgagaagcagcttcctgatcgattgcagtcctttcaggtcatcctgagccaatcccatcttttcatttgtctaatccagtgggtttctctgctttccaaaagtcaaattggatggtacttgtgtgctctgggtggtggactagtgacggagtgccaacgtccctactagtagtagttagtagtagtatccctcgctgaacctagtagctagtatttgcacagatgctctcgactggcctgacttctccccgaatggtaataatattacttacatttcatgttctccatcgcccaatcggtcattagaaacctaccgttgcgacaagtcgagtctctggaggctccagctctatttaaaaccccccctccgcttcccctcgtgcaacctgctggttgatctcttttctcttctcacatttcttcccttccatttcactttccgtccgccagcacatacataccccttccagccaatgactctgcctccctgactacggattactcgtgttgttcggttttggcttctttcaactactttcaaccatacagttgtagtctcgactggtgacagtaatttgggcttaatactcccatagagagtgcgaaagtccgtctttccaagatggcgcggtcatacttgggcctcacaggaggcaagctgcaaatcgctatcagtgtcatcgctggtatggatttcttgctgttcggttacgatcaaggtgtcactggtggtctgttgaccctccaatcgttcatcaaatactttccaactatcgcaaccaacggtgaatactatgagagcttgactaaagcgcaacaaagtacccagtcgactcgccaaggtaagtgcaccattttgtgctatgctctaatcattgattcagcccgcggactgatctttgtttttgtcaaggtgtcgttgtcgctgcgtacaacttgggctgctttgctggatcgattcccacaatttggattggcaacatgctcggtcggcgcaaaactatcttcgttggttcgtttattatgtgcatcggagctttgctgcaatgcacttcctaccaactcgggcaattcattgttggacgcttggttactggtttcggtaggtgcaacgacgccttatgtccaacttgtgagttatgcaacttatgcaatactaatcatatactttgtcggtaggaaacggcatgaacacctctaccgtgcccacctggcagtcagagtgctgtaaatccaaccatcgtggaatgctagtcatgattgaaggtgccatgattacttgcggtatcaccatcagttactggattgatttcggtctgctattcgccgatccaaatgaggtggcttggcgattcccgctggccttccagattttcttcgccctcattatcctggttttcgttttgcctcttcccgagtcgccccgttggctaatcctcaagggccgcgaggacgaagcaaggactgtcctgcggtccctcttgggcgacgctgacgagaccttcattgagacggaatttacggccatcaaggctacagtcttggaaatggccaagggttcgttccgtgacatgttcaccatgaccgaggaccgccacttccaccgcgtggtcttagcctacgtcaatcaaatgttccaacagatttcgggtatcaacctgattacatactacatccccgttgtgctggagaaccagctgggtatgaccctcgaaaactcccgcttgatatcagcttgcaacgggacggaatacttcctcgcttcatggattgccgtgttcaccattgagcactttggtcgtcggacactgatgctttttggcgccgcgggaatgtcaatatcgatggtcatccttgccgtcaccgccagcatcggtagtaacggagccaatatcgcctgtatcgtcttcctgttcgttttcaatacattcttcgccattggctggctgggtatgacctggctgtatccggctgaagtggtgccgctacggattcgtgctccggctaacgcgctggcaacgtcatcgaactggatcttcaacttcctggtggtcatgatcacgccggtggcttttgacaacattgggtaccagacctacatcatctttgcggtcatgtaagttcctcatcccctcgttcactctccattttctggcatcctcagttctaaactttgaacagcaacgcctttatcttccccgtagtgctcttcttctatccagagacggcccgccgatccctggaggaaatggatcgtattttccgcaaaacgaccagtgtcttcaacgttgtcaaggttgctaacgaggaacctcacatgtacggcaagcatggtgagcttctgcgtacgctcgatgacgtggaagacgatgcagtccgtcgcgccagtgtgctgagccaccgggcaaaggacatggagaaggacagtgacgagaacaccaacagcgtgaaggcataagcgtacacgactgtgctttcttcttggtccgaactctcaaggactataatgatttagtgattcaaacatgggccatacggccctaactactgagcttcgtttataccccgactgtttccgtgtatttagaccgagaaacatgctagttttgatcttcacgcttaacttcgattaactcttgcccaacatagcatgaactagtctagtcagtaagctgtacatgcactacatctcatgatgaatagccccttgcgtgagatgcacggccatgcagctgagatgaagggatgtcattgtggacactcccaagatatgagcttatctttagcaccataatggagcgatccaggccgccgtaatggactggtctagaacttattgatgctctactagacatgactccggggagctttagagatacgatcctgaggcagcagcaagtatcgcgaaagaataaaaactgatcaggtgacgaccagatcaagtggtggctacctgctccggcagcttccccaagaacatagttggccttcataccaacacatcattagattcgatgaactcttagccatctctcgtccagtattcacaccctgatccggttttaaagtgagcggatcgagacgcatgatcccatttgattgatagtgagcataatgtgtcctcatactgggttagtagttctgctatatctcacaaggctggttcgctatttagacatttgtacatcgtacgcatcttgcagtcctctcgtccgtgggccgcagtgatagaactatcaaactcaaggagcctctactaatagactgtgtctgctagtgctcaaatcctgcatattgatgttagtgtctcagtcattcctcgtttacgcatatgtacgacgaagctttcgatacttgcatgaatgatatggattcggaggaggagtggtccctcgtttgataacaaggtgacacgagtcgctccgataaccgactttttttcctttcccctttttggatggcatacataagcatagcatgttgtacagacagtagctttcgggctaatcttttatgggcttgtgcttgctgactcttggttggggaagtaggggaaactgcagttaaaccggatggtgcatctttcttattaactgttctgcatatctgggatagcagtattattctccctgcgagtatctacaacagcagaacgattgaaggactaattattagctggccatgcgccaggcgcaatcaagatgcagcatccgtcaggttcgctggctgggtatgtgatggttctgtccatccttggaaaggggtatttgcgccagggagataagctgttcttccctatacgaagaggatactgtgccaagtccttctaattcccttcgtttcaagcataggtacaaaaggacacaagcctgtcactatcttggaaggagtcaagcttagagactgaatagaagctgaatgcgcagagcagcgtcgacttctagaatgtcgtcggattatggttccccgtttcaggctcgttcatctgctgcccttgactgggtggagccggtcggtgccagtttgtctgctcggtctcaccgaggtccaggcgtcagaaaaggcggaagggcgctgtctagactctctatcaattgacagagaacaggaaagaaacgttggatacgcccagaagattggctcaccgggccatggattcagtcaccgaccggtgcaacagaaagctgcagatcgaacggcaacctcgatgacactgcaggatgcagacctctagccggacgaatggaaagcaccgacatcggattgaagctttttatcttttagtgttgggcgacatcgttgaatatactaaattggtattgtgatttctcaatctggggaagaatagtgactcattgcggactgaaggagatcggttggttaactaaaacttgttgagtgcatcaaccgcgaaagtggattcgtccgaccgtcggctgccaaatcctcctggagctgctctggatcctctggattcgttccatggcaatagtttatccgccgaaaccgtcgctgttctcgtgaggatcgactcttctcgggccatcgttggtccgcctcaatgtctctcgcgtctccgctttgtgtctgcggttctttttatcaatcgcttggcaattgcctcagcgcagagctcattcaagtacaatcccactgtcccttgcgttctcacttcttcttcccctctttcctctgagcgagctgcgattgacctgatattgtttcatttttgcctttccagcatctcatcatggcagactcagttcaggtaagtttttttagcatccagacttactagataaagtcggtcctccgatccgtgcacatgcacatgctcaaagctctccccgctttttttttcttttctcaacgcttgactcaatacctgcagcatccacccaactaaccagacatgcaatttcctctagggctgatcactaccgtcttgatcgtttatttccgatttctcccaccgtgacaccactggccacgaagcttcgtcagtgcggggtgtccagctgcattgcttgagcgatccttatcagccactttatacccttcgtctccccaccattcttctcgctttcagaggaactatcgtcacgctcacccttgtaagtcccaggccttagcgtcgacgatgtctccccggatcttgcgctaacaatttctctcgcagcagttccagcaaacactctatcatgtccttgatggaagcgccatcccaggcccctgagccgggaaaggacctgagcgcagaggatatccaagagcgatcattaagcagtcatgacggcgacgtagaaccgagcaacgaacccgatgttgcggaaatcgagcgcatttacaggtccgtctcatctcctccctaggtgcgaaacacacctgaccttgaataggaaattggacttgcgtatcatccccgcattctgggtcctctacttcctttgcgcagcagtgcgctccaacgtcagtctcgcgcagaccatgaataccgactccggccacgatcttggctccgtcctaaacgcttcgccacaccaaatctctacgggtctggcgctgttctacgtgtgctacgtcgtgtttgaccttccgtccaacctcataatgacccgtctgagtccgcacgtgtggatgagtcgcattgtcatcagcgtcggtgtcattggcagttgcatggccgctatgaaagccgcatggagtctatagttcgtcccccactcccctgtctctccgcgcaacagcaactaacaatcccagcctcctccgtctccttctaggcatcgtcattgcaggcatgtggcccggcatgacctactacctaaccctattctatcccccatcgcgaacgggcaagcgcatcggccaatactacaccgcagcgcaagtctccgccgcagtagtcggtctggtatcagccggatttcaagaaatggacggcgagcgtggcctcgtcggcttccaatggatgttcctcgtctacggcgtaatcaccattgccgtcggcatagtcctcctctggtggctaccggaccgaccactcgcgccaggagttgaacccccacgccgcaaatacctctggtggttcccgcgcagccccccagccctcacaggccgagacgccgaaatccattaccacgatctcaagcgcgtataccaccgcgcgcaatggacctggatggacctcgcccgcgtcttcatggactggcgtctctggcccctcctcatcatgtacttcggcgtcgtgggcgtgggcattggcgtccaaagctacgccacggtgatcatcgaagcaatcaacccctccctaagcggaatcgacctgagtcttctctccgctccgatctggatcgtacgtccctccgcatcccctccctatatcaaacccacccactaaccaacctccgaaaacaaacagatggacctcatagccatcgtcctcgtaacccccttctcggaccgcttccaccgtcaccgcgccctcttcttctccatccccgtcctcctccagatcctcggcctcctgctaaccacctacgcggggaccgacaccaactcgtggccgcgctacggaggcctcctaatcgtgggcttcgggctaggccccaccgttcccatcaccatgacctggacagcggaggtattccaggggcgccacggcgaggtaggcgtggccactgcgtcggcggttgtctccgggtggggtaatttgggaagtatattgacgacgtatgcgctgtattcggggtggaagagcgattacgaggcgccgggcagggccaagtatcggaagagtaatctggtcatggtggggattttgtgtgcgagtattttggcggcggtgttgatgcaggttcttgtgagggtgattgatgggaaggagggtggggaggagcaggataagattgtggatggggcggcgaggagggaggcgaggcagagggggttggatgggttggggcagggaatgtttaagttttggaagaagtcgcgttgagttggggaatgaatggggcatgtgagcatttgggggggtggggtcagtctgggggatcatccatctctctttgatgagggtggtctttatatctatatactatacacgatcatgatcactatatgtacttaatgctagtcaaaaattgttttattagttgtgattgccagcagcaataccgcaagttgtctagatgcaggggagaagttttcatgtccagcccgttgggcaatgattgtattgacacactatgttactgtgataagtcggccattaatctattctctgatccttccggtgtatgccttaggcacattccaccagtttattttcaagtgactgtcggttcctccgaagtcctctatgcttaacgtaacacataacccaagtaatgaaagaaaacgaaatgcaaaaccagcagagggtaaggaacgcaaggcgagctctggcggagagtaaatgaagagtcccgaactaccagctgaagaatgaaaaagaaattctatgtttgctcccgagagtgccaggctgcgctattgtccacctccctgtcgacgccggagggtatacgagcgctaatatgaagtgtattcacattttcaaacggtatgtaacgcatttagttgccacccatgagctggaaaaacagtcagtcatctgcgtgatccatgtaaaactcagtagaacttacagtctcaacaataataccggtgatctggtaggggcaggcgttactagcgggacgacggtcctcgaagtaacccttgccgtccttggcgacctggcggggaatacggatggagccaccacggtcggcaacaccatagctgaacttgtcgatgttgccggtctcgtgacggccagtgagacgctcctcgttaccctcaccatagacagcaatgtgctcaacatggcgggcctcaagcttcttcatggcggcctcaatgaccttcataccgccctcagcacgcatcgaagcggaggagacgttggtgtggagaccggcaccgttccagtcacccttgatgggcttggggtcgaaagagatcttgacaccgaactcttcagcgacacggtggaggaggaaacgggacatccaaaggtggtcacccactgcaaacacagttagtattaatgcactccaaatagcaactggcgagggccaactcactctcaatgccgtcgcaagggccgacctggtactcccactgggaaggcatgacctcagcgttgataccggagatcttgataccggcgtacaagcaggcacggtagtgagcctcgacgatgtcacggcagtagaccttgccggtaccaacaccacagtagtaaggaccctgggcaccggggaaaccaccgcggggccatccgtagggccagccatcagtgccgaggagggtgtattcttgttccagaccgaaccaccattcttccttggcgtggatttccatcagacggttggcctcgtggcggtggttgtacttgttgggggttccatcggagtcccaggtctcacagaggacgaggatgttgtcaccacggcggaagggatcggggaagatagcgacggggcggaggtagacatcggagttgtcaccaggggcctgacccgttgacgaaccgtcaaagttccattcggggagctcatcgaccgatgtgacaggcttggagagagtctaaagcacaatgatgggttagcccgagacgcgctatgtcacgtgcaacgggtgggtgcagccggcgcgtgcaggatcgagtcaccgtgcgcagggcttatcggtgttcgagggagcgatgataacgacgggtccctcgtcgcaatccaggacacgtccgactccacacgcgtgtgccatgaatgaagaaagtcgagtgaatggaagaaaagtgcttaccttggtcttgctacggcagccaccgacagcatcaatccagatgtactcagcctggacggtacctcgctggtcgagggtcatgtacttcatgagctgtttccagccagtcagtatggcattttcctcagaaccgcaaagcggctgaagaaagattatgcaaggtattaatgagaagatgaacgcacattctccgtgttggagatgacggttgcttcaccagaagactgtggcgaaaaagtgtgagtcagcgagtaagttctagcaaatcttggcaggcaaacaacgcaactgaagccaaagtaacagattgggagtatagcattgaaaggacataccattgtgaagtgtgtgtgtgtgatgtagaatgaattaagattcttttttgtggttattgagcttgctaacgcaaagcttgttcaaagacgtttgactttgaatttgtgatcaagtccaatgacgatataaacgcgagacaatccaaaagattggtcaagagcaaagtgatagcgagagaggggaaggacccagagatataagagagagagaagcgtggaataaaagatggcggagagaggagtgaggaggaatggagattgtaagtcagcggttcagtgggtggggagggatatcctttaaatttaagagaatcaggaaggcgggcttttgctggggaggggggcaaaaaaagtcccagacaaaaatggatctggaaattcacaaaaataactctgaaaattaccgtcacagcttcgggctgcgtttcggttgctgggcatccgctttcgtattacacttttctttcccaccgcgtccgtttcgccggatacaccgatcgcattcaatatgcgagggagtcattctggcgatccccttcacattatgtcgcatttgctgcttttcctgtctgtttcattggatgcactgctccatgtggtgatcaattttatgaatcaatttttgttgctttgctctcaagagtgaaatgtaactctgcccattacccaagtcagatttcactgacaccagatgaatgcggcaaggctgcaggttagaccagggtttgttacgccactatttccatcgcccatccattgtaaggactagacccaacactggctttttcgatatcaagtctacgtacgccggtctttttcccagcgtgggcatgtccgcgcttgctaaaattcacgcaagacttgctagtgaattgattcatcattaacggtgaagtggcaggatattgcattagccatggaagaaaaaaaaaattaaatgggattgtcaatgccgtgtaattgagacacctgtccaccgatatgcctatccgggctcagaaagaaacaatattacccaaacgggtaaaatggatgcacgattggaaaaagttcccccgtctttcttttcttcttttgttctgcgagggcaacttccgtggaaggccactactgcagtcggataatttcttagatagcaaattcgtaatacagactatctgaaccttgataggcagcactctcctccattggaattcatccatgactgagagtattaatcacagcaatttcattcgaacccgcaaggcggttgcccccttccccagataatcttcccaccccacgcgacggtgatctggattcagaagcgtccactcctgtttgagttcccaccgtgcacttactatcagggcagggatcaaaaatttaaaaggaataagaaattaaagccactatctcgtactctatacaccgcatctcgaaaagccatgtctgctgaccttgtccttccccccctccctttcaaaaagtaatcatgatattgtctgatccctcacttttttccccctctaaccttctcttacccagagatagcgacagcaattagttgctaagaggaattatcaaccagtggtcggttccgatgcatatcagctgcaggacccgaatagctcgaacgttgcctgcgcctaatcgcattgacatggcttcctattggtaggcgtgacatgatgggtgcatctcaggataacaatgataggaaagacatatcgaggtaccggtgtctatctttcccgtcttatctttgtgcaatttgggggatattgaagtggatggccgtagtgcattgcccgactactactagtactacgattactaccttgaagctgcgttggagtatctactaaatgtgaccagatatcacggatgaattaccggggtttctgataggaaacgatcacgatgttccgtgtaagcgccaatacacaatttctttcacgatacgcaaatcctgtcccgactccagtgtgtacctgcggttatctaaattgggaggatttcccttatcagtggctgcccctcaatccccgccatgagtcgcgtgggtggatcatggcgcgcctgccgactgattttttttcagttctcggccttttcatttctttttaatcgcgcatggacaatacactttgagtcggcgctttgccctttccgcacagtactttcaaaaatgaagtatcacgatccaactattgtcccatatccaagctgccggcccggtggaatatcccgttcccatttccttcccccatcaacgcatatcaacgtccagggatgcggtacattgcacatacaaagtctgacagcttaccaccatgaaatacagttacacacaagcgggtaaacccaagagagcccatgtccggatgccttgcctcgcaacgcaagtcgactggctgatttgccgggagtggggcgtggcaaaacattccttgaagggagaatggcaagagagccgcccgccagccccgagaccggccactgtttccatgttaactggagttataattaggttttgtgactaatatcatgtgagtacggtgtgttactcgtgggcgcaccgcctctccagccgagcctggagggaaaaacggttccagagggaaaaagtcaaatgaacggcgggtgaatggatgaggggggaagggaagaagggaaaaaaaaagagagttgagctacacaggttactcctgagtttagagcatccttgttcgaccccaggatttcccatccgcatgctctgcggtgacccattcgtctgttagtgtccgatcgtgggtttggtcactcccctttctccgcgagtctttgtctgctccgggggtgggtgaatgggtgctgcagcaaatgacagagaggccaagtcgggagtttcaggaatccgcgagggagaaagtggctgcgtttccgatcagccctgtggacgtcatggctggcctccacactgtgatgctacaatgaggtatcagatgtcattgctggagaactgggcaggatagcttggaatccacctgagagacatcaggcctcagtgtcttaaaccgtgcgccataaaagcgtcatcctccttcaacacctttagtactccctgttactgtgcgaatcttggaagccgggctgtgttgccgcgccccagaatagtaactgagccatcaatgattgtggcgctgctcaatgactagccgagatgggtctagtgccgtccagccgacgacacagtacacaatccaagtgaccaccaccatcaccacccttcctgaatcgtatctgatcgtgatgcgagtttcatatccatcctgatacagtagtccgatccccccccccctcccctgaatgaaaatgatacacaaaatagaaaaaattcgcaaccgcatatacacggacggtaatacggagtatgagtggaccaacttactcaccaccaccagactgaccaacagctgcagcacctggtgaaaaactagcagaccaaggatgggttcgggcgtcacagcagtggactggcggaccacgatgcaagcctctcagcatttcaagagccaatatatccctcaccggccaagcagaaaaagaattcaaagcccccatttccgaattaacccctcaatgaaacggacgataaaactaatcagaacatggttctgtctgtagatcacgcccttccagttcgtgatgcttatcgtggcctgctcattggttgatggggggtggtcatgacaaacgacgctgactggtttcgggccgaccagagcgattaggtcagatgccatttacatcttgtgtaactgcaattcaggctgttttgattctgagctttattttgaaagggtattgatagtaagtggcctactagattatatcgcagagctttcttatcgtgatattgtcgagtagtactatatatcttcaccaagcactcacatcttcactactactactactactactactactaagacttcatccaggtattgcttctactacagaagtagtagtaataaccattaacaattattcggaacataatcctcatcatatgaagtaaatgcacatgcacatgctcacttcagagttccgaaaaacccaaccatatacgaaatgaagccgatcaatcgacacgttcgaatgcctcccattcccgaaccattttcgcaggccatcacattcctccatagatcatgatgatgatcttcatcatccatccattcctcatacaaatcactcaaaactccgcggctaccaaaatcgtatacttacatacaacattacctaagtatactttcaccatatcaagtcatcgaccatacaatagactaaccccatctgcacgacacatccaatatcacttcgataatgacaggtctaatggatatgcctagtttacaacaacaaacccagggtcctgagacttcttttgcatgaatggtataaaccttaagttcgttgcagatgagggaagtaagtaggagctgttcgacacagcaaaaggatcttcagctatcaagcccggtggttccgattagtccttgaggggacagggccagggccagcaccagccacagcgatctcggccgcggagtgctttgttgcaggcatgtatgtatgtatgtatgtatcatgcggtgcctgaatatggggtaataggcatctaaggtgaagtattaatcttgggctagtctaggattgattccataccggaacctaatacctactacgtgctcaggggattttctaatcgaagtaaccgggagaaactaaccatataaccgtgaaaacaaaaacaaagaagcatacatacatacatacataacatgtaatataaattcaatatcaacagcaagaataaaaaagagagagaaacaaacaaaaatagaaaaagaattgaatgtatgaaacaaagacagaaaatacctcaaacattgaaaaagaaagtgtaaaaatttcccaaaagctaagctaagctaactaactacctgacatttcccaaattccccatagttaggcatccagttttagccagtcagggagagtaattcgcgcagttgatcaaagggccgccaaataaaaattttatttgctagtgcatactattatagaactaataacgtccaagcttcaacttcactcctctttccttgaatttcaagggggaaaaagaattagaacagaaagacatggaaatggatgcaaaggtgcatattgactcaaacaatatctgaattttcaaccacttgttctatggttcttacataacttccctgcgtgtttctttttcattgcatgtttcaattgaattattttcaaacttcactccttactatttattttaaagtaggtatttatttccgcatacatacatggggaatgcacatgtagacaaataaaaaaaaaatctcctccttgcatgttgttgggggttcgagctttagatttaatccctcatacttactgattcttgaaggagtgaaatgtggcggtcggttggttcaattggcttgtgactcagctgatcggtttcagaggatcggatggatctgtctataccgcctctacagtatttgttgggcatttgccgatgattatctatgtactaactgggtataaatctgctataagtaattgtggattcgtatattatagacttgcgagttacaagcccatgggctggtttaaactagttggctactatgtatgcaaatcctaggacagttgtcatcaagactggtctagattcccggggctcctcgtttttgtgtttgcccctgcagatgggccgatgggacacccacgtaagttcactcgctctggaagttctgacagttaggtgtttgtatttttgtgcctatggtctggcatactgtacatttcatttctcctgctgtcttactagtactatttttccgtgagctgcttgttgttattgtttgtttttgactgtcattccactgctagtcaagttccctcggctctagctccacacccacagggtcacctcggtcaaacacatggccctttcccagtagttgcacaggactgtatcctattaagcttaagattcctttcacatgccccagtccatatcagctggtttagaatcgggtgttacaggtcgggctggtttaggatcaactggtgtatgacagcctctagcattcttcctatgcagatactgcacagaccgtgatccaagaaaaaatgggccgagtctgcttccagaacatcggtcgaatcttcggcaagtccccacgtctgaattagtgcgactcctggtcgaggatatcccagcttgcgtcaccgcttagaccgatggacgagatcgatcgctctccacttccgacgcagtggatgatgcgtatcccttcccctcattgtcatagaatcagcggcaagtctcagcggcccttccgctgccgcgcccatcgtaaaatccattccaccaagatcccaatatcctgtgacaattccagcacatttgctattttgctttgcaactcgagagccttcttctctggggtgtcttccatgctgtccgtggtggtagtgttgttgtcatctagcagaccggtcatgtccacaacggagacccgaccgtttagtccaacttccagactaatggacaccttcgtcagtgccgcctccgcgttggcggattccgacgcttcgtctggttgatccactgcgaaaagtagcatgatcactggtgcttgtcccagttgcgtccgcaacgttacgtctaccttgacatcgttgtcaacagtagaattggggcccgaattctcgtttcctacccccacagggcctttacccttagcacccggcgaagttgctaatttctcgaagcctcccaacaatgcatcgagtctcttctcattcgggtcggcattgctcagaatgatgacatctttcttcgtcttcccatcagtaaatttgggtgggctaaatgagatatttgaagaatcagccggcgtggcggatttgtcctcatcgggcttgtatgaagagctgaaaatgctgcggatcaggttggccagaaaggcatactggcgaaggatctagaagaatatgtcagtaacctcgacacacaacatgagtctccgaatcataccggaaggatatctgcgagttgccggggatgtgcgaatgggatatctctcattgttcggccagctacagactcaaacggctggaacgtgtagctgtgatgcttcgtacacggtttgcccgtactgtcaaccgattgcaccgacattctgcgtctcctccgctcaagctgagaggcctcctctggccccagtcccatagcccctgctgccgacaaaggcgaccagcctggggccaggagtccatcgtaggtaaccattttgaactcctgcggcagttgcattccaaggtgccggtagatatcagatgctgccaaaataggtaaatccaaggccggctccaacttagcaacgaagcgacgattaggagcagaagaacccagcatattcgagtcaagtgccatggcgtccgggtgaccttggttgttggtcaacgtcgccggaggatcaacccagttgacaactgcagcttcagacccatgcgcctcactcgacgacggcccattgtcattgttattgaccccagttaacacttcggatccaacccagtccttcgacacacggagggatgggtaaccctcttcgcactccaccacaatgctccatttcccttccaagctgctcgaatcatcatccgacggttgtccattcggtgcatcaaccaccatcgcatcagacgacgtcttctgcttctccttcgcatccagaacccgtgcttgctgcacccagtaatccaagctgagaccaatgcgactccccttgtgcatacacggctggccaacccagccactgcaaagatggtcgtacacccccgcgaacttgcgatggttccactccgcctcccacacgcgcttcaagctctcgtaaagaccttcgatggcctcgaaacaattgacctcctgactaagccgatcatgtttggcaagccactgtagattctcatggaacccccgcaacgactcccaagcaccccggtctccttcctccggcgactggatcaggtcgcgcttaagcaccgccgtagcctcgtcgcgctgttccccatcctgcgcatcgggcgtcgcatacttcaagctaacgtccttcaccacattatacccccgatggaagtcgatctccaggtcgacaaagttccccgcaatgctgagactgtcctcctgccagatcgactcgaacccttcgagatcactcagccgctcaataccctctctgcaaacgccccgccccgagactcgggctcgtagaagctggaccacatcgtcgatatgtcttctgcgctcctcctcgctgtcgcgagcacccccgagcttcagacccggcatgcccaatgcctggatatcattctcgttcatgcctgcgccgacaagcccatcgtgcccggcgggggacggactgattccgctgtagccaccaagcgcgaggagagcggacggggaactgaacgtaacggggtcctccgctccggtagtcacagcgagaggggtagaatattggtgcatcgaagtggggggttggttgtgtccatgaccggaagctgaaggcgtcctcgttgacggcgatttgtgagaaatcgggcgggccatatgagcaccagacggacgaggcgacgaggtcagatgcgtcggagtcgctcctgggtttggcttggacgatggggtcgccataatggttattgaaggctgtataagagccacagagaaaaagtagatctatccacctcgactaggaaatatacaaagtgtatgaagtagcaaacaaaggctgggtatcacgcagaaaagagagataatggagaagaaatcaagcagccgatgaaatcatggatgctccatatgtctggcgagagcaaaacacacgacttgacagacgaattgaaagagaaagattgcgcaagcgccactgtctatttaagaatgtaagacatgagcctccataacacgcacaatcaagaacaccaacccatggagcaaatcgcaagtggaggggaggatagccggggagatggccggtagtgcatcccgatcaccaactggtcgcggccgcaaacgcgcagtcacatgagtttggcctgtttgtctgcgcagcgtcatagtttctccaggtcttcggatttccctaaccagcgtctatttactaagttcaattgaactccgtttctttaatcagcatatttgctaaaatgttgggccttcgctcatttgttcgccagacgcctagatggacgcagctccgagctgtgtccacgctagagggtcattctcacattgtaagtagctaaacgcagcaattcgccgatctacgaaccatctacaaatcaaccctactaacacttcaacccagtacgtattccccaagaacggaaccaacatcctctccctcctacccaccgaacccaccaacccggacctcgccctcggcgtatcctccaagctcccaccaacacccgactccttcagagagaacccgaaattcctcaacatcctgcaagaagtgatcgcggagcatggatacaaagacccagaagctgtttcgcaagcccaggtgatggtctcaacagcaggcgctaacctaatgtctgggggagtgctgatgggtggcgggcgtacgaggagacgccgcggcgaagccggggactccagtggcggagctagtggtcaaggtggtgctggttcggcggggaggggaggctggattcatctgtcggatggtagacggccgccggagtatggacggattgcttggtatggttcctttgactttgtgtttggggtgtggctgacgaggtgtgatggataggcctgaagatatctttgggagtctggaggtggatgctgatgggaagtttgttggaggtaatggcaattatcaggcgagtggtatgttatgtgattgattgatggttggttgttatattggatgatgtgactgacttggctagggacttatcggattgtgactcgggatggaatgtaagtaccatctattcctgatataactgcgtgggttgtgctaatttgagatcagtttcggtctgagtccgttcctacgggaaaagttggtccagagattgcgccagcaagagtctcaataggctatttcattaggagccttgtacaatatttcatggatgtattatttattgggctttgtgggatagtatctccattcaaactgctggcagttgacacaagttggatcatgcctggattacagacgatcaattctcgggtccagcccggagctcagatcatgtcttttcttccatcatgcaaccctctctttttacttcccgaaaaagttcgtaattcgctgagtccctgcagggggctgcttctgcggactcttcttcatcggcttattatgcgtggcactgcgcgtcttcttccctgctggcgtctcaggcttagatggtgaactcatctccgggctcttcttcggcgatgaagctacactcggctccgttttctgcaacttagtatcttccgtctcgacatcaggcgaatgttccctcttgactccagaaaccggcttgggggcattatcctcgctccattcagcatctttcgtgggcctctcatccttcactccttcttccaccttcaccgcagcacccttcttcgcattggcaaagaagttcgcaatattgctcttattctccttactactaaccggaactataaaatcaggagaattatttcccaccttccccacctctttcggcacaggataacactccagctcgccctcatatggcttgaggatcgactgcagctctttcgaccactccgtcctagaggggtccagccaagtcttcatctgctcgctattcgggtccagaatcacgggcatccgatcatgcaggaacttcaagtaggaattcgaagatgtcgtgatgatcgtatatgtgtagagataatcatccgaatctgatactgcaattagctcccagccccaaacattccctcagaagtataaagaatgtataagcccaccttcatacttaacactatcccacaaccccgcaaaatacatcaaatcgccatccttcctcttcacgaaatgcggaaccttctctttcccccctggtcctttcttcaaccactcatagaacccctgacacaccaccacgcaccgcttcctccgcttcatggacgtccataggccccggtcctcgattagtgagtcatctcggcagttgattgtgcgcataatacttccgtagtcgggattgcgtttcgtccagaagggaatcagaccccagcgcatgctgtggagcttgtatttggtggcattgctcttcttttctccccctgtttcctctccttctgctgtctctttttcggtgtcaggttgactagctggctcatcatgctgatgagaagacgggtacatatgcgtatcagcaaggtaaacagcgccgctgttccctggagcgaagttgtaggtttcgcggacgtcttcatcggggggtgcgtcgtcgacttggaggccttggtcttggagacggcggcggatgaagctcatgcgctttttgtttgttccagtgttagtaccacttcagttcatactggttgtgtggggtgttggtcgtgatatatagtaccacaggagtagtacatagggcgggggattaggcacgtaccacgcctaaagcgtatcgtccacacatggtggggtgatttaaattatcgatgagagattattggaagcgctgaagcaaaagaaagattagctggtgtggaatgcgactgaagagagagaaaggaagaataggttgcgacgtcatgcggcagggcggagaaggaagctaaactacgatcgatcggcgggaatctccaactgtaacttaagcagtgaaagaggtctggaacttccggccaacttcttcactgtatggcaactatatagagaacgggacttttctcatatttaccttgctttagcgtcacgagcctctttttctgtggttgtgatataatggttgtctcttggtgttatgtgttcattgtatatttggctggactcctggtaaatatgttcagtaccgcattcaggcatgctattactatatccggaagtgtaacgtatctagctttaatcagatagcagtaagacggctggtttacggtaagattaggctagttatacaggaccgtaatgtcaaggtgagttataagtaatagcctactcaggttatgatctaagttgtcatagagaacaatgtatattgaactagttgatagtagcacttcaaaataccaaaaagagacattgataaaatgttgtaaaattcagttctttatttgaatagatatacttgaagaagtgataaaataaacggaataaatcttgacaattggtgatgcacacagtggccaaagagaaaaagccattggtcttgatgatacccgctaatttaatgtaaagcatctatgtgaagtgaatagtatcagaaagacagaatcatgtgattgcaagaaatatatataatacatggcgatggtcatactaacagaatcaacaccatatcctgacgggatgcaaggtacacgatcttagtgatgtagatcaatctcagggacggacccgagaagagcctcaaacggaagcatccatgtacggggatataaggtactatggattaacttccatcgaccgatggatcgaataatccagaacgatacgttgaccccacagactgttgccatagtactatccagtagttatgatccaccccccctcgcatcggagctaccaaagatagtagtagtacggtatgtctacgatgtctccgacggtgatagggtaactttttaacagtcttttaaaatggtattagaacattttgcatgtcatccctttcacaagattccagacaattcggattttatgaaacgaaatctcgagtaagctagacatgttcaaggtgaaaacccgggaggaatggggggaaatgcccctccctccgaggtgctttcattgctcatggctcatacatcccaaccaatgcctgccctttttgttgtttggaaaaggaaaaaataaaaaacagatatctttgttatttgatttctctcctccgctaaaactcaacaccgtcccttgataacttgatgggtatcaatctatgccctcgacatgacaccccaagcgcggatcttgttgtcggtgtaaccagcgaacagagtctggccgtcagcgctccaggccaagctgacacactcgggctcgcggctcttcttgcccttctcgatgtactcgggcttgagctcgtcaaccttgctcttcttctcgaggtcgaagatggtgatgctgctggaggtggcagcgcagagccagtaacggttgggggagaagacgagggcgtggatctcgtcaccggcgtggagggagtagaggtgcttggactcgttaaggtcccagagcatggtggtgccgtccttgccaccggaggcgcagagggatccatcgggggagatggtgacggcgttgatgtagccggtgtgaccgatgtggtcggtctggagacggcaggaagcgagctcccaaacctagttgttttgcatgttagcttcatgactccacagagataagattcttcaagttgaagttctcggtggaaaagcaataaaagcaataacaacataaacaagatatgtttattgattgtccatcagggcattggtgaatgtttgtctcatggccgtgaaaggctctgaagtagcaaatacgtttatgcaaaaacatcttctggacgagtcgagattgcgaatgatataaacttgggtatgcgggagtcgagtcataacgtaccttgacgagcttgtcccaaccagcggagacgatgacggggttctgggggttggggctgaagcgaacgcaggaaacccactcggtgtggcccttgtcggtgatggtgaacttgcagtcaccaagggtgttccagagcttgatggagcggtcacgggaagcggagacaatctggcggttgtcggcggagaaagaaacggagaggacgtcgttggtgtggccgacgaaggtccgggtggtctcaccagtggagagctcccacaggcggagggacttgtcccaggaggaggacagagcgtaggcaccgtcggaggagatcacctataaatccccatgcacggtcagccaaatcatcttcctttttattctttgcccagtcccgccttctcgtaggtttcgatcgggcttcgtccttcgtctgtggggaaagtcttttcttgtctggactgggacatggtggggacggagtaattcggagggcatacacagtcagagacgatgtgagagtgaccctcaaggctgcgcttggggtaaccgtaggcctgctcgtcgcgggtcaggttccagatgatcagggtcttgtcgcgactgccagagagcagcatgttggggctataatcgaggaagaaaaacataaagtcagaacccagttttgtccatttgatatatgaatatttcatgtttcaaccaatgcgatcattttcttttctcgcaacaatgcatccatataccacttgttcggtagcacatgcacaccttgttcgattttcgcaacaaaacgcatttgtttcatgtcttcaattcggtgtagtgtagtgttgccttacttctccagagaggtagccaggcaggtaacccagccattgtgaccctcaagggtaccgcgaaggacgagctgctcagccatgttgggagtctgggaggagagagggatgaacgcgggcggagcaattgtcgttgactctaggctggagataaaaatcacagcattgaggatggagtggcagacactcagcgtgcccgcctgagccctaactagcgcgcccagcccttctcgccgttgtgcggtaccgccaaccctaactcgtataagcgagtcacgtgtattttcaccgcctgcctcggccgctgaccgcctatcgccatctatatcactagatatccggttgaaatgtgaatgaaccctcattatcgaatagcaatgctttttataaccctccccttatatcccagtaaagccattccggtgtataatctgtacaatctcgcccacatatcatacaagccaactatacaatttcgcgtcacttacacaacccaccatgcctatggcagcagactagcaatgctcacttgttgaacacctgcacattgggcatacgtcccagtccaggcccaccagtcttcttggtcttcgcagcatggaatcccgtggcactgttatcccgaacatgttgacgcaggagtcgcagcacatcggagtcggcccatcgtgacggaacgggccggtatgcagccttgaaagcaccaaccgtctgcgcccactcgccgctcttggctccagtacgcttccacgtctccgtgggagtatcctgggcacctgcctcagtggacacagcagcctcattgccctcagccggagggtcctgcgtggcccagtagtaaatatcccagtcattctcatccaagaaccggtcatactcctgcaactgctccttgttcatatcggccagataaacatcggcgaacgtagacaacaggagatcagactcgaggattccgcgcttgcggctctgatctatacaattacccaactgcattagctactcattcaaccaggaagacgtgaaccggggatcacgaacacaacaaccgagccctcatagtagtgacatcttcgccctcccggcgcagaggctcaaccttgaaagtaattccctccatctctccaacaccaagttcaggcttctgagcccccgtctcctggcgacctccggtgaaatgctcgactctcccggggtaaggatccgccggccggtagttggggtcgaccgagttcaacatctcggggggagccggcttctcgccgaccttggggaagtccttggtcatggtggaggtcgtgttgggcacatgggggttagggggcttgtttgtctggttcttgcgatgctcaggggccgtggatggtgcgcgatcattgttgttcacgctgttttgacgaacaaccgagctgccgaaggagcgacgggcaaaagttgtcgtcagagagatcggcgaggtcgatggccgcatgaagcggttgatgagtctgggtgcggacattgtgatgtcgctatggtaattgacaatggtctatagaggaaatcaagggggaattggaggtttggtcgcgatatcctggaggaggtcgacgataaagtaagaaccgaagccgaagaatgacggggttgacatcatccggagaaacctcgtttgcattgtttgcaggcctattcgccaaccgtctccggcgcatttccaacggcggtttgtttgctccccttgcctcgctgatgttgctatgactgcagcatgtggcacagtgtgcgggctgcaattggctctcatggtatcgtctcctattgactattagggacttcgatctagatttacacaggatcgcgctagctgtccatttgctagcatgtttgcatgccttggtcgtgacacactacagcatttacagtattgacggtctttcaagcttgggaaaatggcctccccttatgtggttaaagacggctaaaaataaaggaaacaataccgatcaccagcaccgttgtacatgcatagttgtcatactcctcgtcaatattcaatcagtgtaccgtgaagcaaatcccggaactacatagggtcaagacgataatgaaatgcattgaaaagaaatagtccatattttgtcatgacaagagagaaagcatcaacctggaaccttctctttctcacgattctagttttaagacgacatggtctagataagatgcttggatctacaaatccaaagctgttagccacattacccgaataccagacccaacggaagaagcgatagaaaagaacatacctgaagtaagccctcagatacacgacctgccaagcacccaatccaaccagcatacccatagtaccgaaagcgaaccacttcacacgctcgttcgtgctctcgttggtatcacgcagcttctgctcacgagcgcgcaggtactccatctcgctgacaatctcggccaccatctcttcgatacggcggaggtcggtctcaacaggcttgagcttctcctgaacctgaatgctagaccagtcacgggcatcggcaccaatgtcgacatcgagctcgatggacttgtaggggttggcaacggcgtctatttgtcgtctggttagtaccacatacacacgcacattacacagcacctggtatccctggcacatcaagatacaacatgatcaaggtagataaacatacgacgagtggtgagctggttgtcaaagcaaacgtcgaaagcagtatcggcgggagaagtgaaggcctgacgagtctctccggcaatgtccttaggacgaccgtggtcattgcccagcgcatccttgatctatttcagaaaagagaaagctagttagcccaagtacatccttttccttcgcgagcgacagaagctcaaggtagaatcgaacaccggaggacaacacaacagctggcccgaccagcgtgcctcccgcaatcatcacaaaagacgatggagtgagttcccacatacatgcatgttaacaacctggccatcacccttgtttccgctcacaatggcggtgacgaccacaagctggtccttgaaaacgaagttgcgtatacatcgctcgttcttcccgctcacagcagagaggtcgaacttcagggcggaggtgagttggacgaacaggaggaagagaagaccgaggaaagacctcattgtgagacgggtggccgccattgtcaatggcagttgtggcagtggccgagggggaggagactataaattgacaacgaggctcggaagctgctgtgctgctgctattgatgcccgccgcgctctggagaccggggatcccgatcggccggtcgaacgtttctccggatatcggcccacacgccggatctatacaaattacagtctttggagatggcattactactcgaatcattacagcaaggagatttgttatttgatgaattcgttgaaattgtttctatcaacaacgtaggcgatttggaaagtcgagtaatctcattcacaggccataaagtggaactctcttcctgaggatactgagtaaaatagaaaaaggcccacacactagtggatagataaaagaagaaatgtagagggggaatcaagcgtgaaaaagaaataccgctggaaagagtgatacatccaagaggtgcaaagacagaccgcaatccaaaagggaaatgaagaaaaagaagatgtgagcgaaagagtaaagctccaatatggacaggaaaagggcaaggaaataaaagacagtatcgttcatcagagttcgccacggcgaacagggcatgtcgtttgcctaacacattatgatatcgtgttcaaagcaatgattagagagtgacaatgtagagaaatgggacacaggaggggaataaaaataagacgcattaatcagtgaggcacattatgcctcgaccttcttgcggcgcataaaaagtcgcgagaaccccgagtccttagacttggtagcagcaggagccttggtgacgggaggctcaggaggtccagtgttcttgaggaaatcagccagtgcgctggtctcggtctgtcgcactgagggagtcttgaggtcataggcgccattcatggctcccgcattgcgctccatgcccactttgacggtataattcgacgctcctcccatgtagttatcgggctgttgatgcagcgaggtcttggagggtttcgccataagtgtcttttcggatgcggtgttgcgacgcagccgagccttcactgatgctgagcctcgccgagagttcgcggtggccgccaaaggctgctgtggcggagtgggctctggcggagggacattgcgcaggaagtcgatcagactctcctcatcccgtttgggctttggctcttcaagaagttcgtcgagctcgtcgtcatcgtccaagtcgatagcgtaagggtccggcacacgacgtcttgtccgtggcggacggtggtcatcagaaacgctcacaggagcagcaaatgtcgtcttcgtttccttggccaaggcagtcggagtgctcgtccggctagtagattccagaagccctgtgcgagagcccacggaaaccagagatgtctcagccactgactgcgtgctggccactgagggggcgccctttgcagtgcggcctggctcaatagcctgtagctcgtccgagtccatggtatccctgaaaggcgccactgtccgcgggatacgatgagccccagccgttggtgggccttcccgaataaaatcaatcaagtcggacgtctgatcgccccggggagccacagcagaacgggcttccagacgaggaccgctacgggcagagttggcaacagaaacagtgctactcgcaggtcgggaaagcttcttcgaaatctcagtggcgtcagacaaccggcgcaagcgcgacgacttggcagggctaccatcaaccgttgctggagtggttggagtattcggcccggtagacttcaagaagtttgcaaaatcacgggtcgattccatgctgtgctttgcgtcccgagcctgtccgacagccggtttctgctgtaggcccgtagtgggaatttcgatggacttgggtttcgactggatgtacttgggtactggtggaaggtccaccgtgcttttcgacgatgtagttgagtgtctcgaccgagacatgtcatctggaatcggctcaacgctctttggcaggtcggtcggatcagtacttgcttgctgagcacgccatctaggtgaatccggcaactagttcaaggtattagcaatagcagatgggggaaaagggagaacaattgctgactcacctccatttccctcatgctcctgggggtcaaggtgaaatggatagtttcctcgctccggatcaactcgtccaagccggacgtgtcgtcgtaagccgactcgcgtgtcgagaccctgctcacctcagacgaggtacggagacgaagcgagcccgtatctgcaggccgaccgataagacctttcaacttgctcgatacctgagaagtagtagaacccgctgtgacaggacgcttctcacggctgctgctgaagctgcccgagcgacgagacttggaataaacagaagacgccacagaggtggacggccgtgccggcaatcgctggactgcggcgcgttcgacgccggagctgacggaggctatccctgggctcgagcgcccgtactgatgctgaaccccgggtacggacgagccgcgtttgccaggcaatgaccgtgaagaatccgaaattgcgctctctccagaagttgaaacaggccgggatgctttctctacagcggtgtcctctgcagaagatggaacagttggaggggtagagtcctcgggagtagactggtcacaatcagcagccttggacgcatcctgatcggcggcggcggtgggttgtgccggggtggagtccacaaccccctgcgtccggggcgcgagaggcccaggggcagtttctaccccaggggccagttgagctttttcaactctctcatgtttctcaacctcgtcagtttctgggtaatcacggtcgctcagagaaggtgacgacactggggtactactagcgtcactcattgctacctcgaccgatgcgaccgaagtggacggagtcgcggcggccccctgtccagcgctaggaaccaccggttcattttgttcaacggcctctggtttagttgccgcttcaccgtgccgctcgtcgtcctcgtcatgctcgtacatcgtctccaggcgtcttcgctcctccgatggagtaggcgacgtgcgctcggcgggctgctcaacttcggagggttgttcatccgcgggagcagtattgggcaaagaccttgaccgaacatggcgcggagatttgatgttaaccaatcttggcgtgataggagagttcccattcgatgagggcgatcgtggtgagggtagtgtcagcaccataaggctatggggtcgaaccttatgagctactacagcctgcatcgtctggatgtcgccagtgtcgagctccggaaggaagcatgggatctcaatctcctggatgtcatgctcactcatcggcagcgggacggaggccgggtcaacttcatcctcagtctccgggagcggctcgttcacggatcgcgatgatgctgtacgcggcgagatctcgtcgattgtgatagcactgctttttctactgccgggcccgaaaactaagctctggcgattccgtagagattcccttgacaccgctcgcgacaagttgcttcctcgcacacgcttcctccaagtccgccaaagtctgcccagggtggggttcaacgccagcctctccatgtcgtggtcttccacgaccagtcggtccatgcttgcccgattcgcacccgtccctgccaaatcatcttcatcctcaaggtttgctgatagcctagatcgagctatctcacccgcgatgataagagcttgctcccccatgtgctcaatgatggaggtaagaaagatcgaggcagcaggcgtgatgtgaccgacatggctggcgagcctgcggaggccacctccatcttcgcctatgatttcctggttgatatattcctcttcgtcgtcttcttccatatctcccagccgcgtgtagaccatgcaccgcagacgggtcagcttccaggaacgcacaaggtcgaattccccaatcgaggtttggccgctacggaactccagctgctcgtcttccggtccacctaggtattcacttaactcgtcgtcagctgccgaaaccatctccttggcaagtcgaggctttaacacttcggcgacggcgggacgaatcttgaccaattgggtggacttggcggcagccaggatgttgaagagaatgttgtcgaggaatgcattgagagaagaaagagcttcaggggtgacaagcgcactcgcactggagtcatggccttcatcgtcggctacaaagtcggcggcgttgaactcttggtcggcagtaatgatttgagcggccgcagatgaggcgatatacgagggcgcggggatcactgttgggggagcgagaaaatgggaacgggagagctgcgagtcactggacatgctggtgctgcgcgaacgcgagagcgtccgtcccagctcgtgcgattcgagtcccttgttgtgctgcatgattgaaccacagggtcatatatcgaccccgatagcgcgcacagggtagtaggtattaaagaagtaggatagaaagtgaacgactcggggtataatctcggaggtcaaagagaatggccagaaagaatagggaaatagcacgctagatcatcctagaagtcataaggcataagcatatcttcgtcagcttttccaacaatacgacctccgatgcacagcctagtttgggggccttttgcttgattcgcctttgcgcagtctgccttctgaacggatgccgtaagatggcgtcggaccatcccagactatcaaaagcaaaaacagaaagatgactgtgggggagggcgcaatgagcagcgaaggcgcgaagaaaaaaacaaaggatgaccgaagcaaagcgaggaatggggaaaaaaaaagaaaaataagaagtacagagtaccaacggggtggatgcagggcaaaatagtgtcgcgactaagtagaacgtacccggagaaaggaaccaattaacagtatgtcggggtcatgtcgataagacgcggaaagggatctgaaggaaatcgattccgagagatcaataaagaactgaacggaagtggaaactcattaaagagttctatagaagagaggaggagaaaaaggagagagggaaagagagagagagagagagtgtgtgtagtatgtgtgtaagaaagagagtaagtgaaaggaagaaaggaagaaggaagaaagaaagatctggaatagatgttggtagctgggggagatggatttcaggagtaacagccagccagaagatcccgttgcaatgagagttgctttgctttctcactgtctcttgtctgtctctctttactactactagtctctagctccccattcagacccgagaaatgaaatgtttagtgagttaggattgtctagtattactgactattacaattacagactaactgggcgagttagtaccactttagtctttttttactcgaagcaaaatcaggagaggtggatcccacccttttccctcccggaggaagaagagaaagcagaggcaaatgagggtcgagggggaagtggagcagggggagattgatgggaggcgacggtcgctatgaacggtgaagactaacttgggattatcaaatcttgcggtggaaagtcttatccgtactttgaaggggatgggctggcaatcatctccggattcttgaaagttgtaccagttgtaccagttgcatttagtacaaaagtatattggaggtgttatctacaaagtatcatctaccagaccaaatggaaatgatttgatttgactttggagagcattagactcaccacgagtcggatgtctccaggcacgagcgggttgccgatcttgccactcggacggtgaatgcagtgcgtgtgtgtcatacaacaacaacaacgtggtactattgggatctttcggccgccatgaaccatggatgtccttccagcagcagagggactgttgctctaagaagcagctcaactgccttaggtgaccaagccttgatttattgatggagtaataccttggttggatgagcaatagtaacaaccgtggcttaaagaccgttggaagaagtccatgagctatttttcctttttctttccagagaagcaacgaaggaaaaggcagcgaagcccccaagaaagacaacgatctccagaagccaaaccgactaacaaatgcgccccactcagccttcgaaacaaaaccctaaaaccgtccgactgcaggaaaggggcgctactgtacgtctgtaaccgcttaaccgacccgtgttggcctgcttggccacgccgcctccaggttactctcgtcttaggcgaggttggatgtcactagtaattctctggactttaatgaaaatggaaggtctctgagagtaaaattatccgtgatgttcctgaacgaatttcctggattccccctcttcttctctctcctccctctgcctaaagaatagtaacaaagagacatgccacggttgagcccgtctattggccgtaccagatttcggctcctcatatccttcccgaaaatacttatccagacccatccaacacaaggtcaaactctgatttccgactattaaatccaatcaatacccctgggccgaagcggaaggcagccgtgccagggccaatggacatgggatccaccccccataaccacgggcatcccctcccccctcttcctctttctttcaccttttgagactctgaagaattagagatgagatgaaatggtacttctttcgagaaattacgcaatgaggctcgaaaacaagggtcccgtttccttccagaaatgctaggcattcctgtcaacccaccgtgtagccgtcacggacttcatacaagcaaaagggatgacgaccgagacgaggtcgcaaacatcagaatggcgatcttttgaacggaactgacaaggtagatcatcggtgggtagtaacgacaataatgcatgagcgtactgcatgactctccagcacacgcacacaagttctccatatctaccccatacgctactgaattgccatatgaggctaaaggacgccctgacaaatcttatatgactattcgggaccacaaaaatcctccgaccttccttctcagtattaagctgctgggaagcacagggcatatccctcttggatgtgccgtccccgaagtcactatggagtaagtactaagtctatcttcttgctatttattcctgatccctgcaatccgggtaagtagttactagatacgaattaggtaaaaagccaaagatttgaaataccatttcagggacacccaccaacaccataccccaccatcacgcgatcgaataaccatacatacagcatcacaggaaacatccaaaaaatctcctctccgtgccatcctagtggaccgatcccagtacccaggcatgctcagtcatgaccattggtagacagtggcctccgtggttcacacattccgtggttcggacggccctcgatatagccgttccgggtaagtcctcggatagttaatcgggtacaccaggggacgctggtctatgattggtttccgactacaggttttaatctatctcggatatggtcgctatacccactttgtctttctctccgctgagtccgttcaggtcccaggttcagctcagcccagtcgggtctagttgaatggggaaatatccacgtaaaactccagctgagaccacactgcatgactcaatcagtggctatattaagcgatgggggtcgatagtaaatgggaagtcccaataggctggaaatatacggtaggtacatactctatatcgactcatccattaagaatatgctagttagcacacatattctcccaaggaccatcaatcgaaagagactaatagtctaaagtagcgggggttaagctgtcaaattggtgccaaggacttggaacaaactgagacgatgcgatacaagagagttctagaacatgaattgatcaatgagtgattcagctattgacttggctttcttcttttcagctgcgtctagatcctttatctatcaaatcaaacagtcgacaatcaacctgagtctagactagaatacaatccccacgggagacctccgatcctggcaccttcagcctggtagcaacaacagcaactgcatctcaatcacaccaaccacatcacagcatcacctcgtcctatgccatgcatcctagcgccgcgggagtggctgttcaatagtcaaaagactattatccagttagactacccccatgtcgcataataacgggatgagatcaatactacttgctgcccaaccatacctaccccgaagatctcgaatgcacacccaagcagtgacatcgacggacgtctccagctgatgagatctccactactatctacccaagatcgccacgatctagacctctagataaccataactggctgctctgtgcacaaatcacattcccatgtagtactatgcagttggccttgagtccaaactaaccccgcaatcactcactccctagcccgcacatgctcctgtgtagcgtgcaaggattgtcgtgctttgtattatgttgaagtaactgatcaagtactagagttgaggttctggttctacaaacaacgagatatactccgatacagtggactggctgctacccattgaacctactcagtattaagtactcaccagtttaatcgaatatgtccccctgtacgcagtatctacagcatgtgaaccgtccatcccgatagatacccgtgtgttgggcactgtcacacagcccagcccagtccatccgccacgataggcaagggattccagcagcatcatccattgcagggattagagggacgatcgttcgatcgttcgatcgatcgcatgtgcgtgtgcgtgtgtgccacatcctggcacagcttgcatggacacaccacagtaagtagaaccaaacccggtatacacaagtacaaaggaaatggactcaaagtccgaaccccgaccgatcagaccaagcacagtcgatggaatggatgatgacttgcatatggtccccatctcatgctagccaacttgacatgttactgtatgtgctgtgctccacactggctatgctgtaggtaatacaaatagcaatcaacaatagaaacaaaagaagcacactagagtgtatttagcatagaacaacacagcattccaaccaactcatcacactttcattaaaatcatacgatctaactggctcggtggaggcgatgtggcttcggtaactaagatgttagtacgaagttagttgcatgcatactaacacaagtagtctagtcaatacttgactggctataggcgaattccgttttccgttcataaggcagtttagattaactaattaatcccatctccaggctcctttatttacctaatttaactatgggttagttgcagcctgtttggtttgactgtggcatggctgatgcattgagtcatttgctgctgcggcccactgatctgatctgatctgacatcagctctgatctgttggaagtcagtagttgtttcttccaatgaaaataaactggtgactatgccgtagtcagtgtaagggagtgactaagtaagcaagcaaggatttgctgacatgcactcactactttgcgctaattagaacgggactgaaactcggaggtaaatggcccatgtcataccgagtactctaacctagactacttgccggtagtattgtttggcccccaagcgaccggtttcacggcaggtccgggtatcactccccaagcctcgtgtttcaggtcaggtgaatatccacctcccccgtcttaagtacttactatgcctgtagtatgacaatgtgtgttacagctggacgggctgtgccttgcttgatggacaaaacgttgtttcaagactgacagggaaattttgttcaatagcatcgtatggcatatgattgacacttctatgtttcaggtactgttccgatgatgagacagtattcttctggacggcccgggtcgtgtctattgccttctttggctggtaaaattcacgacctatgacctttggtatggggagaggcactttcagtaataggcactttttatttcaatgtcatactattgataaaaatcatcaggactattgaaccccgctcatgagcttttggtaggaatcggtcgtgccgtgcaatggcacaccgtaaaaagaaaatgacaagcaaaaatcaatatctgggccagttccagttttcaaattcttttcatccgtcatgtcatcatgttttgtatgatctttgactctagtggaccaaaaagccattccagttttccagtgcatacgcaacaccactggtgaagaagctaagctcgtctggccctacatcggtgtcacacgctagtctttcggagagtagattctcgatcttggccagcaagtccttattatgacttctaccggctcccgaggaacgctctgaggcgccttctccattgacgaggctggcaagttctccaaagtcctctttggcaactatgttgcggaaaagcccaatgacgtgattcagcacattgtcaaaataggtcccgctggcactatctaagtccaagtacggcgaatccaggcgaccgatgtagaagtcattcgcttgtttgcgcaggcgggctttgtattcaagatcagggatcccatttatgccattcatgtaggcgaggaacagcctcttgtccaggtcgacgacgtcactggtatgctcttcaggcagctgtttgatcgactcgagcgtactgctgaattcgtcatcctcaatatcgtcgacgtccaggtcgtcgactgactccttgaaccggagtgtgccagatgccagtgcacgttccatgagctcgtggccagtcagctctgcatcacagtcttcatcatcgtccagagacactggagcatcgatatagcgtatgtttgtgtcaaatcggaccataggtccaaaagagatgaaagatccatccaaggattcggaatcgtcttcgtcacatattcggacattatatcggatgcgtcgtcccaccccgagacatggtacatatcatcatcgtcgtcatcactgtcttcgaaaatcgcatcgtagtcgtattccgagttttccgatgcatagcccgactctgattcctcatcttcttcgatttcggaatacggtcttttcaatatgggcttcaaaaaggaaccaagagacggttcggttgcagtcaccgggcctgagacaccagaggtgttcgaggtggtttgcttggtcgacacgacagagacttcgtccgaggcatagcaactgtcatgagagatcgatacttcaagttgagaaaacgttgaagagagagactcccatgactttttgttcatgttttgtgggctcattttggtagaggcctttggcagaataatctggtcaaagaaaattgccaacagcggcaatgaccaagaagatccaaagcagacttgacaaagagattcccactcgcactcgtagcgactgggatgaagagaagtcaattgccttgggcgaaaaatgcagagaggagatttttggatttcaaatagtggcttcgaaggcctccaaatggtttgaaggaatccatggtgaagcacaggcgcaaaggtagtagccgcctagtgagagccgagaaggcccttaaccagaataacctcgcaaaacattatggatatctgtaaattcacttcaagttgggggatagttttgagtcaagacgcatgcgcgtttggttgttggtaaggttcttggccgagatatacggtttaagccctttcttgcccttgaatacacgttcgatttcgatggagtgtctgacgtgatacatatagactgctgggtcgtctgtgaactcggttgttgagttgaatgagaaggcgcagtatttgatgctaggcaaataccgcgacgcgttgaatagtgcttgggtagtatccgtcaactctgcgtgaggatgacggcgttatgggctccgttcggaacttggctgggtgctttgttcgtaaagaggggcaataaccgatggccgatgccctggcgctataatgtcatgcccacttttcgtggggatacgagtggtgcaacgggaggggacgaggggtaaagaacagaaattcgttgagagacagtccctcaaaggaagttcaggtatgataagtctcgacgactgtacgccgagaagtgtctagaatggatgagaaatagcacagtaaccagtgctggggtggaagaaagggatgggaacaaggcgaacctcgcgggtgtcagtcagatttccgtcatcaccacatgaccttggccttgttgcctccctttcctttcctttcctttccggcgctgccatcgggccgatcgcggaatgctcctttaggtctagctgttgcggccgagtctcgctatttcctccaatcagcgctcgtcactactcggctcggagctgcgagtaattccgtgccggagtctctacgtgccgccggtgagtgtttctcatcatgggtgggatgctgtgtacacttgaggtaacattgattgtcgacatttcactgctggagctggcctcttcgcttagatatcctctccatccatgttcctgggctctaatccatatctggcttctttctccaccccaatccaaagctggtggtttacttttctttgaaagagagtcagtccttgtcgaggggaccgcggcacagtgacttcccgaaaaggaaataagcggcactaccgcttgcctttgctacaatgcccaccatcttcgtccgactttcatagtcgagaatgacttacaattgatcagagaatctatactccacacttagcaacactccatgctcggttgtctatgtttaggtgttggtatgcttaacgcactaaaagaagctggccctagaaattcttctgggtggctttctcgacttactgtacctgccagaacgacggtttcggcgaacccctgataagacatcttccaaaccaccacttgccttcaacgtctctcggaagtgcgtggccttgccccgatcgcctgtcgttcgtaagcctaagtattacgaaccccagctccaccagatgctgaggattcgggacaaagaaagggcaacttggccagggaaatgagacggcctcgcttctgagacgaacttatgctgcactaaactctcaatagactggcgaatcatactatctatcttgagacaagaaacaaagaaatcgcgatgaaacatcacacttagagttccgaccctcgcaaagccgaatctacgatacggaccgcctattcttcagcgtaatccaaggccaatgggtacagagctcagcacactcactgaacgtgtaggccagagctgaatgcgaatagctatgtcctccctccttcgccaggacttcagcccgtgaagggggataattatagaaactcgtgttaaacgacgagttaatctacagatctaagaagaggaattttctttctttttttttgagctaatgcttaatgcaaaaagcatacaggaggggcttcgatccaggatgccaaatccttctttccacgcattgttacggggggtgtgcattcttgctaggcccagcattccaatgttcaggccacccagctcaccaacggtagctcaatgagtacccgaagatcattagctccaccatgcgggaagagcgtggagcaaaggttcggtcggggaaatttagtgcaaatcatttgaggctgctatcctacgtatacgactcaggatgagccaaagcaacccaatgacgcttacactcaggtgtcagtcagcccgttgagccccctctccacgtcgtcccttgacgcgtcgagccgtcgaagccggtcgacctccattgtgacactcatagttcgatccagcctcgacatcgattatcaaacaatggcgaggtcggtgtcattggctcagtgctcgctggttcctctgagacccgcccatattcgccctgctgatacctctgcaccctgtttctggcatagtaaaggttgcattcccgcgggtggccatcagtgctccgagcccactgggtagagggtgtctggcagtggatggcacgaatcagccaccgactttgcactcctcctgattggcgacaatggcttgtgggaaaggcatgggccgttctgctcgggcaattgggatggggtgggccatatcgaggggctgcgtattccttgatggcacattccctgcctatcttgcccttgttgagagctcttggaatgtgcacagaatccagcggagaatccagaggctggggcccatcgtagcaattcaaataggagccctctgtctgttgtttgtttgctttgtctactttgcattttgtgcactgttttcttcgattgtcaactcgtcaaactgttccaacactgccagtgcattccatcatcacttcaagccatcgtcatcaccacggccattctggacggatactcggctagcttagccgtcccttactttgcgtcaagctttcctctgcgtcaagcttctgtgcttccgcggccttcgtcgccagtcatatctactcggcccaagtgttcgttgggtcgacctttgacagctactctggtcgtcgccgcaaacggaaagcggcaccccgtctggcacaatgttcgcccagcagttcgaccattccttgaatgatttagatttatttaatcagtacgtcaatatggacagctccagtgtggatggcaacaaagatgtttcattccctggcgatcttgaccaaatatttcagcttgagtcattgtccagcgactttggcgagcactctccggccatctccacatcaacagcgcaaccccatcagcaaccagcccaaaactggagtaaagacttttggtgtctgccccagaacgcggactcttctaccggccaaggccagaatttctctctacaggataccgttcatccatctgccgtttctgagctgggtgtcaactacgaagctccgccgacagcgtgcgctccggaaacccgcccttctccatcgactactccagcaacccctagtcgtaagaccaccaaaagtgctgtgactacgcccaaggtgatacgtcgtcatcgcgaacctaatgatcgtcgtggtccgctgcacaagcagagcttctccccaggcataacacgctccactcaaccccaacggaatagaatggcgtatcctgaagcctgggcgcagcgattcaacaacttcagctttcgcagctcggatgaacgcttgccactgtcaccaccaccttccgacattctcgttcaacaggagaatatggctgcagacaattctgccgtccacctaaaccgcaccgaagcactacccaaggcatcagctgaaatgcctcctcaatatgacaccagcatcttcaaccagtcgcccgctatctccatgccttctccgtcgacagctgcgctagcggggcagcccccgagatatttaagccagtccagcggctcggggttgcccacctcgagccccccttcggctgacgacatcttctcctccccacattcttcagggcctcagtccatgtcttcctggcattccgactctcttggctcttctgggattccatacagcacccccgatctgagtggacaagatggccaagcatggtggtcgccaatggcttcaagagtcccacagcgacagccttcatatcagcagatggtggcgtccccagctgcacagagaccgatccagaactctgcaagtcagagtgacatgctgcaagggggccttatgattcaactggacccctcgtcatacgacctttcaaacacacattcgtcattcccctcgtccggcctgccttccgctccaaatggtcatgagagccgcgcctacatgcagcccactgcatcgtcagtg

(The sequence listing continues in the following parts.)

The invention claimed is:

1. A non-naturally occurring composition comprising a CRISPR-Cas system comprising a polynucleotide encoding a guide-polynucleotide and a polynucleotide encoding Cas protein, wherein the polynucleotide encoding the Cas protein is comprised in at least one AMA vector comprising an AMA1 sequence, wherein the at least one AMA vector is capable of being autonomously maintained in a filamentous fungal host cell wherein the polynucleotide encoding the guide-polynucleotide encodes a guide-sequence that is the reverse complement of a target-polynucleotide in the genome of a filamentous fungal host cell, wherein the target-polynucleotide is a (N)y part of a 5'-(N)yPAM-3' polynucleotide sequence, wherein y is an integer of 8-30, wherein PAM is a protospacer adjacent motif, and wherein PAM is a sequence selected from the group consisting of 5'-XGG-3', 5'-XGGXG-3', 5'-XXAGAAW-3', 5'-XXXX-GATT-3', 5'-XXAGAA-3', 5'-XAAAAC-3', wherein X can be any nucleotide; and W is A or T, and wherein the polynucleotide encoding the guide-polynucleotide has sequence identity with the at least one AMA vector and is capable of recombining with the at least one AMA vector in vivo in the host cell, wherein the guide-polynucleotide is capable of directing binding of the Cas protein at the target-polynucleotide in the host cell to form a CRISPR-Cas complex, wherein the CRISPR-Cas complex is capable of directing cleavage of a polynucleotide at the location of the target-polynucleotide in the host cell, wherein the composition further comprises one or more distinct exogenous polynucleotides that are capable of recombining with the target polynucleotide in the host cell resulting in a modified target-polynucleotide, wherein the filamentous fungal host cell is deficient in a non-homologous end joining (NHEJ) component, and wherein at least one of the exogenous polynucleotides comprises one or more regions of homology with the target-polynucleotide upstream of the PAM associated with the guide sequence or downstream to the PAM associated with the guide sequence, wherein the homologous region is at most 0.5 kb.

2. The composition according to claim 1, further comprising a second distinct polynucleotide encoding a distinct guide-polynucleotide, wherein said polynucleotides encoding the guide-polynucleotides additionally comprise sequence identity with each other and are each capable of recombining with the at least one AMA vector-in the host cell.

3. The composition according to claim 1, further comprising an additional polynucleotide that has sequence identity with the polynucleotide encoding a guide-polynucleotide and with the at least one AMA vector and is capable of facilitating recombination of the polynucleotide encoding the guide-polynucleotide and the at least one AMA vector in the host cell.

4. The composition according to claim 1, wherein the polynucleotide encoding the Cas protein and the polynucleotide encoding the guide-polynucleotide are comprised in one AMA vector.

5. The composition according to claim 1, wherein the at least one AMA vectors comprise a selectable marker.

6. The composition according to claim 1, wherein at least two distinct exogenous polynucleotides are present that are capable of recombining with the target-polynucleotide, resulting in a modified target-polynucleotide, wherein said at least two distinct exogenous polynucleotides comprise sequence identity with each other and are capable of recombination with each other in the host cell.

7. The composition according to claim 1, wherein two distinct exogenous polynucleotides are present, and further comprising a third distinct exogenous polynucleotide that is capable of recombining with the target-polynucleotide, resulting in a modified target-polynucleotide, and wherein a fourth polynucleotide is present that has sequence identity with the distinct exogenous polynucleotides and is capable of recombining with the exogenous and distinct polynucleotides in the host cell.

8. The composition according to claim 1, wherein the Cas protein comprises at least one nuclear localization sequence.

9. The composition according to claim 1, wherein the Cas protein has activity for directing cleavage of both polynucleotide strands at the location of the target-sequence.

10. The composition according to claim 1, wherein the Cas protein comprises at least one mutation, such that the protein can direct cleavage of a single polynucleotide strand at the location of the target-sequence.

11. The composition according to claim 1, wherein the Cas protein encoding polynucleotide is codon optimized for the host cell.

12. The composition according to claim 1, wherein the guide-polynucleotide is encoded by a polynucleotide that is operably linked to an RNA polymerase II or III promoter.

13. The composition according to claim 1, wherein the polynucleotide encoding the guide polynucleotide is operably linked to an RNA polymerase II promoter and further encodes a pre-guide-polynucleotide comprising i) the guide-polynucleotide and ii) a self-processing ribozyme, wherein, when transcribed, the self-processing ribozyme is capable of releasing the guide-polynucleotide.

14. A method of modulating expression of a polynucleotide in a cell, comprising contacting a host cell with the composition according to claim 1, wherein the guide-polynucleotide directs binding of the Cas protein at the target-polynucleotide in the host cell to form a CRISPR-Cas complex.

15. The method according to claim 14, wherein the host cell comprises a polynucleotide encoding a compound of interest.

16. The method according to claim 14, wherein the host cell is a recombinant host cell.

17. A filamentous fungal host cell comprising the composition according to claim 1.

18. A method of producing a filamentous fungal host cell, comprising contacting a filamentous fungal host cell with the composition according to claim 1, wherein the guide-polynucleotide directs binding of the Cas protein at the target-polynucleotide in the host cell to form a CRISPR-Cas complex, wherein the filamentous fungal host cell is deficient in an NHEJ (non-homologous end joining) component.

19. The method according to claim 18, wherein the filamentous fungal host cell comprises a polynucleotide encoding a compound of interest.

20. The method according to claim 18, wherein the host cell is a recombinant filamentous fungal host cell.

21. The composition according to claim 1, wherein the homologous region is at most 100 bp.

22. The composition according to claim 1, wherein the filamentous fungal host cell is an *Aspergillus*, a *Penicillium*, a *Rasamsonia* or a *Mortierella*.

23. The composition according to claim 5, wherein each AMA vector contains a distinct selectable marker.

24. The composition according to claim 8, wherein the at least one nuclear localization sequence is a heterologous nuclear localization sequence to the filamentous fungal host cell.

25. The composition according to claim 12, wherein the promoter is selected from the group consisting of a human H1 RNA polymerase III promoter, a human U6 RNA polymerase III promoter, and a yeast SNR52p RNA polymerase III promoter.

* * * * *